United States Patent 11,596,699 (RNA ENCODING AN ANTIBODY) - sequence listing, part 2

SEQ ID NO: 4279 - protein, 126 aa, Artificial Sequence
  anti-HIV_Chain
QVQLVQSGAAVKKPGASVKVSCEAYGYKFTDHFMHWWRQAPGQGLEWMGWINPYTSAVNYSPKYQGRVTMTRDTFLETVYMELRGLRVDDTAIYYCATPKSGRDYWSFDLWGQGTLVTVSSASTKG

SEQ ID NO: 4280 - protein, 126 aa, Artificial Sequence
  anti-HIV_Chain
QVQLVQSGAAVKKPGASVKVSCETYGYKFTDHFMHWWRQAPGQGLEWMGWINPYSSAVSYSPRYQGRVTMTRDTFLETVYMELRGLRFDDTAIYYCATPKSGRDYWSFDLWGQGTLVTVSSASTKG

SEQ ID NO: 4281 - protein, 126 aa, Artificial Sequence
  anti-HIV_Chain
QVQLVQSGAAVKKPGASVKVSCETYGYTFTDHFMHWWRQAPGQGLEWMGWINPYSSAVSYSPRYQGRVTMTRDTFLETVYMELRGLKFDDTAIYYCATPKSGRDYWSFDLWGQGTLVTVSSASTKG

SEQ ID NO: 4282 - protein, 126 aa, Artificial Sequence
  anti-HIV_Chain
QVQLVQSGAEVKKPGSSVKVSCKTSGVRFSSNAISWVRQAPGQGLEWMGRTTPMLGGANHAPSFKGRVTISADESTRTVYMEMSSLRYEDTAVYYCASGRREGLNFLLDYWGQGTLVTVSSASTKG

SEQ ID NO: 4283 - protein, 126 aa, Artificial Sequence
  anti-HIV_Chain
QVQLQESGPGLVKPSETLSLTCTVSGGSISTYYWSWIRQPPGKGLEWIGYISYSGSTNYNPSLKSRVTISVDTSKNQFSLKLSSVTAADTAVYYCARHKSVLLWFRELDYWGQGTLVTVSSASTKG

SEQ ID NO: 4284 - protein, 126 aa, Artificial Sequence
  anti-HIV_Chain
QVQLVQSGAEVKKPGAAVKISCKASRFTFSSYYIHWVRQAPGQGLEWMGIINPSGGSTSNAQKFQDRVTLTRDMSTGTVYMELSRLTSEDTAVYYCATPEPSSIVAPLYYWGQGTLVTVSSASTKG

SEQ ID NO: 4285 - protein, 126 aa, Artificial Sequence
  anti-HIV_Chain
QVQLVQSGAEMKKPGASVKVSCKASGHTFTNYYMHWVRQAPGQGLEWMGMINPTGDSTRYAQRFQGRVTMTRDTSTRTVYMELSSLRSDDTAVYYCARAHHDFWRAPVDVWGKGTTVTVSSASTKG

SEQ ID NO: 4286 - protein, 126 aa, Artificial Sequence
  anti-HIV_Chain
QVVLIQSGAEVKRPGSSVKVSCKASGGSFPITWVRQAPGHGLEWMGGINPFFGTTNYAQKFQGRVSITADESTSTTYLHLSDLRSEDTAVYFCARENREKWLVLRSWFAPWGQGTLVTVSSASTKG

SEQ ID NO: 4287 - protein, 126 aa, Artificial Sequence
  anti-HIV_Chain
SQQLVQSGAQVKKPGASVRVSCQASGYTFTNHFLHWWRQAPRQGLEWMGWINPVHGGRNYARRFQGRINFGRDVYQETAYMELSGLRNDDTATYFCARGGGDGRNWHLHPWGQGTLVIVSAASTKG

SEQ ID NO: 4288 - protein, 126 aa, Artificial Sequence
  anti-HIV_Chain
EVQVVESGGGLVQPGGSLRLSCVASGFTFSEYWMSWVRQAPGKGLEWVATIKRDGSEESYVDSVKGRFTISRDNAKNSLYLQMNSLRAEDTAVYYCARVRDPNYNLHFDSWGQGTLVTVSSASTKG

SEQ ID NO: 4289 - protein, 126 aa, Artificial Sequence
  anti-HIV_Chain
LVQLVESGGGVVQPGKSLRLSCATSGFTFSTYGMHWVRQAPGKGLEWVAVIWYDGSYKYYADSVKGRFTISRDNSKNTLFLQMNSLRAEDTAMYYCGREMAVGGTKALDHWGQGTLVTVSSASTKG

SEQ ID NO: 4290 - protein, 126 aa, Artificial Sequence
  anti-HIV_Chain
EFQLVQSGGGLVKPGGSLRLSCTGSTFSFSSDDMNWVRQAPGKGLEWVSSMSDSGSHIYYADFVKGRFTISRDNAKKSLYLQMNSLRAEDTAVYYCAQSRPPQRLYGMDVWGQGTTVTVSSASTKG

SEQ ID NO: 4291 - protein, 127 aa, Artificial Sequence
  anti-HIV_Chain
EVQLVESGGGVVQPGGSLRLSCAASGFMFKNYAMHWVRQPPGKGLEWVAVIWYGGRDQNYADSVKGRFTISRDDSDNTLYLQMNSLRAGDTAVYFCARNSQVGRLMPAAGVWGQGTLVTVSSASTKG

SEQ ID NO: 4292 - protein, 127 aa, Artificial Sequence
  anti-HIV_Chain
QGHLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSAST

SEQ ID NO: 4293 - protein, 127 aa, Artificial Sequence
  anti-HIV_Chain
QVQLLESGGGLVQRGGSLRLSCTASGFVFNNYWMTWVRQAPGNGLEWVANIDQDGSEKHYLDSVKGRFTISRDNAKNSLYLQMNSLRAEDTAIYYCARVRFKVTAWHRFDSWGQGDLVTVSSTSTKG

SEQ ID NO: 4294 - protein, 127 aa, Artificial Sequence
  anti-HIV_Chain
QSALTQPPSASGTPGQRVTISCSGSYHNIGSNAVNWYQQLPGTAPKLLIYSNDQRPSGVPDRFSGSKSGTSASLAISGLQSEDEADYYCAAWDDSLHVFGTGTKVTVLGQPKANPTVTLFPPSSEEL

SEQ ID NO: 4295 - protein, 127 aa, Artificial Sequence
  anti-HIV_Chain
QSVLTQVLSVSGTPGQRVIISCSGTSSNVGGNLVSWYQHLPGAAPRLLIHRDDQRPSGVPDRFSGSKSGNSASLVISGLRSDDEADYFCAAYDSTFSLPVFGGGTRLTVLSQPKAAPSVTLFPPSSE

SEQ ID NO: 4296 - protein, 127 aa, Artificial Sequence
  anti-HIV_Chain
QVQLLQSGAAVTKPGASVRVSCEASGYNIRDYFIHWWRQAPGQGLQWVGWINPKTGQPNNPCQFQGRVSLTRHASWDFDTFSFYMDLKALRSDDTAVYFCARQRSDYWDFDVWGSGTQVTVSSASTK

SEQ ID NO: 4297 - protein, 127 aa, Artificial Sequence
  anti-HIV_Chain
QVQLVQSGGEVRKPGSSVKVPCKISGNAFSNYGVNWVRQAPGQGLEWVGRIIPVIGVAQHAPKFQGRVTITADKSTTTAYLELSSLRSDDTAVYFCAKDHGDPRTGYYFDYWGQGALVTVSSASTKG

SEQ ID NO: 4298 - protein, 127 aa, Artificial Sequence
  anti-HIV_Chain
QVQLGQSGTEVKKPGFSVKVSCKASGGSSTAYGYSWVRQAPGQGFEWMGRIIPFYGIITYAPKFQGRVTITADRSTSTVYMELTSLTFADTALFFCARDFGDPRNGYYFDSWDQGLWLTVSSASTKG

SEQ ID NO: 4299 - protein, 127 aa, Artificial Sequence
  anti-HIV_Chain
QVQLVQSGAEVKKPGSSVKVSCKASGGTFSNYAISWVRQAPGQGLEWMGGIIPIFEAASYAQKFQDRLTITTDESTTTAYMDLSSLRSEDTAIYYCARAQGDILTEGYFDYWGQGTLVTVSSASTKG

SEQ ID NO: 4300 - protein, 127 aa, Artificial Sequence
  anti-HIV_Chain
QVQLQESGPGLVKPSETLSLTCTVSGGSISSAGYYWSWIRQHPEKGLEFIGYIYYLGTTYYNPSLKSRVSISIDTSNNQFSLELSSVSAADTAIYYCARDYTASGRHFFDYWGQGTLVTVSSASTKG

SEQ ID NO: 4301 - protein, 127 aa, Artificial Sequence
  anti-HIV_Chain
QVQLVQSGAEVKKPGASVKVSCKAPGYTFIGHYMHWIRQAPGQGLEWMGWINPNSGDTNYAQTFQGRVTMTRDTSISTAYMELTRLRSDDTAVYYCARDLRPMRGNWAMHVWGEGTTVTVSSASTKG

SEQ ID NO: 4302 - protein, 127 aa, Artificial Sequence
  anti-HIV_Chain
QVQLQESGPGLVKPSETLSLTCTVFGASIRSFYWHWIRQSPGKGLEWLGSVFDNGLTTYNPSLKNRLSISEDPSRNQISLNLRSMTAADTAVYYCARADYDLLTSSYHFDSWGQGTLVTVSSASTKG

SEQ ID NO: 4303 - protein, 127 aa, Artificial Sequence
  anti-HIV_Chain
SQQLVQSGTQVKKPGASVRVSCQASGYTFTDYVLHWWRQAPGQGLEWMGWIKPVYGARNYAHRFQGRINFDRDVYREIAYMDLSGLRSDDTAVYFCARDGSGDATSWHLHPWGQGTLVIVSSASTKG

SEQ ID NO: 4304 - protein, 127 aa, Artificial Sequence
  anti-HIV_Chain
SQQLVQSGTQVKKPGASVRVSCQASGYTFTNYILHWWRQAPGRGLEWMGLIKPVYGAVNYARQFQGRIQLTRDIYREIAFLDLSGLRPDDTAVYYCARDESGYDLNWHLDSWGQGTQVIVSPASTKG

SEQ ID NO: 4305 - protein, 127 aa, Artificial Sequence
  anti-HIV_Chain
SQQLVQSGAQVKKPGASLRVSCQASGYTFMNYLLHWWRQAPGQGLEWMGWINPVYGAVNYAHRFQGRLTFSRDVYREIAYMDLNGLRSDDTAVYFCARDGSGDDRNWHLDPWGQGTLVIVSSASTKG

SEQ ID NO: 4306 - protein, 127 aa, Artificial Sequence
  anti-HIV_Chain
SQQLVQSGTQVKKPGASVRISCQASGYTFTDYVLHWWRQAPGQGLEWMGWIKPVYGARNYARRFQGRINFDRDIYREIAFLDLSGLRSDDTARYFCARDGSGDDTSWHLHPWGQGTLVIVSAASTKG

SEQ ID NO: 4307 - protein, 127 aa, Artificial Sequence
  anti-HIV_Chain
SQQLVQSGTQVKKTGASVRVSCQASGYDFTKYLIHWWRQAPGQGLEWMGWMKPVYGATNYAHRFQGRISFTRDIYREIAFMDLNGLRSDDTAVYFCARDGGGDDRTWLLDAWGQGTLVIVSSASTKG

SEQ ID NO: 4308 - protein, 127 aa, Artificial Sequence
  anti-HIV_Chain
SQQLVQSGTQVKKPGASVRVSCQASGYTFMNYIIHWWRQAPGQRLEWMGWINPVFGARNYAHRFQGRINFDRDINRETFQMDLTGLRSDDTAVYYCARDGSGDARDWHLHPWGQGTLVIVSSASTKG

SEQ ID NO: 4309 - protein, 127 aa, Artificial Sequence
  anti-HIV_Chain
SQHLVQSGTQVKKPGASVRVSCQASGYTFTNYILHWWRQAPGQGLEWMGLIKPVFGAVNYARQFQGRIQLTRDINREIAFLDLSGLRSDDTAVYYCARDESGDDLKWHLHPWGQGTQVIVSPASTKG

SEQ ID NO: 4310 - protein, 127 aa, Artificial Sequence
  anti-HIV_Chain
SQQLVQSGTQVKKPGASVRVSCQASGYTFMNYIIHWWRQAPGQRLEWMGWINPVFGARNYAHRFQGRINFDRDINRETFQMELTGLRSDDTAVYYCARDGSGDARDWHLDPWGQGTLVIVSSASTKG

SEQ ID NO: 4311 - protein, 127 aa, Artificial Sequence
  anti-HIV_Chain
SQQLVQSGTQVKKPGASVRISCQASGYTFTDYVLHWWRQAPGQGLEWMGWIKPVYGARNYARRFQGRINFDRDIYREIAYMDLSGLRSDDTARYFCARDGSGDDTSWHLHPWGQGTLVIVSAASTKG

SEQ ID NO: 4312 - protein, 127 aa, Artificial Sequence
  anti-HIV_Chain
SQQLVQSGTQVKKPGASVRISCQASGYSFTDYVLHWYRQAPGQGLEWMGWIKPVYGARNYARRFQGRINFDRDIYREIAFMDLSGLRSDDTALYFCARDGSGDDTSWYLDPWGQGTLVIVSAASTKG

SEQ ID NO: 4313 - protein, 127 aa, Artificial Sequence
  anti-HIV_Chain
SQQLVQSGTQVKKPGASVRISCQASGYSFTDYVLHWWRQAPGQGLEWMGWIKPVYGARNYARRFQGRINFDRDIYREIAFMDLSGLRSDDTALYFCARDGSGDDTSWHLDPWGQGTLVIVSAASTKG

SEQ ID NO: 4314 - protein, 127 aa, Artificial Sequence
  anti-HIV_Chain
SQHLVQSGTQVKKPGASVRVSCQASGYTFTNYILHWWRQAPGQGLEWMGLIKPVFGAVNYARQFQGRIQLTRDIYREIAFLDLSGLRSDDTAVYYCARDESGDDLKWHLHPWGQGTQVIVSPASTKG

SEQ ID NO: 4315 - protein, 127 aa, Artificial Sequence
  anti-HIV_Chain
QVQLVESGGGVVQPGKSLRLSCAISGFLFNNYGGQWVRQAPGKGLEWVAAISYDGNNRYYADSAKGRFLISRDTPKNILYLQIYSLRLDDTAVYYCARDSVSKSYSAPPEFWGQGTVVTVSSASTKG

SEQ ID NO: 4316 - protein, 127 aa, Artificial Sequence
  anti-HIV_Chain
QVHLEESGPGLVKTSQTLSLTCSVSSYSISRSGYFWTWIRQRPGKGLEWIGYIYFNGRTTYNPSLKSRITISRDTSHSQFSLTLNSLSAADTAVYYCGRCQDGLASRPIDFWGQGTLVTVSSASTKG

SEQ ID NO: 4317 - protein, 127 aa, Artificial Sequence
  anti-HIV_Chain
QVQLVESGGGVVQPGRSLRLSCATSGFTSKNYGVHWVRQAPGKGLEWVAVIWYDGSNKFYADSVKGRFTISRDRSKNMVYLQMNSLRVEDTAIYYCARDSVAFVLEGPIDYWGQGTLVTVSSASTKG

SEQ ID NO: 4318 - protein, 128 aa, Artificial Sequence
  anti-HIV_Chain
QVQLVQSGGGVKKPGTSASFSCRTSDDIYDNEFFDSAFMHWVRLIPGQRPEWMGWMNPRSGAVNYARQLQPRVSMYRDRDLSTAYMEFKSLTSADTGTYFCARKKRGDGFNLYFDLWGRGSQVIVSSA

SEQ ID NO: 4319 - protein, 128 aa, Artificial Sequence
  anti-HIV_Chain
QGHLVQSGGGVKKLGTSVTISCLASEDTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTS

SEQ ID NO: 4320 - protein, 128 aa, Artificial Sequence
  anti-HIV_Chain
QSALTQPPSVSGAPGQRVTISCSGGPSNVGGNYVYWYRQFPGTAPKLLILRDDQRPSGVPDRFSASKSGNSASLAISGLRPDDEAFYFCATYDSQGSFRVFGGGTALTVLSQPKAAPSVTLYPPSSEE

SEQ ID NO: 4321 - protein, 128 aa, Artificial Sequence
  anti-HIV_Chain
NFMLTQPPSASGTPGQRVTISCSGGGSNIGGNLVSWYQHFPGAAPKLLIYRNDQRPSGVPDRFSGSKSGTSASLAISGLRSDDKATYFCAAYDSTLSLRLFGGGTTLTVLSQPKAAPSVTLFPPSSEE

SEQ ID NO: 4322 - protein, 128 aa, Artificial Sequence
  anti-HIV_Chain
NFMLTQPPSVSATPGQTVTISCSGSGSNVGGNHVYWYRQLPGAAPTLVISKTDHRPSRVPDRFSGSKSGNSASLAISGLRPDDEAVYFCATYDTGLSLRLFGGGTRLTVLSQPKAAPSVTQFPPSSEE

SEQ ID NO: 4323 - protein, 128 aa, Artificial Sequence
  anti-HIV_Chain
QSALTQPPSASGAPGQRVTISCSGGPSNVGGNYVYWYRQFPGTAPKLLILRDDQRPSGVPDRFSASKSGNSASLAISGLRPDDEALYFCATYDSDGSIRLFGGGTALTVLSQPKAAPSVTLFPPGWEE

SEQ ID NO: 4324 - protein, 128 aa, Artificial Sequence
  anti-HIV_Chain
QVQLLQSGAAVTKPGASVRVSCEASGYNIRDYFIHWWRQAPGQGLQWVGWINPKTGQPNNPRLFQGRVSLTRHASWDFDTFSFYMDLKAVRSDDTAVYFCARQRSDYWDFDVWGSGTQVTVSSASTKG

SEQ ID NO: 4325 - protein, 128 aa, Artificial Sequence
  anti-HIV_Chain
QVQLLQSGAVVTKPGASVRVSCEASGYKIRDYFIHWWRQAPGQGLQWVGWINPQTGQPNIPRPFQGRVTLTRHASWDFDTFSFYMDLKALRSDDTAIYFCARRRSDYCDFDVWGSGTHVTVSSASTKG

SEQ ID NO: 4326 - protein, 128 aa, Artificial Sequence
  anti-HIV_Chain
QVQLLQSGAAVTKPGASVRVSCEASGYNIRDYFIHWWRQAPGQGLQWVGWINPKTGQPNNPRQFQGRVSLTRQASWDFDTISFYMDLKALRLDDTAVYFCARQRSDYWDFDVWGSGTQVTVSSASTKG

SEQ ID NO: 4327 - protein, 128 aa, Artificial Sequence
  anti-HIV_Chain
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVYSASTKG

SEQ ID NO: 4328 - protein, 128 aa, Artificial Sequence
  anti-HIV_Chain
QVQLLPFGGAVTKPGASVRVSCEASGYNIRDYFIHWWRQAPGQGLQWVGWINPKTGQPNNPCQFQGRVSLTRPASWDFDTISFYMDLKALRLDDTAVYFCARQRSDYWDFDVWGSGTQVTVSSASTKG

SEQ ID NO: 4329 - protein, 128 aa, Artificial Sequence
  anti-HIV_Chain
QVHLSQSGAAVTKPGASVRVSCEASGYKISDHFIHWWRQAPGQGLQWVGWINPKTGQPNNPRQFQGRVSLTRQASWDFDTYSFYMDLKALRSDDTAIYFCARQRSDFWDFDVWGSGTQVTVSSASTKG

SEQ ID NO: 4330 - protein, 128 aa, Artificial Sequence
  anti-HIV_Chain
QVHLSQSGAAVTKPGASVRVSCEASGYKISDHFIHWWRQAPGQGLQWVGWINPKTGQPNNPRQFQGRVSLTRQASWDFDTYSFYMDLKAVRSDDTAIYFCARQRSDFWDFDVWGSGTQVTVSSASTKG

SEQ ID NO: 4331 - protein, 128 aa, Artificial Sequence
  anti-HIV_Chain
QVQLLQSGAAVTKPGASVRVSCEASGYKISDHFIHWWRQAPGQGLQWVGWINPKTGQPNNPRQFQGRISLTRQASWDFDTFSFYMDLKALRSDDTAVYFCARQRSDYWDFDVWGSGTQVTVSSASTKG

SEQ ID NO: 4332 - protein, 128 aa, Artificial Sequence
  anti-HIV_Chain
QVQLLQSGAAVTKPGASVRVSCEASGYNIRDYFIHWWRQAPGQGLQWVGWINPKTGQPNNPRQFQGRVSLTRHASWDFDTFSFYMDLKGLRSDDTAIYFCARQRSDYWDFDVWGSGTQVTVSSASTKG

SEQ ID NO: 4333 - protein, 128 aa, Artificial Sequence
  anti-HIV_Chain
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKG

SEQ ID NO: 4334 - protein, 128 aa, Artificial Sequence
  anti-HIV_Chain
HVQLLQSGAAVTKPGASVRVSCEASGYNIRDYFIHWWRQAPGQGLQWVGWINPKTGQPNNPRQFQGRVSLTRQASWDFDTFSFYMDLKALRLDDTAIYFCARQRSDYWDFDVWGSGTQVTVSSASTKG

SEQ ID NO: 4335 - protein, 128 aa, Artificial Sequence
  anti-HIV_Chain
QVHLSHSGAAVTKPGASVRVSCEASGYKISDHFIHWWRQAPGQGLQWVGWINPKTGQPNNPRQFQGRISLTRQASWDFDTFSFYMDLKALRSDDTAVYFCARQRSDYWDFDVWGSGTQVTVSSASTKG

SEQ ID NO: 4336 - protein, 128 aa, Artificial Sequence
  anti-HIV_Chain
QVHLSQSGAVVTKPGASVRVSCEASGYKISDHFIHWWRQAPGQGLQWVGWINPKTGQPNNPRQFQGRISLTRQASWDFDTFSFYMDLKALRSDDTAVYFCARQRSDYWDFDVWGSGTQVTVSSASTKG

SEQ ID NO: 4337 - protein, 128 aa, Artificial Sequence
  anti-HIV_Chain
QVHLSQSGAVVTKPGASVRVSCEASGYKISDHFIHWWRQAPGQGLQWVGWINPKTGQPNNPRQFQGRISLTRQASWDIDTFSFYMDLKALRSDDTAVYFCARHRSDYWDFDVWGSGTQVTVSSASTKG

SEQ ID NO: 4338 - protein, 128 aa, Artificial Sequence
  anti-HIV_Chain
QVHLSQSGAVVTKPGASVRVSCEASGYKISDHFIHWWRQAPGQGLQWVGWINPKTGQPNIPRQFQGRISLTRQASGDFDTFSFYMDLKALRSDDTAVYFCARQRSDYWDFGVWGSGTQVTVSSASTKG

SEQ ID NO: 4339 - protein, 128 aa, Artificial Sequence
  anti-HIV_Chain
QVHLSQSGAVVTKPGASVRVSCEASGYKISGHFIHWWRQAPGQGLQWVGWINPKTGQPNNPRQFQGRISLTRQASWDFDTFSFYMDLKALRSDDTAVYFCARHRSDYWDFDVWGSGTQVTVSSASTKG

SEQ ID NO: 4340 - protein, 128 aa, Artificial Sequence
  anti-HIV_Chain
QVHLSQSGAAVTKPGASVRVSCEASGYKISDHFIHWWRQAPGQGLQWVGWINPKTGQPNNPRQFQGRISLTRQASWDFDTFSFYMDLKALRSDDTAVYFCARHRSDYWDFDVWGSGTQVTVSSASTKG

SEQ ID NO: 4341 - protein, 128 aa, Artificial Sequence
  anti-HIV_Chain
QVHLSQSGAAVTKPGASVRVSCEASGYKISDHFIHWWRQAPGQGLQWVGWINPKTGQPNNPRQFQGRVSLTRQASWDFDTYSFYMGLKAVRSDDTAIYFCARQRSDFWDFDVWGSGTQVTVSSASTKG

SEQ ID NO: 4342 - protein, 128 aa, Artificial Sequence
  anti-HIV_Chain
QVHLSQSGAVVTKPGASVRVSCEASGYKISDHFIHWWRQAPGQGLQWVGWINPKTGQPNNPRQFQGRISLTRQASWDFDTFSFYMDLKALRSDDTAVYFCARHRSDYWDFDVWGSGTQVTVSSASTKG

SEQ ID NO: 4343 - protein, 128 aa, Artificial Sequence
  anti-HIV_Chain
QVHLSQSGAVVTKPGASVRVSCEASGYKISDHFIHWWRQAPGQGLQWVGWINPKTGQPNNPRQFQGRISLTRQASWDFDTFSFYMDLEALRSDDTAVYFCARQRSDYWDFDVWGSGTQVTVSSASTKG

SEQ ID NO: 4344 - protein, 128 aa, Artificial Sequence
  anti-HIV_Chain
QVHLSQSGAAVTKPGASVRVSCEASGYKIRDYSIHWWRQAPGQGLQWVGWINPQTGQPNIPRPFQGRISLTRQASWDFDTFSFYMDLEALRSDDTAVYFCARQRSDYWDFDVWGSGTQVTVSSASTKG

SEQ ID NO: 4345 - protein, 128 aa, Artificial Sequence
  anti-HIV_Chain
QVHLSQSGAAVTKPGASVRVSCEASGYKISDHFIHWWRQAPGQGLQWVGWINPKTGQPNNPRQFQGRISLTRQASWDFDTFSFYMDLKALRSDDTAVYFCARQRSDYRDFDVWGSGTQVTVSSASTKG

SEQ ID NO: 4346 - protein, 128 aa, Artificial Sequence
  anti-HIV_Chain
QVHLSQSGAVVTKPGASVRVSCEASGYKISDHFIHWWRQAPGQGPQWVGWINPKTGQPNNPRQFQGRISLTRQASWDFDTFSFYMDLKALRSDDTAVYFCARHRSDYWDFDVWGSGTQVTVSSASTKG

SEQ ID NO: 4347 - protein, 128 aa, Artificial Sequence
  anti-HIV_Chain
QVRLLQSGAAVTKPGASVRVSCEASGYEIRDYFIHWWRQAPGQGLQWVGWINPKTGQPNNPRQFQGRVSLTRQASWDFDSYSFYMDLKALRSDDTAVYFCARQRSDYWDFDVWGSGTQVTVSSASTKG

SEQ ID NO: 4348 - protein, 128 aa, Artificial Sequence
  anti-HIV_Chain
QVRLLQSGAAVTKPGASVRVSCEASGYEIRDYFIHWWRQAPGQGLQWVGWINPKTGQPNNPRQFQGRVSLTRQASWDFDSYSFYMDLKALRSDDTGVYFCARQRSDYWDFDVWGSGTQVTVSSASTKG

SEQ ID NO: 4349 - protein, 128 aa, Artificial Sequence
  anti-HIV_Chain
QVRLLQSGAAVTKPGASVRVSCEASGYEIRDYFIHWWRQAPGQGLQWVGWINPKTGQPNNPRQFQGRVSLTRQASWDFDSYSFYMDLKALRSDDTAVYFCARQRSDYWDFDVWGSGSQVTVSSASTKG

SEQ ID NO: 4350 - protein, 128 aa, Artificial Sequence
  anti-HIV_Chain
QVQLLQSGAAVTKPGASVRVSCEASGYNIRDYFIHWWRQAPGQGLQWVGWINPKTGQPNNPCQFQGRVSLTRQASWDFDTISFYMDLKALRLDDTAVYFCARQRSDYWDFDVWGSGTQVTVSSASTKG

SEQ ID NO: 4351 - protein, 128 aa, Artificial Sequence
  anti-HIV_Chain
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVIVSSASTKG

SEQ ID NO: 4352 - protein, 128 aa, Artificial Sequence
  anti-HIV_Chain
QVQLVQSGADVKKPGATVTVSCKTDEDEDDFRAHLMQWMRQAPGQRLEWVGWIKPQTGQPSYGQKFQGRVTLTREVSTSTVFLQLRNLRSDDTAVYYCARPRGGRDNWSFHVWGRGTLVTVSSASTKG

SEQ ID NO: 4353 - protein, 128 aa, Artificial Sequence
  anti-HIV_Chain
EVQLVESGAEVKKPGASVKVSCKVSGNSLTEFSIHWVRQAPGKGLEWMGGFDPEEGETVPAQKFKGRLTMTEDTSTNTAYMELSSLRSEDTAVYYCSTEPREMGTLTAGFEYWGQGTLVTVSSASTKG

SEQ ID NO: 4354 - protein, 128 aa, Artificial Sequence
  anti-HIV_Chain
RVQLGQSGAEVKKPGASVKVSCKVSGNSLTEFSIHWVRQAPGKGLEWMGGFDPEEGETVPAQKFKGRVTMTEDTSTNTAYMELSSLRSEDTAVYYCSTEPREMGTLTAGFEYWGQGTLVIVSSASTKG

SEQ ID NO: 4355 - protein, 128 aa, Artificial Sequence
  anti-HIV_Chain
QVQLVQSGADVKKPGASVTVSCKTDEDEDDFRAHLVQWMRQAPGQRLEWVGWIKPQTGQPSYAQKFQGRVTLTREVSTSTVFLQLRNLRSDDTAVYYCARPRGGRDNWSFHVWGRGTLVTVSSASTKG

SEQ ID NO: 4356 - protein, 128 aa, Artificial Sequence
  anti-HIV_Chain
QVQLQESGPGLVKPSETLSLTCSVSGASISNFYWTWIRQPAGKGLEWVGRLYSSDRTNYNPSLNGRVTMSLDTSKNQFSLRLTSMTDADTAIYFCAREKGQWLTVPPYYFDSWGQGILVTVSSASTKG

SEQ ID NO: 4357 - protein, 128 aa, Artificial Sequence
  anti-HIV_Chain
QVQLVQSGAEVRKPGASVKVSCKTSGYTFTNSYIHWVRQAPGQGLEWMGIINPPGGNTYYAQKFHGRVTLTRDTSTSTVYMELNSLRSEDTAVYFCARPHSPTNIPSRPLDYWGQGTLVTVSSASTKG

SEQ ID NO: 4358 - protein, 128 aa, Artificial Sequence
  anti-HIV_Chain
QVQLQESGPGLVKPSGTLSLTCNVYGGSMISYYWSWIRQPPGKGLEWIGHVYNSGNTKYSPSLKNRVTISMDTSRNLFSLKVTSVTPADTAVYYCARADYDNIWDSRGGFDLWGQGTLVTVSSASTKG

SEQ ID NO: 4359 - protein, 128 aa, Artificial Sequence
  anti-HIV_Chain
QVQLVQSGAEVKKPGSSVKVSCKASGGTLSSYTISWVRQAPGQGLEWMGRLIPLVDITTYAQKFQGRVTITADTSTNTAYMELSNLRSEDTAIYHCATSTMIAAVINDAFDLWGQGTTVTVSSASTKG

SEQ ID NO: 4360 - protein, 128 aa, Artificial Sequence
  anti-HIV_Chain
QVQLVQSGAEVKKPGASVKISCKASGYSFRNYAVHWVRQAPGQGLEWMGEINGGNGNTEYSQKSQGRLTITRDISATTAYMELSSLRSDDTAVYYCARVAYVHVVTTRSLDNWGQGTLVTVSSASTKG

SEQ ID NO: 4361 - protein, 128 aa, Artificial Sequence
  anti-HIV_Chain
QVRLSQSGAAVMKTGASVTISCETEGFNFVNYIIHWVRRPPGRGFEWLGMIDPRNGHPWFAQTVRGRLSLRRDTFNEIVYMTLSGLTTDDTGLYFCARNEPQYHSLPGMFDYWGQGTPVTVSSASTKG

SEQ ID NO: 4362 - protein, 128 aa, Artificial Sequence
  anti-HIV_Chain
QVRLSQSGAAVVKTGASVTISCETEGYNFVNYIIHWVRRPPGRGFEWLGMIDPRNGHPWFAQTVRGRLSLRRDTFKETVYMTLSGLTSDDTGVYFCARNEPQYHSLPGMFDYWGHGTPVTVSSASTKG

SEQ ID NO: 4363 - protein, 128 aa, Artificial Sequence
  anti-HIV_Chain
QGQLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTS

SEQ ID NO: 4364 - protein, 128 aa, Artificial Sequence
  anti-HIV_Chain
QVQLVQSGAEVKKPGASVKVSCKASGYTFTSYDINWVRQATGQGLEWMGWMNPNSGNTGYAQTFQGRVTMTRNTSISTAYMELSSLRSEDTAVYYCARDRWLPQYYYYGMDVWGQGTTVTVSSASTKG

SEQ ID NO: 4365 - protein, 128 aa, Artificial Sequence
  anti-HIV_Chain
QVQLVQSGAEVKKPGSSMKVSCKSSGGTFSNHAISWVRQAPGKGLEWMGGIIPMSGTTNYLQKFQGRVTITADEFATTAYMELSSLTSEDTAVYYCARARADSHTPIDAFDIWGPGTRVIVSSASTKG

SEQ ID NO: 4366 - protein, 128 aa, Artificial Sequence
  anti-HIV_Chain
QVQLVQSGAEVKKPGASVKVSCKVSGYTLTELSIHWVRQAPGKRLEWMGGFDPEDGERIYAQKFQGRVTMTEDTSTDTAYMELNSLRSDDTAVYYCATGGLYCSSISCIMDVWGQGTTVTVSSASTKG

SEQ ID NO: 4367 - protein, 128 aa, Artificial Sequence
  anti-HIV_Chain
QVQLVQSGAEVKMPGASVKVSCKVSGYSLTELSIHWVRQAPGKRLEWMGGFDPEDDERIYAQKFQDRVTMTEDTSTDTAYMDLNSLRSEDTAVYYCTTGGLYCSSISCIMDVWGQGTTVIVSSASTKG

SEQ ID NO: 4368 - protein, 129 aa, Artificial Sequence
  anti-HIV_Chain
EVQLSESGGGFVKPGGSLRLSCEASGFTFNNYAMSWVRQAPGKGLEWVSVTSAHGGSAYYGEFVKGRFTMSRDHFIDTVYLEMNGLTVEDTAVYYCVRVTFYHEGSGYYYRAGNYFDSWGKGTRVVVSA

SEQ ID NO: 4369 - protein, 129 aa, Artificial Sequence
  anti-HIV_Chain
EVQLSESGGGFVKPGGSLRLSCEASGFTFNNYAMSWVRQAPGKGLEWVSVTSAHGGSAYYGEFVKGRFTMSRDHFIDTVYLEMNRLTVEDTAVYYCVRVTFYHEGSGYYYRAGNYFDSWGKGTRVVVSA

SEQ ID NO: 4370 - protein, 129 aa, Artificial Sequence
  anti-HIV_Chain
EVQLSESGGGVVKPGGSLRLSCEASGFTFSNYAMSWVRQAPGKGLEWVSVTGGHGTYGYYGEFVKGRFTISRDHSMDTVYLQMNRLRVEDTAVYYCVRTPYYHESSGYYYRAGNYFDFWGKGTLVIVSA

SEQ ID NO: 4371 - protein, 129 aa, Artificial Sequence
  anti-HIV_Chain
EVQLSESGGGFVKPGGSLRLSCEASGFTFNNYAMGWVRQAPGKGLEWVSVTSAHGGSAYFGEFVKGRFTMSRDHFIDTVYLEMNRLTVEDTAVYYCVRVTFYHEGSGYYYRAGNYFDSWGQGTLVIVSA

SEQ ID NO: 4372 - protein, 129 aa, Artificial Sequence
  anti-HIV_Chain
QVQLVESGGGLVQPGGSLRLSCAASGFTFSTHWMHWVRQAPGKGLVWVSRIHSDGRSTSYADSVKGRFTISRDNAKNTLYLQMNSLRAEDTAVYYCARGAAVFGVVIIGGMDLWGQGTTVTVSSASTKG

SEQ ID NO: 4373 - protein, 129 aa, Artificial Sequence
  anti-HIV_Chain
QVQLVESGGALVQPGGSLRLSCAASGFSFSSYAMSWVRQAPGKGLEWVSAISRSGGSTYYADSVKGRFTISIDNSNNTLYLQMNSLRVEDTAVYYCAKREAFYYGAGGYGMDVWGQGTTVTVSSASTKG

SEQ ID NO: 4374 - protein, 129 aa, Artificial Sequence
  anti-HIV_Chain
FQGHLVQSGGGVKKPGTSVTLSCLASEYTFTEFTIHWIRQAPGQGPLWLGLIKRSGRLMTSYRFQDRLSLRRDRSTGTVFMELRSLRTDDTAVYYCARDGLGELAPAYHYGIDAWGQGTTVIVTSASTS

SEQ ID NO: 4375 - protein, 129 aa, Artificial Sequence
  anti-HIV_Chain
QGLLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG

SEQ ID NO: 4376 - protein, 129 aa, Artificial Sequence
  anti-HIV_Chain
NFMLTQPASVSGSPGQSITISCSGTGSDIGVYNYVSWYQQHPGKAPRLMIYDVTNRPSGVSNRFSGSKSGFTASLTISGLQGDDEADYYCSSYSSTNTYVFGTGTHVTVLGQPKANPTVTLFPPSSEEL

SEQ ID NO: 4377 - protein, 129 aa, Artificial Sequence
  anti-HIV_Chain
QSALTQPRSVSGSPGQSVTISCTGTSSDVGAYNYVSWYRQHPGKAPKLMINDVSKRPSGVPDRFSGSKSGNTASLTISGLQAEDEADYYCCSYAGTYSYVFGTGTKVTVLGQPKANPTVTLFPPSSEEL

SEQ ID NO: 4378 - protein, 129 aa, Artificial Sequence
  anti-HIV_Chain
QGQLVQSGGGLKKPGTSVTISCLASEYTFNEFVIHWIRQAPGQGPLWLGLIKRSGRLMTAYNFQDRLSLRRDRSTGTVFMELRGLRPDDTAVYYCARDGLGEVAPDYRYGIDVWGQGSTVIVTAASTKG

SEQ ID NO: 4379 - protein, 129 aa, Artificial Sequence
  anti-HIV_Chain
NFMLTQPPSASGAPGQRVTISCSGGPSNVGGNYVYWYRQFPGTAPNLLILRDDQRPSGVPDRFSASKSGNSASLAISGLRPDDEAFYFCATYDSDGSIRLFGGGTTLTVLSQPKAAPSVTLFPPSSEEL

SEQ ID NO: 4380 - protein, 129 aa, Artificial Sequence
  anti-HIV_Chain
QLVLTQPPSVSGAPGQRVTISCSGGPSNVGGNLVYWYKQFPGTAPKLLIRRDDQRPSGVPDRFSGSKSGNSASLTISGLRPDDEAFYFCATYDSQGSTRLFGGGTVLTVLSQPKAAPSVTLFPPSSEEL

SEQ ID NO: 4381 - protein, 129 aa, Artificial Sequence
  anti-HIV_Chain
NFMLTQPPSVSGAPGQRVTISCSGGPSNVGGNLVYWYKQFPGTAPKLLIRRDDQRPSGVPDRFSGSKSGNSASLAISGLRPDDEAFYFCATYDSHGSIRLFGGGTLLTVLSQPKAAPSVTLFPPSSEEL

SEQ ID NO: 4382 - protein, 129 aa, Artificial Sequence
  anti-HIV_Chain
QSALTRTPSVSGAPGQRVTISCSGGPSNVGGNYVYWYQQFPGAAPKLLIRRDDQRPSGVPDRFSGSKSGNSASLAISGLRLDDEAYYFCATYDSGWSIRLFGGGTRLTVLSQPKAAPSVTLFPPSSEEL

SEQ ID NO: 4383 - protein, 129 aa, Artificial Sequence
  anti-HIV_Chain
QSALTQPPSVSATPGQTVTISCSGSGSNVGGNHVYWYRQLPGAAPTLLISKTDHRPSRVPDRFSASKSGNSASLAISGLRPDDEAIYFCATYDTGLSLRLFGGGTRLTVLSQPKAAPSVTLFPPSSEEL

SEQ ID NO: 4384 - protein, 129 aa, Artificial Sequence
  anti-HIV_Chain
QVQLLESGPGLVTPSGTLSLACAVSGASISSSHWWTWVRQSPGKGLEWIGEIDRRGTTNYNPSLRSRVTILLDNSKNQFSLSLRSVTAADTAVYYCTKVYAGLFNERTYGMDVWGHGTTVLVSSASTKG

SEQ ID NO: 4385 - protein, 129 aa, Artificial Sequence
  anti-HIV_Chain
QAVVTQPPSVSATPGQTVTISCSGSGSNVGGNHVYWYRQLPGAAPTLLISKTNRRPSQVPDRFSGSKSGNSASLAISGLRPDDEADYFCATYDTDLSLRLFGGGTRLTVLSQPKAAPSVTLFPPSSEEL

SEQ ID NO: 4386 - protein, 129 aa, Artificial Sequence
  anti-HIV_Chain
QSALTQPPSVSGTPGQNVTISCSGGGSDVGGNLVSWYQHFPGAAPKLLIHRDNQRPSGVPDRFSALKSGNSASLAISGLRSDDEAFYFCAVYDSSLSLGLFGGGTKLTVLSQPKAAPSVTLFPPSSEEL

SEQ ID NO: 4387 - protein, 129 aa, Artificial Sequence
  anti-HIV_Chain
QSALTQPPSASGTPGQRVTISCSGGGSNIGGNLVSWYQHFPGTAPKLLIYRNDQRPSGVPDRFSGSKSGTSASLTISGLRSDDEATYFCAAYDSSLSLRLFGGGTTLNVLSQPKAAPSVTLFPPSSEEL

SEQ ID NO: 4388 - protein, 129 aa, Artificial Sequence
  anti-HIV_Chain
QSALTQPPSVSATPGQTVTISCSGSGSNVGGNHVYWYRQLPGAAPTLLISKTNHRPSQVPDRFSASKSGNSASLAISGLRPDDEADYFCGTYDTSLSLRLFGGGTRLTVLSQPKAAPSVTLFPPSSEEL

SEQ ID NO: 4389 - protein, 129 aa, Artificial Sequence
  anti-HIV_Chain
QSVLTQVLSVSGTPGQRVIISCSGTSSNVGGNLVSWYQHLPGAAPRLLIHRDDQRPSGVPDRFSGSKSGNSASLVISGLRSDDEADYFCGAYDSTFSLPVFGGGTRLTVLSQPKAAPSVTLFPPSSEEL

SEQ ID NO: 4390 - protein, 129 aa, Artificial Sequence
  anti-HIV_Chain
QSALTQPPATSGTPGQRVTISCSGGGSNVGGNLVSWYQQFPGAAPKLILHRDGQRPSGVPDRFSASKSGTSASLTISGLRSDDEATYFCAAFDSALSLPLFGGGTKLTVLSQPKAAPSVTLFPPSSEEL

SEQ ID NO: 4391 - protein, 129 aa, Artificial Sequence
  anti-HIV_Chain
QLVLTQPPSVSATPGQTVTISCSGSGSNVGGNHVYWYRQLPGAAPTLVISKTDHRPSRVPDRFSGSKSGNSASLAISGLRPDDEAAYFCATYDTGLSLRLFGGGTRLAVLSQPKAAPSVTLFPPSSEEL

SEQ ID NO: 4392 - protein, 129 aa, Artificial Sequence
  anti-HIV_Chain
QSALTQPPSVSGTPGQNVTISCSGGGSNVGGNLVSWYQHFPGAAPKLLIHRDNQRPSGVPDRFSVLKSGNSASLAISGPRSDDEAFYFCAVYDSSLSLGLFGGGTKLTVLSQPKAAPSVTLFPPSSEEL

SEQ ID NO: 4393 - protein, 129 aa, Artificial Sequence
  anti-HIV_Chain
QTVVTQPPSASGTPGQRVTISCSGGGSNIGGNLVSWYQHFPGAAPKLLIYRNDQRPSGVPDRFSGSKSGTSASLTISGLRSDDEATYFCAAYDCTLSLRLFGGGTTLNVLSQPKAAPSVTLFPPSSEEL

SEQ ID NO: 4394 - protein, 129 aa, Artificial Sequence
  anti-HIV_Chain
QSALTQTPSVSGAPGQRVTISCSGGPSNVGGNYVYWYQQFPGAAPKLLIRRDDQRPSGVPDRFSGSKSGNSASLAISGLRLDDEAYYFCATYDSGWSIRLFGGGTRLTVLSQPKAAPSVTLFPPSSEEL

SEQ ID NO: 4395 - protein, 129 aa, Artificial Sequence
  anti-HIV_Chain
QSVLTQPPSASGAPGQRVTISCSGGPSNVGGNYVYWYRQFPGTAPNLLILRDDQRPSGVPDRFSASKSGNSASLAISGLRPDDEAFYFCATYDSDGSVRLFGGGTTLTVLSQPKAAPSVTLFPPSNGGR

SEQ ID NO: 4396 - protein, 129 aa, Artificial Sequence
  anti-HIV_Chain
QGQLVQSGGGVKKPGTSVTISCLASEYTFNEFVIHWIRQAPGQGPLWLGLIKRSGRLMTSYKFQDRLNLRRDRSTGTVFMELRGLRPDDTAVYYCARDGLGEVAPDYRYGIDVWGQGSTVIVTAASTKG

SEQ ID NO: 4397 - protein, 129 aa, Artificial Sequence
  anti-HIV_Chain
EVQLVESGAEVKKPGASVKVACKVSGKKLSDLSIHWVRQAPGKGLEWMGGFDEEDGKISYERKFQGRVTMTEDTARDTAFMEMSSLRSDDTAVYFCAAAPRLDLGELSSGFHFWGLGTLVSVSSASTKG

SEQ ID NO: 4398 - protein, 129 aa, Artificial Sequence
  anti-HIV_Chain
QGQLVQSGGGGKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVSSASTKG

SEQ ID NO: 4399 - protein, 129 aa, Artificial Sequence
  anti-HIV_Chain
EVQLVESGAEVKKPGASVKVSCKVSGYTLSDLSMHWVRQAPGKGLEWMGGFDEEDGEITYAQKFQGRVSMTEDTSRDTAYMELSSLRSEDTAVYYCATAPRLELGELSSGFHYWGLGTLVTVSSASTKG

SEQ ID NO: 4400 - protein, 129 aa, Artificial Sequence
  anti-HIV_Chain
QGQLVQSGGGVKKTGTSVTISCLASEYTFTEFTIHWIRQAPGQGPLWLGLIKRSGRLMTANRFQDRLSLRRDRSTGTVFMELRSLRIDDTAVYYCARDGLGELAPAYHYGIDVWGQGTTIIVTSASTKG

SEQ ID NO: 4401 - protein, 129 aa, Artificial Sequence
  anti-HIV_Chain
QGQLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG

SEQ ID NO: 4402 - protein, 129 aa, Artificial Sequence
  anti-HIV_Chain
QGQLVQSGGGVKKLGTSVTIPCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG

SEQ ID NO: 4403 - protein, 129 aa, Artificial Sequence
  anti-HIV_Chain
QGQLVQSGGGVKKPGTSVTISCLASEYTFNEFVIHWIRQAPGQGPVWLGLIKRSGRLMTSYKFQDRLSLRRDRSTGTVFMELRGLRLDDTAVYYCARDGLGEVAPAYLYGIDAWGQGSKVIVTPASTKG

SEQ ID NO: 4404 - protein, 129 aa, Artificial Sequence
  anti-HIV_Chain
QARLDQWGTGLLKPSETLSLKCAVFGVLFTDYNWTWVRQSPGKELEWIGHLDHRGGGNYNPSLESRVTISLDYSKAQFSLHLKSVTVADTARYYCAGAVKGFWFDDPYTWFGPWSQGTLVTVASASTKG

SEQ ID NO: 4405 - protein, 129 aa, Artificial Sequence
  anti-HIV_Chain
QARLDQWGTGLLKPSETLSLKCAVFGVLFTDYNWTWVRQSPGKGLEWIGHLDHRGGGSYNPSLESRVSISLDYSKAQFSLHLKSVTVADTALYYCAGAVKGFWFDEPSTWFGPWSQGTMVTVASASTKG

SEQ ID NO: 4406 - protein, 129 aa, Artificial Sequence
  anti-HIV_Chain
QGHLVQSGGGVKKLGTSVTISCLASEDTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG

SEQ ID NO: 4407 - protein, 129 aa, Artificial Sequence
  anti-HIV_Chain
QVQLVQSEAEVKKPGSSVKVSCKASGGTFRGYTISWVRQAPGQGLEWMGRIIPILGKAIYAPSFQGRVTLTADKSTGTAYMELSRLRSDDTAVYYCAKVKMRGSSGYYYLFDDWGQGTLVTVSSASTKG

SEQ ID NO: 4408 - protein, 129 aa, Artificial Sequence
  anti-HIV_Chain
QARLDQWGTGLLKPSETLSLKCAVFGVLFTDYNWTWVRQSPGKGLEWIGHLDHRGGGNYNPSLESRVTISLDYSKAQFSLHLKSVTVADTALYYCAGAVKGFWFDEVYNWFGPWSQGTLVTVASASTKG

SEQ ID NO: 4409 - protein, 129 aa, Artificial Sequence
  anti-HIV_Chain
QGQLVQSGGGVKKPGTSVTISCLASEYTFTEFTIHWIRQAPGQGPLWLGLIKRSGRLMTAYRFQDRLSLRRDRSTGTVFMELRNLRMDDTAVYYCARDGLGELAPAYQYGIDVWGQGTTVIVSSASTKG

SEQ ID NO: 4410 - protein, 129 aa, Artificial Sequence
  anti-HIV_Chain
QVRLVQSGPQVKRPGASIRLSCESSGYRFQDYIVAWIRQTRGQGFEFVGMVNPRGGRPWPSSRFRDRVTLTRDIESETFYLGLNDLTSDDTATYFCARLEADGSDYSPKMFDFWGQGTKIVVSPASTKG

SEQ ID NO: 4411 - protein, 129 aa, Artificial Sequence
  anti-HIV_Chain
QVRLVQSGPQVKTPGASMRVSCEASGYRFLDYIIVWIRQTHGQHFEYVGMINPRGGTPWPSSKFRDRLSLTRDIHTDTFYLGLNNLGSDDTAIYFCARLEADGDDYSPKMFDHWGQGTRIIVSAASTKG

SEQ ID NO: 4412 - protein, 129 aa, Artificial Sequence
  anti-HIV_Chain
QVRLVQSGPQVKTPGASIRLSCEASGYRFLDYFIVWVRQTPGQGFEYVGMINPRGGRPWSSWKFRDRLSLTREIDTDTFYLGLSNLRSDDTAIYFCARLEADGDDYSPKMVDYWGQGTKIIVSAASTKG

SEQ ID NO: 4413 - protein, 129 aa, Artificial Sequence
  anti-HIV_Chain
QVRLVQSGPQVKRPGASIRLSCETSGYRFQDYIVAWIRQTRGQRFEFVGMVNPRGGRPWPSSKFRDRVTLTRDIESETFHLGLNDLTSDDTATYFCARLEADGADYSPKMFDFWGQGTKIVVSPASTKG

SEQ ID NO: 4414 - protein, 129 aa, Artificial Sequence
  anti-HIV_Chain
QVRLVQSGPQVKTPGASMRISCEASGYRFQDYIIVWIRQTHGQGFEYVGMINPRGGTPWSSSKFRDRLSLTRDIYTDTFYLGLNNLGSDDTAIYFCARLEADGGDYSPKMFDYWGQGTRIIVSAASTKG

SEQ ID NO: 4415 - protein, 129 aa, Artificial Sequence
  anti-HIV_Chain
QGQLVQSGGGVKKPGASVTISCLASEYTFNEFVIHWIRQAPGQGPLWLGLIKRSGRLMTAYKFQDRLSLRRDRSTGTVFMELRGLRPEDTAVYYCARDGLGEVAPDYRYGIDVWGQGSTVIVSAASTKG

SEQ ID NO: 4416 - protein, 129 aa, Artificial Sequence
  anti-HIV_Chain
QVRLVQSGPQMKTPGASLRLSCEVSGYRFLDYFIVWVRQTGGQGFEYVGMINPRGGRPWSSWKFRDRLSLTRDIETDTFYLGLNNLRSDDTAIYFCARLEADGDNYSPKMVDYWGQGTKIIVSPASTKG

SEQ ID NO: 4417 - protein, 129 aa, Artificial Sequence
  anti-HIV_Chain
QVSLVQSGPQVKTPGASMRVSCETSGYRFLDYIIVWIRQTHGQHFEYVGMINPRGGTPWPSSKFRDRLTMTRDIHTDTFYLGLNNLRSDDTAIYFCARLEADGDDYSPKMFDYWGQGTRIIVSAASTKG

SEQ ID NO: 4418 - protein, 129 aa, Artificial Sequence
  anti-HIV_Chain
QVRLVQSGPQVKTAGASMRVSCEASGYRFLDYIIVWIRQTHGQHFEYVGMINPRGGTPWPSSKFRDRLTLTRDIYTDTFYLGLNNLGSGDTAIYFCARLEADGDDYSPKMFDYWGQGTRIIVSAASTKG

SEQ ID NO: 4419 - protein, 129 aa, Artificial Sequence
  anti-HIV_Chain
QGQLVQSGGGVKKPGTSVTISCLASEYTFNEFVIHWIRQAPGQGPVWLGLIKRSGRLMTSYKFQDRLSLRRDRSTGTVFMELRGLRLDDTAVYYCARDGLGEVAPAYLYGIDAWGQGSTVIVTSASTKG

SEQ ID NO: 4420 - protein, 129 aa, Artificial Sequence
  anti-HIV_Chain
QGQLVQSGGGLKKPGTSVTISCLASEYTFNEFVIHWIRQAPGQGPLWLGLIKRSGRLMTAYNFQDRLRLRRDRSTGTVFMELRGLRPDDTAVYYCARDGLGEVAPDYRYGIDVWGQGSTVIVTAASTKG

SEQ ID NO: 4421 - protein, 129 aa, Artificial Sequence
  anti-HIV_Chain
QGHLVQSGGGVKKLGTSVTISCLVSEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG

SEQ ID NO: 4422 - protein, 129 aa, Artificial Sequence
  anti-HIV_Chain
QGQLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVSSASTKG

SEQ ID NO: 4423 - protein, 129 aa, Artificial Sequence
  anti-HIV_Chain
QGHLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG

SEQ ID NO: 4424 - protein, 129 aa, Artificial Sequence
  anti-HIV_Chain
QVQLVQSGSELKKPGASVKVSCKASGYTFTSYAINWVRQAPGQGLEWMGWINTNTGNPTYAQGFTGRFVFSLETSVSTAYLQINSLKAEDTAVYYCARDLLESRTYYNDIRDCWGQGTLVTVSSASTKG

SEQ ID NO: 4425 - protein, 129 aa, Artificial Sequence
  anti-HIV_Chain
QVQLVQSGAEVKKPGASVKVSCKASGYTFTDYYIHWVRQAPGQGLEWMGWINPSTGGTNFVQKFLGRVTMTSDTSINTAYMELRRLKNDDAAIYYCATYSTRQFFHYYYVTDVWGQGTTVTVSSASTKG

SEQ ID NO: 4426 - protein, 129 aa, Artificial Sequence
  anti-HIV_Chain
FQGQLVQSGGGVKKPGSSVTISCLASEYTFTEFTIHWIRQAPGQGPLWLGLIKRSGRLMTSYGFQDRLSVRRDRSTGTVFMELRSLRTDDTAVYYCARDGLGELAPAYHYGIDVWGQGTTVIVTSASTS

SEQ ID NO: 4427 - protein, 129 aa, Artificial Sequence
  anti-HIV_Chain
QVQLVESGGGVVQPGRSLRLSCAASGFTFSSYAMHWVRQAPGKGLEWVAVISYDGSNKYYADSVKGRFTISRDDSKSTVYLQINSLRAADTAVYFCAREGGLRFLEWLFWGQGTLVTVSSGESSASTKG

SEQ ID NO: 4428 - protein, 130 aa, Artificial Sequence
  anti-HIV_Chain
QVQLVQSGAVVKSPGSSAKLSCRLLGDEFGTYFISWIRQAPGRGLEWVGGIVPHSQLQSSAQKFHGRFFITGGVTPPIIFLQLTNVTFEDTGTYFCARERGRHRDPKTGKSLRGRYFDFWGRGTGVTVSP

SEQ ID NO: 4429 - protein, 130 aa, Artificial Sequence
  anti-HIV_Chain
QIELRQSGAAMKSPGSSVKLSCTVLGENFGTYFISWIRQAPGQGLEWVGGIVPHSQLQSSAQKFHGRIKISGGGTPPVVSLELTNVTFDDTGTYFCARERGRHVEPKTGDRLAGRYFDIWGRGTGLRVSP

SEQ ID NO: 4430 - protein, 130 aa, Artificial Sequence
  anti-HIV_Chain
EVQLVESGGGLVKPGGSLRLSCEASGFTFTNAWMNWVRQAPGKGLEWVGRIKSQTHGGTTRYAAPVKGRFTISRDDSKHTLYLQMDRLTTEDTAVYYCTGTITGSTFYYYGMDVWGQGTTVTVSPASTKG

SEQ ID NO: 4431 - protein, 130 aa, Artificial Sequence
  anti-HIV_Chain
VVQLVQSGPGLVKPSQTLSLTCTVSGGSISSGDFYWSWIRQPPGKGLEWIGYIYYSGSTYYNPSLKSRLTISVDTSKNQFSLRLSSVTAADTAVYYCARDLNSRIVGALDAFDIWGQGTMVTVSSASTKG

SEQ ID NO: 4432 - protein, 130 aa, Artificial Sequence
  anti-HIV_Chain
EVQLVQSGGGLVQPGRSLRLSCAASGFTFDDYAMHWVRQAPGKGLEWVSGISWNSGTIGYADSVRGRFTISRDDAKSSLYLQMNSLRTEDTALYYCAKDGWVGSGSSTLRGSDYWGQGTLVTVSSASTKG

SEQ ID NO: 4433 - protein, 130 aa, Artificial Sequence
  anti-HIV_Chain
QSVLTQPPSASGSPGQSITISCTGTSSDVGGYNYVSWYQQPPGKAPKVIIYEVSKRPSGVPDRFSGSKSGNTASLTVSGLQAEDEADYYCSSYAGSNNFVFGTGTEVTVVGQPKANPTVTLFPPSSEELL

SEQ ID NO: 4434 - protein, 130 aa, Artificial Sequence
  anti-HIV_Chain
QAVVTQEPSLTVSPGGTVTLTCASSTGAVTSGFYPHWFQQKPGQAPRALIYSTSNRYSWTPARFSGSLLGGKAALTLSGVQPEDEAEYYCLLLPYYGGPWIFGGGTKLTVLGQPKAAPSVTLFPPSSEEL

SEQ ID NO: 4435 - protein, 130 aa, Artificial Sequence
  anti-HIV_Chain
QSALTQPPSASGAPGQRVTISCSGGPSNVGGNYVYWYRQFPGTAPTLLILRDDQRPSGVPDRFSASKSGNSASLAISGLRPDDEGFYFCATYDSDGSIRLFGGGTALTVLSQPKAAPSVTLFPPSSEELK

SEQ ID NO: 4436 - protein, 130 aa, Artificial Sequence
  anti-HIV_Chain
QVQLVESGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 4437 - protein, 130 aa, Artificial Sequence
  anti-HIV_Chain
EVQLVESGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 4438 - protein, 130 aa, Artificial Sequence
  anti-HIV_Chain
EVQLVQSGSDVRKPGATVTVSCKADEDEDDFTAYDYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 4439 - protein, 130 aa, Artificial Sequence
  anti-HIV_Chain
QVQLVQSGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 4440 - protein, 130 aa, Artificial Sequence
  anti-HIV_Chain
QVQLVQSGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSRGRGTSLTVSSASTKG

SEQ ID NO: 4441 - protein, 130 aa, Artificial Sequence
  anti-HIV_Chain
EVQLVESGSDVRKPGATVTVSCKADEDEDDFTAYNYFMHWVRQAPGQGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 4442 - protein, 130 aa, Artificial Sequence
  anti-HIV_Chain
VVQLVQSGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 4443 - protein, 130 aa, Artificial Sequence
  anti-HIV_Chain
EVQLVQSGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 4444 - protein, 130 aa, Artificial Sequence
  anti-HIV_Chain
EVQLVQSGSDVKKPGTTVTISCKADEDEDDFTAYNYFMHWVRQAPGQGLEWIGWINPRTGQPNHAKQLQGRVTLTRERSTSTVFMKLTNLRLDDTAVYFCARPLRGGDTWHYHSWGRGTSLIVSSASTKG

SEQ ID NO: 4445 - protein, 130 aa, Artificial Sequence
  anti-HIV_Chain
QVQLVESGGGLVKPGGSLRLSCAASGFSFNEYYMSWIRQAPGQGLEWVANIGSSDAYTIYADSVKGRFTISRDNAENTVYLQMNSLRGEDTAVYYCARIEGYCSNSRCSNYFDPWGQGALVTVSSASTKG

SEQ ID NO: 4446 - protein, 130 aa, Artificial Sequence
  anti-HIV_Chain
QVQLVQSGAEVKKPGASVKVSCKVSGYPLAELSVHWVRQVPGKGLEWVGGFDPEEGKTVYAQKFQGRVTMTEDRSTDTVYMELISLRYEDTAVYYCATDNPVLQLGELSSSLDYWGQGTLVTVSSASTKG

SEQ ID NO: 4447 - protein, 130 aa, Artificial Sequence
  anti-HIV_Chain
EVQLVQSGAEVKKPGESLRISCKTSGYNFNDDWIAWVRQRPDKGPEWMGIFYPGDSQATYSPSFQGHVTFSADTSISTAYLQWTSLKASDTAIYYCARTRCFGANCFNFMDVWGKGTALTVTVSSASTKG

SEQ ID NO: 4448 - protein, 130 aa, Artificial Sequence
  anti-HIV_Chain
QVQLVQLLQSGAEVKKPGSSVKVSCQISGYGFSNYAISWVRQAPGQGLEWLGRIVPAVGMTEYAQKFQGRVTFTADRSTITAYMDLRGLRSDDTAVYYCVRDPQVEVRGNAFDIWGQGTMVTVSSASTKG

SEQ ID NO: 4449 - protein, 130 aa, Artificial Sequence
  anti-HIV_Chain
QVHLQQWGAGLLKPSETLSLTCAVSGGSFSGFFWTWIRQSPGKGLEWIGEVNHSGFTHSNPSLESRATISVAASNTQFSLRLASVTAADTAIYFCALRYFDWSPFRRDTYGTDVWGQGTTVIVSSASTKG

SEQ ID NO: 4450 - protein, 130 aa, Artificial Sequence
  anti-HIV_Chain
QVRLEQSGGALRKPGASVTLSCQASGYNFVKYIIHWVRQRPGLGFEWVGMIDPYRGRPWYAHSFAGRLSLSRDTSTETLYMTLSSLKSDDTATYFCARAEAASDSHSRPIMDWTWRILCLLAVVPASTKG

SEQ ID NO: 4451 - protein, 130 aa, Artificial Sequence
  anti-HIV_Chain
QVRLEQSGAAVRKPGASVTLSCQASGYNFVNYIIHWVRQRPGLDFEWVGMIDPYRGRPWSAHKFQGRLSLSRDVSTEILYMTLNSLRSDDTATYFCARAEAESQSHSRPIMFDSWGQGSRVTVSSASTKG

SEQ ID NO: 4452 - protein, 130 aa, Artificial Sequence
  anti-HIV_Chain
QVRLEQSGAAVKKPGASVTISCQASGYNFVKFFIHWVRQRPGQGFEWVGMIEPYRGRPWSAGNFQGRLSLSRDVSTETLYMTLNNLRSDDTAVYFCARLEAESDSHSRPIMFDHWGHGSLVTVSSASTKG

SEQ ID NO: 4453 - protein, 130 aa, Artificial Sequence
  anti-HIV_Chain
QVRLEQSGAAVRKPGASVTLSCQASGYNFVNYIIHWVRQRPGLDFEWVGMIDPYRGRPWSAHKFEGRLSLSRDVSTEVLYMTLSSLRSDDTATYFCARAEAESQSHSRPIMFDYWGQGSRVTVSSASTKG

SEQ ID NO: 4454 - protein, 130 aa, Artificial Sequence
  anti-HIV_Chain
QVRLEQSGTAVRKPGASVTISCQASGYNFVKFFIHGVRQRPGQGFEWVGMIEPFRGRPWSAGNFQGRLSLSRDVSTETLYMTLNNLRSDDTAVYFCARLEAESDSHSRPIMFDHWGHGSLVTVSSASTKG

SEQ ID NO: 4455 - protein, 130 aa, Artificial Sequence
  anti-HIV_Chain
QVRLEQSGTAMRKPGASVTLSCQASGYNFVKYIVHWVRQKPGLGFEWVGMIDPYRGRPWSAHKFQGRLSLSRDTSMEILYMTLTSLKSDDTATYFCARAEAASDSHSRPIMFDHWGQGSRVTVSSASTKG

SEQ ID NO: 4456 - protein, 130 aa, Artificial Sequence
  anti-HIV_Chain
QVRLEQSGAAMRKPGASVTLSCQASGYNFVKYIVHWVRQKPGLGFEWVGMIDPYRGRPWSAHKFQGRLSLSRDTSMEILYMTLTSLKSDDTATYFCARAEAASDSHSRPIMFDHWGQGSRVTVSSASTKG

SEQ ID NO: 4457 - protein, 130 aa, Artificial Sequence
  anti-HIV_Chain
QVRLEQSGAAMRKPGASVTLSCQASGYNFVKYIIHWVRQKPGLGFEWVGMIDPYRGRPWSAHKFQGRLSLSRDTSMEILYMTLTSLKSDDTATYFCARAEAASDSHSRPIMFDHWGQGSRVTVSSASTKG

SEQ ID NO: 4458 - protein, 130 aa, Artificial Sequence
  anti-HIV_Chain
QVRLEQSGNAVRKPGASVTISCQASGYNFVKFFIHWVRQRPGQGFEWVGMIEPFRGRPWSAGNFQGRLSLSRDVSTETLYMTLNNLRSDDTAVYFCARLEAESDSHSRPIMFDHWGHGSLVTVSSASTKG

SEQ ID NO: 4459 - protein, 130 aa, Artificial Sequence
  anti-HIV_Chain
QVRLEQSGAAVRKPGASVTLSCQASGYNFVRYIIHWVRQRPGLDFEWVGMIDPYRGRPWSAHKFGGRLSLTRDVSTEILYMTLTSLRSDDTATYFCARAEAESQSHSRPIMFDSWGQGSRVTVSSASTKG

SEQ ID NO: 4460 - protein, 130 aa, Artificial Sequence
  anti-HIV_Chain
QVRLEQSGAAVRKPGASVTLSCQASGYNFVNYIIHWVRQRPGLDFEWVGMIDPYRGRPWSAHKFQGRLSLSRDVSTEILYMTLSSLRSDDTATYFCARAEAESQSHSRPIMFDFWGQGSRVTVSSASTKG

SEQ ID NO: 4461 - protein, 130 aa, Artificial Sequence
  anti-HIV_Chain
QVRLEQSGTAVRKPGASVTISCQASGYNFVKFFIHWVRQRPGQGFEWVGMIEPFRGRPWSAGNFQGRLSLSRDVSTETLYMTLNNLRSDDTAVYFCARLEAESDSHSRPIMFDHWGHGSLVTVSSASTKG

SEQ ID NO: 4462 - protein, 130 aa, Artificial Sequence
  anti-HIV_Chain
QVRLEQSGAAMRKPGASVTLSCQASGYNFVKYIVHWVRQKPGLGFEWVGMIDPYRGRPWSAHKFQGRLSLSRDTSMEILYMTLTSLTSDDTATYFCARAEAASDSHSRPIMFDHWGQGSRVTVSSASTKG

SEQ ID NO: 4463 - protein, 130 aa, Artificial Sequence
  anti-HIV_Chain
EVQLVQSGGGLVQPGGSLRLSCAASGLTFRNFAMSWVRQAPGKGLEWVSSISGSGGSTYYADSVKGRFTISRDNSKNTLYLQMNSLRGEDTAVYFCAKGVGYDILTGLGDAFDIWGQGTVVAVSSASTKG

SEQ ID NO: 4464 - protein, 131 aa, Artificial Sequence
  anti-HIV_Chain
QVQLVQSGAAVRKPGASVTVSCKFAEDDDYSPHWVNPAPEHYIHFLRQAPGQQLEWLAWMNPTNGAVNYAWQLHGRLTATRDGSMTTAFLEVRSLRSDDTAVYYCARAQKRGRSEWAYAHWGQGTPVLVSS

SEQ ID NO: 4465 - protein, 131 aa, Artificial Sequence
  anti-HIV_Chain
QVQLQQWGAGLLKPSETLSLTCAVYAGSFSGYYWTWIRQPPGKGLEWIGEVNHGGSTNYNPSLKSRVTLSVDTSKNQFSLKLTSVTAADTAVYYCARVSRYDFWSGNYGSYGLDVWGQGTTVTVSSASTKG

SEQ ID NO: 4466 - protein, 131 aa, Artificial Sequence
  anti-HIV_Chain
EVQLVQSGGGVVQPGRSLRLSCVVSGFTFSSFTFHWVRQAPGKGLEWVAGMSFHATYIYYADSVKGRFTISRDDSQDTLYLEMDSLRSEDTAIYYCARDPGIHDYGDYAPGAFDYWGQGSPVTVSSASTKG

SEQ ID NO: 4467 - protein, 131 aa, Artificial Sequence
  anti-HIV_Chain
QVQLVQSGTEVQKPGASVKVSCKTSGYTFSKYYIHWVRQAPGQGLEWVGRINTDSGGTDYAEKFQGRVTMTRDTSITTVYLEMRGLTSDDTAAFYCARGPPHAGGWTIYYYGLDVWGQGTSVIVSSASTKG

SEQ ID NO: 4468 - protein, 131 aa, Artificial Sequence
  anti-HIV_Chain
RTVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSGVFGTGTKVTVLGQPKANPTVTLFPPSSEEL

SEQ ID NO: 4469 - protein, 131 aa, Artificial Sequence
  anti-HIV_Chain
QVQLQQWGSGLLKPSETLSLTCAVYGGSFRSYYWNWIRQSPGKGLEWIGEVSHSGSTNYNPALKSRVTISVDTSKNQFSLKVKSVTAADTALYYCSRGRGKRCSGAYCFAGYFDSWGQGGLVVVSSASTKG

SEQ ID NO: 4470 - protein, 131 aa, Artificial Sequence
  anti-HIV_Chain
QVHLVQSGAEVKKPGSSVRVSCEASGWTFGSVNSAITWVRQAPGQGLEWMGRTIPFLGISNYAQKFQGRVTITADKSTNIAYVDVTSLTSQDTAVYYCARLITGMTAPWFYYMDVWGKGTTVTVSSASTKG

SEQ ID NO: 4471 - protein, 131 aa, Artificial Sequence
  anti-HIV_Chain
QVHLQESGPRLVRSSETLSLTCSVPGGSIVNPITNYYWSWIRQSPRKGLQWIGDIYYTGTSSRNPSLDSRVSISMDVSRKQISLTLYSVTAADTAVHYCASQSLSWYRPSGYFESWGQGILVTVSSASTKG

SEQ ID NO: 4472 - protein, 131 aa, Artificial Sequence
  anti-HIV_LightChain
MKLPVRLLVLMFWIPASSSDIVMTQSPLSLPVTPGEPASISCRSSQRLLSSYGHTYLHWYLQKPGQSPQLLIYEVSNRFSGVPDRFSGSGSGTDFTLKISRVEAEDVGVYYCSQSTHVPLTFGQGTKVEIK

SEQ ID NO: 4473 - protein, 132 aa, Artificial Sequence
  anti-HIV_Chain
QVQLQESGPGLVKPSETLSVTCSVSGDSMNNYYWTWIRQSPGKGLEWIGYISDRASATYNPSLNSRVVISRDTSKNQLSLKLNSVTPADTAVYYCATARRGQRIYGVVSFGEFFYYYSMDVWGKGTTVTVSS

SEQ ID NO: 4474 - protein, 132 aa, Artificial Sequence
  anti-HIV_Chain
QVQLQESGPGLVKPPETLSLTCSVSGASVNDAYWSWIRQSPGKRPEWVGYVHHSGDTNYNPSLKRRVTFSLDTAKNEVSLKLVALTAADSAVYFCARALHGKRIYGIVALGELFTYFYMDVWGKGTTVTVSS

SEQ ID NO: 4475 - protein, 132 aa, Artificial Sequence
  anti-HIV_Chain
QVQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSS

SEQ ID NO: 4476 - protein, 132 aa, Artificial Sequence
  anti-HIV_Chain
QVHLQESGPGLVKPSETLSLTCNVSGTLVRDNYWSWMRQPLGKQPEWIGYVHDSGDTNYNPSLKSRVHLSLDKSNNLVSLRLTAVTAADSATYYCATTKHGRRIYGIVAFNEWFTYFYMDVWGKGTTVTVSS

SEQ ID NO: 4477 - protein, 132 aa, Artificial Sequence
  anti-HIV_Chain
QVQLQESGPGLVKPSETLSVTCSVSGDSMNNYYWTWIRQSPGKGLEWIGYISDRESATYNPSLNSRVVISRDTSTNQLSLKLNSVTPADTAVYYCATARRGQRIYGVVSFGEFFYYYSMDVWGRGTTVTVSS

SEQ ID NO: 4478 - protein, 132 aa, Artificial Sequence
  anti-HIV_Chain
QVQLVESGPGLVTPSETLSLTCTVSNGSVSGRFWSWIRQSPGRGLEWIGYFSDTDRSEYSPSLRSRLTLSLDASRNQLSLKLKSVTAADSATYYCARAQQGKRIYGIVSFGEFFYYYYMDAWGKGTAVTVSS

SEQ ID NO: 4479 - protein, 132 aa, Artificial Sequence
  anti-HIV_Chain
QVQLQESGPGLVKPPETLSLTCSVSGASINDAYWSWIRQSPGKRPEWVGYVHHSGDTNYNPSLKRRVTFSLDTAKNEVSLKLVDLTAADSAVYFCARALHGKRIYGIVALGELFTYFYMDVWGKGTTVTVSS

SEQ ID NO: 4480 - protein, 132 aa, Artificial Sequence
  anti-HIV_Chain
QVQLQESGPGLVKPPETLSLTCSVSGASINDAYWSWIRQSPGKRPEWVGYVHHSGDTNYNPSLKRRVSFSLDTAKNEVSLKLVDLTAADSAIYFCARALHGKRIYGIVALGELFTYFYMDVWGKGTTVTVSS

SEQ ID NO: 4481 - protein, 132 aa, Artificial Sequence
  anti-HIV_Chain
QVQLQESGPGLVKPSETLSVTCSVSGDSMNNSYWTWIRQSPGKGLEWIGYISKSESANYNPSLNSRVVISRDTSKNQLSLKLNSVTPADTAVYYCATARHGQRIYGVVSFGEFFTYYSMDVWGKGTTVTVSS

SEQ ID NO: 4482 - protein, 132 aa, Artificial Sequence
  anti-HIV_Chain
QVQLQESGPGLVKPSETLSLTCSVSNGSVSGRFWSWIRQSPGRGLEWIGYFSDTEKSNYNPSLRSRLTLSVDASKNQLSLKLNSVTAADSATYYCARTQQGKRIYGVVSFGEFFHYYYMDAWGKGTAVTVSS

SEQ ID NO: 4483 - protein, 132 aa, Artificial Sequence
  anti-HIV_Chain
QVQLVQSGTALKSPGSSAKLSCTVLGDEFGTYFISWIRQAPGQGLEWVGGIVPHSQLQSSAQKFHGRIIISAGAGVTPPVVSLQLTNLTFEDTGTYFCARERGRHRDPKTGDALRGRYFDFWGRGTGVSVSA

SEQ ID NO: 4484 - protein, 132 aa, Artificial Sequence
  anti-HIV_Chain
QVQLVQSGTALKSPGSSAKLSCTVLGDEFGTYFISWIRQAPGQGLEWVGGIVPHSQLQSSAQKFHGRIIISAGAGVTPPVVSLQLTNLTFEDTGTYFCARERGRHRDPKTGKAPRGRYFDFWGRGTGVTVSA

SEQ ID NO: 4485 - protein, 132 aa, Artificial Sequence
  anti-HIV_Chain
QVQLVQSGTALKSPGSSAKLSCTVLGDEFGTYFISWIRQAPGQGLEWVGGIVPHSQLQSSAQKFHGRITISAGAGVTPPVVSLQLTNLTFEDTGTYFCARERGRHRDPKTGDALRGRYFDFWGRGTGVRVST

SEQ ID NO: 4486 - protein, 132 aa, Artificial Sequence
  anti-HIV_Chain
QVQLVQSGAAVKSPGSSAKLSCTVLGDEFGTYFISWIRQAPGQGLEWVGGIVPHSQLQSSAQRFHGRITISAGAGVTPPVVSLQLTNLTFDDAGTYFCARERGRHRDPKTGDALRGRYFDFWGRGTGISVSP

SEQ ID NO: 4487 - protein, 132 aa, Artificial Sequence
  anti-HIV_Chain
EVQLVQSGAEVKKPGASVKVSCKVSGYTLTELSIHWVRQAPGKGLEWMGGFDPEDDEAIYEPKFQGRLTMTEDTSTDTAYMELSSLRSEDTAVYYCATADPFKVAQDEGLYVIFDYWGQGTLVTVSSASTKG

SEQ ID NO: 4488 - protein, 132 aa, Artificial Sequence
  anti-HIV_Chain
EVQLVESGGGLLQPGGSLRLSCAASGFSFNDFEMNWVRQAPGKGLEWVSYISNDGTMIHYADSVKGRFTISRDNAKKSLFLQMNSLRAEDTAVYYCARLAEVPPAIRGSYYYGMDVWGQGTTVTVASASTKG

SEQ ID NO: 4489 - protein, 132 aa, Artificial Sequence
  anti-HIV_Chain
QVQLMQSGAEVKRPGASVKVSCKAFRHSLNNLGISWIRRAPGRGLEWLGWINVYEGNTKYGRRFQGRVTMTTDRSTNTVSMELRSLTSDDTAVYYCARDNHFWSGSSRYYYFGMDVWGQGTTVIVSSASTKG

SEQ ID NO: 4490 - protein, 132 aa, Artificial Sequence
  anti-HIV_Chain
QVQLVQWGAGLLKPLETLSLTCAVYGGSFNGYFWSWIRQTPGKGLEWIGEINHGGSANFNPSLKSRVTMSVDTSKNQFSLKLASVTAADTAIYYCARGRITMVRGDPQRGGVRMDVWGQGTSVTVSSASTKG

SEQ ID NO: 4491 - protein, 132 aa, Artificial Sequence
  anti-HIV_Chain
LVQLVQSGAEVKKPGASVKVSCKVSGHTLSELSINWVRHVPGKGLEWMGGLDPEDGEAIHEPKFQGRLTMTEDTSTDTAYSTLSVWAPVAAAMYYCATADPFKVAQDEGLYVIFDYWGQGTLVTVSSASTKG

SEQ ID NO: 4492 - protein, 132 aa, Artificial Sequence
  anti-HIV_Chain
QVQLLQSGGEVKKPGASVKVSCKVSGYTLTELSIHWVRQAPGKGLEWMGGFDPEDDEAIYEPKFQGRLTMTEDTSTDTAYMELSSLRSEDTAVYYCATADPFKVAQDEGLYVIFDYWGQGTLVTVSSASTKG

SEQ ID NO: 4493 - protein, 132 aa, Artificial Sequence
  anti-HIV_Chain
QVQLVQSGAEVKKPGASVKVSCKVSGYTLTELSIHWVRQAPGKGLEWMGGFDSEDGEAFYKQNFQGRVTMTEDTSTDTAYMELRRLRSEDTAVYYCATADRFKVAQDEGLFVIFDYWGQGTLVTVSSASTKG

SEQ ID NO: 4494 - protein, 132 aa, Artificial Sequence
  anti-HIV_Chain
QVHLVQSGAEVKKPGASVRVSCKASGYTFTTYGISWVRQAPGQGLEWMGWISAHSGDTNYAQKLQARVTMTTDTSTNTAYMELRSLTSDDTAVYYCARDRPRHYYDRGGYYSPFDYWGQGTLVTVSSASTKG

SEQ ID NO: 4495 - protein, 132 aa, Artificial Sequence
  anti-HIV_Chain
LVQLLQSGAEVKKPGASVKVSCKVSGYTLTELSIHWVRQAPGKGLEWMGGFDPEDDEAIYEPKFQGRLTMTEDTSTDTAYMELSSLRSEDTAVYYCATADPFKVAQDEGLYVIFDYWGQGTLVTVSSASTKG

SEQ ID NO: 4496 - protein, 132 aa, Artificial Sequence
  anti-HIV_Chain
QVQLVQSGAEVKKPGASVKVSCKVSGHTLSELSINWVRHVPGKGLEWMGGLDPEDGEAIHEPKFQGRLTMTEDTSTDTAYVELSSLRSEDTAMYYCATADPFKVAQDEGLYVIFDYWGQGTLVTVSSASTKG

SEQ ID NO: 4497 - protein, 132 aa, Artificial Sequence
  anti-HIV_Chain
QVQLLQSGAEVKKPGASVKVSCKVSGYTLTELSINWVRQAPGKGLEWMGGFDPEDDEAIYEPKFQGRLTMTEDTSTDTAYMELSSLRSEDTAVYYCATADPFKVAQDEGLYVIFDYWGQGTLVTVSSASTKG

SEQ ID NO: 4498 - protein, 132 aa, Artificial Sequence
  anti-HIV_Chain
QPQLVQSGSGAEVKKPGASVRISCEASEYNVFDHFMQWVRQAPGQGLEWMGWINPRGGYPSYSPTFQGRLTFTRQPSWDDSTITFHMELRGLGHDDTAVYYCARPHSPDDAWSLDVWGRGTLVTVSSASTKG

SEQ ID NO: 4499 - protein, 132 aa, Artificial Sequence
  anti-HIV_Chain
QPQLVQSGSGAEVKKPGASVRISCEASEYNVFDHFMQWVRQAPGQGLEWMGWINPRGGYPSYSPRFQGRLTFTRQPSWDDSSVTFHMELRGLRHDDTAVYYCARPHSPDDAWSLDVWGRGTLVTVSSASTKG

SEQ ID NO: 4500 - protein, 132 aa, Artificial Sequence
  anti-HIV_Chain
EVQLVESGGGVVEPGESLRLSCAASGFTFRSYDMFWVRQATGKSLEWVSAIGIAGDTYYSGSVKGRFTISRENARTSLYLQLSGLRVEDSAVYFCVRGSPPRIAATEYNYYYGLDVWGQGTTVSVFSASTKG

SEQ ID NO: 4501 - protein, 132 aa, Artificial Sequence
  anti-HIV_Chain
QVQLVQSGAEVKKPGSSVKVSCKASGGTFTTYDISWVRQAPGQGLEWMGGILPDFGAPSYAQKFQDRVTITTDESSSTAYMELNSLRSEDTAIYYCARGRGDDFWSGESPSWYFDYWGQGTLVTVSSASTKG

SEQ ID NO: 4502 - protein, 132 aa, Artificial Sequence
  anti-HIV_Chain
QPQLVQSGSGAEVKKPGASVRISCEASEYNVFDHFMQWVRQAPMEGLEWMGWINPRGGYPSYSPTFQGRLTFTRQPSWDDSTITFHMELRGLRHDDTAVYYCARPHSPDDAWSLDVWGRGTLVTVSSASTKG

SEQ ID NO: 4503 - protein, 132 aa, Artificial Sequence
  anti-HIV_Chain
EVRLLESGGGLVQPGGSLRLSCSASGFTFSNSALSWVRQAPGKGLEWVSSVVSSGGDTFYADSVKGRFTISRDNSRNTLYLQMKSLRAEDTALYYCAKVQIQQLNFGVITDAGMDVWGKGTTVIVSSASTKG

SEQ ID NO: 4504 - protein, 132 aa, Artificial Sequence
  anti-HIV_Chain
QVQLVESGGGVVQPGRSLRLSCVGSGFTFSSSGMHWVRQAPGKGLEWVAVISSDGSDEYYGDSVEGRFTISRDNSKNTLFLQLDSLEAEDSAVYYCAKTPPHYDALTGYPSSVLEFWGLGTLVTVSSASTKG

SEQ ID NO: 4505 - protein, 132 aa, Artificial Sequence
  anti-HIV_Chain
EVQLVQSGAEVKKPGSSVKVSCKASGGTFTTYDISWVRQAPGQGLEWIGGILPDFGAPSYAQKFQDRVTITTDESSRTAYMELNSLRSEDTAIYYCARGRGDDFWSGESPSWYFDYWGQGTQVTVSSASTKG

SEQ ID NO: 4506 - protein, 132 aa, Artificial Sequence
  anti-HIV_Chain
QVQLLQSGTEVKKPGSSVKVSCRASGWTLGNSPNSAIGWVRQAPGQGLEWIGRIIPILDVTNYAQKFQGRVTISADKSTNIAYMEISSLGSEDTAFYYCARVITGMTSPWYFYMDVWGEGTTVIVSSASTKG

SEQ ID NO: 4507 - protein, 132 aa, Artificial Sequence
  anti-HIV_Chain
QVHLVQSGAEVKKPGSSVRVSCKASGWTFGDSVNSAITWVRQAPGQGLEWMGRFIPILGLSNYAQKFQDRVTINVDRSTNTAYMELSGLRSEDTAVYYCARLITGMNAPWFYYMDVWGKGTTITVSSASTKG

SEQ ID NO: 4508 - protein, 132 aa, Artificial Sequence
  anti-HIV_Chain
QVHLVQSGAEAKRPGSSVRVSCRASGGDFSSYTLSWVRQAPGQGLERMGGVVPMLDTVHYAQKFQGRLTLSVDEGTSTAYMELSSLRSEDTAMYYCTRGRQTFRAIWSGPPVVFDIWGQGTLVSVSSASTKG

SEQ ID NO: 4509 - protein, 132 aa, Artificial Sequence
  anti-HIV_Chain
QVHLVQSGAEAKRPGSSVRVSCRASGGDFSSYTLSWVRQAPGQGIEWMGGVVPMLDTVHYAQKFQGRLTLSVDEGTSTAYMELSSLRSEDTAMYYCTRGRQTFRAIWSGPPAVFDIWGQGTLVIVSSASTKG

SEQ ID NO: 4510 - protein, 132 aa, Artificial Sequence
  anti-HIV_Chain
QVQLVQSGAELKKPGSSVKVSCKASGGTFNNHTFNWVRQAPGQGLEWMGRTIPILGSRDYAKTFQDRVTIIADKSTSTVYLELRRLKSEDTGVYYCATSMYYFDSGGYYRNTDLDKWGQGSLVTVSSASTKG

SEQ ID NO: 4511 - protein, 132 aa, Artificial Sequence
  anti-HIV_Chain
QVYLVQSGPELKKPGASVKISCKASGYNFPKYAIHWVRQAPGQGLQWMGWINGDNGDARYSQKLQGRVTPSTDTSASVVYMELKRLRSEDTAVYYCARALYPWEIGGVPSTMGDDYWGQGTLITVSSASTKG

SEQ ID NO: 4512 - protein, 132 aa, Artificial Sequence
  anti-HIV_Chain
QVQLVQSGPELMKPGSSVKVSCRASGDNFLTSTFNWLRQAPGQRLEWMGRFIPSLGLITSAPKFSDRLTITADQATLTAYMELTGLTSEDTALYYCARGLCRGGNCRLGPSGWLDPWGRGTQVTVSSASTKG

SEQ ID NO: 4513 - protein, 132 aa, Artificial Sequence
  anti-HIV_Chain
GVHFQGHLVQSGGGVKKPGSSVTISCLASEYTFTEFTIHWIRQAPGQGPLWLGLIKRSGRLMTSYRFQDRLSLRRDRSTGTVFMELRGLRIDDTAVYYCARDGLGEVAPAYLYGIDVWGQGSTVIVTSASTS

SEQ ID NO: 4514 - protein, 132 aa, Artificial Sequence
  anti-HIV_Chain
QVQLLQSGAEVKKPGASVKVSCKVSGYTLTELSIHWVRQAPGKGLEWMGGFDPEDDEAIYEPKFQGRLTMTEDTSTDTAYMELSSLRSEDTAVYYCATADPFKVAQDEGLYVIFDYWGQGTLVTVSSASTKG

SEQ ID NO: 4515 - protein, 132 aa, Artificial Sequence
  anti-HIV_Chain
QVQLVQSGAEVKKPGASVKVSCKVSGYTLTELSIHWVRQAPGKGLEWMGGFDPEDGEASFEPKFQGRLTMTEDTSTDTAYMELSSLRSEDTAVYYCATADPFKVAQDEGLYVIFDYWGQGTLVTVSSASTKG

SEQ ID NO: 4516 - protein, 132 aa, Artificial Sequence
  anti-HIV_Chain
GVHFQGHLVQSGGGVKKPGSSVTISCLASEYTFTEFTIHWIRQAPGQGPLWLGLIKRSGRLMTSYRFQDRLSLRRDRSTGTVFMELRGLRIDDTAVYYCARDGLGEVAPAYLYGIDVWGQGTTVIVTSASTS

SEQ ID NO: 4517 - protein, 132 aa, Artificial Sequence
  anti-HIV_Chain
QVQLGESGGGLVEPGGSLRLSCAASGFLFSDYQMSWIRLAPGKGLEWISFISGFGSVYYADSVEGRFTISRDNARNSLYLQMNNLRAEDTAVYYCARAYGTGNWRGLYYYYYGMDVWGHGTTVTVSSASTKG

SEQ ID NO: 4518 - protein, 133 aa, Artificial Sequence
  anti-HIV_Chain
QVQLVQSGTALKSPGSSAKLSCTVLGDEFGTYFISWIRQAPGQGLEWVGGIVPHSQLQSSAQKFHGRIIISAGAGVTPPVVSLQLTNLTFEDTGTYFCARERGRHRDPKTGDALRGRYFDFWGRGTGLRVSTS

SEQ ID NO: 4519 - protein, 133 aa, Artificial Sequence
  anti-HIV_Chain
EVQLVQSGGGLVKPGGSLRLSCAASGFTFKNAWMSWVRQAPGKGLEWVGHIKSKTDGGTIDYAAPVKGRFTISRDDSKNTLYLQMNSLKIEDTAVYYCTTDIGSGRGWDFHYYDSNDWGQGTLVTVSSASTKG

SEQ ID NO: 4520 - protein, 133 aa, Artificial Sequence
  anti-HIV_Chain
QVQLVESGGGVVQPGRSLRLFCAASGFAFNTYGMHWVRQAPGKGLEWVAVTWHDGSQKYYADSVKGRFTISRDNSKNTLYLQMNSLRAEDTAIYYCASDQGGFDDSSGYFAPGGMDVWGRGTTVIVSSAPTKG

SEQ ID NO: 4521 - protein, 133 aa, Artificial Sequence
  anti-HIV_Chain
GYSEVQLVQSGPGLVKPSQTLSLTCTVSGGSISNGGHYWNWIRQHPGKGLEWIGHIYNIATTYYNPSLKSRVSISVDTSKNQFSLKLSSVTAADTAVYYCARGSGRWTIGARIYFDNWGQGALVAVSSASTKG

SEQ ID NO: 4522 - protein, 133 aa, Artificial Sequence
  anti-HIV_Chain
QLQLKESGPGMVKPSETLSLTCSVSGASVVSANDYWGWIRQAPGKGLECIGIILYTGSTFYNPSLQSRVTISRDPSKNHVSLTLTSVTAADSAVYYCARIPYHSESYYNVVIGGFDVWGQGTRVTVSSASTKG

SEQ ID NO: 4523 - protein, 133 aa, Artificial Sequence
  anti-HIV_Chain
CQVQLVESGGGVVQPGRSLRLSCVGSGFTFSSSGMHWVRQAPGKGLEWVAVISSDGSDEYYGDSVEGRFTISRDNSKNTLFLQLDSLEAEDSAVYYCAKTPPHYDALTGYPSSVLEFWGLGTLVTVSSASTKG

SEQ ID NO: 4524 - protein, 133 aa, Artificial Sequence
  anti-HIV_Chain
QVQLVQSGADVKKPGASVKVSCKVSGYTVSELSIHWVRQAPGKGLEWMGGFDPEDGKTVSAQNFQGRVTMTEDKSTGTANMELRSLRSEDTAVYYCATTVQLIVDFCNGGPCYNFDDWGQGTLVTVSSASTKG

SEQ ID NO: 4525 - protein, 133 aa, Artificial Sequence
  anti-HIV_Chain
GLDLEHDGHHKEEPRASVTVSCEASGYNFVNYIIHWVRLTPGRGFEWMGMIDPRRGRPWSAQKFQGRLTLTRDIDSERLYMQLSGLRGDDTAVYFCARQEPDFHDGHGHTLRGMFDSWGQGSPVSVSSASTKG

SEQ ID NO: 4526 - protein, 133 aa, Artificial Sequence
  anti-HIV_Chain
QVRLVQSGAQLKKPGASVTVSCEASGYNFVNYIINWVRQTPGRSFEWVGMIDPRRGRPWSAQKFQGRLTLTRDIDSEKLYMHLSGLRGDDTAVYYCARQDSDFHDGHGHTLRGMFDSWGQGSPVTVSSASTKG

SEQ ID NO: 4527 - protein, 133 aa, Artificial Sequence
  anti-HIV_Chain
QVRLSQSGAAVVKTGASVTISCETEGYTFVNYIIHWVRQPPGRGFEWLGMIDPRNGHPWFGQRFRGRLSLRRDRSTETVFMTLSGLTSDDNGIYFCARNEPQYYDGSGHSLPGMFDYWGQGTRVVVSSASTKG

SEQ ID NO: 4528 - protein, 133 aa, Artificial Sequence
  anti-HIV_Chain
QVRLSQSGAAVMKTGASVTISCETEGYNFVNYIIHWVRRPPGRGFEWLGMIDPKNGHPWFAQAVRGRLSLRRDTFNEVVYMTLSGLTSDDTGLYFCARNEPQYHDGNGHSLPGMFDFWGQGTLVTVSSASTKG

SEQ ID NO: 4529 - protein, 133 aa, Artificial Sequence
  anti-HIV_Chain
QVRLSQSGAAVVKTGASVTISCETEGYTFVNYIIHWVRQPPGRGFEWLGMIDPRNGHPWFGQRLQGRLSLRRDRSTETVFMTLSGLTSDDTGIYFCARNEPQYYDGSGHSLPGMFDYWGQGTRVVVSSASTKG

SEQ ID NO: 4530 - protein, 133 aa, Artificial Sequence
  anti-HIV_Chain
QVRLSQSGAAVVKTGASVTISCETEGYTFVNHIIHWVRQPPGRGFEWLGMIDPRNGHPWFGQRLRGRLSLRRDRSTETVFMTLSGLTSDDIGIYFCARNEPQYFDGSGHSLPGMFDYWGQGTRVVVSSASTKG

SEQ ID NO: 4531 - protein, 133 aa, Artificial Sequence
  anti-HIV_Chain
QVQFFQSGSSMKKSGASVTISCEATGYNIKNHILHWVRQKPGRGFEWVGMIDPINGRPWFGQAFRGRLTLTRDLSTETFYMSLSGLTSDDTATYFCARREADYHDGNGHTLPGMFDFWGPGTLVTVSSASTKG

SEQ ID NO: 4532 - protein, 133 aa, Artificial Sequence
  anti-HIV_Chain
QVRLSQSGAAVVKTGASVTISCETEGYTFVNYIIHWVRQSPGRGFEWLGMIDPRNGHPWFGQRLRGRLSLRRDRSTETVFMTLSGLTSDDTAIYFCARNEPQYYDGSGHSLPGMFDYWGQGTRVVVSSASTKG

SEQ ID NO: 4533 - protein, 133 aa, Artificial Sequence
  anti-HIV_Chain
QVRLSQSGAAMKKPGASVTISCETEGYTFINYIIHWVRQPPGRGFEWLGMIDPRNGRPWFGQSVQGRLSLRRDTYTEVVYMTLSGLTSDDAGLYFCARNEPQYHDGNGHSLPGMFDYWGQGTLVAVSSASTKG

SEQ ID NO: 4534 - protein, 133 aa, Artificial Sequence
  anti-HIV_Chain
QVRLVQSGAQLKKPGASVTVSCEASGYNFVNYIINWVRQTPGRGFEWVGMIDPRRGRPWSAQKFQGRLTLTRDIDSEKLYMHLSGLRGDDTAVYYCARQDSDFHDGHGHTLRGMFDSWGQGSPVTVSSASTKG

SEQ ID NO: 4535 - protein, 133 aa, Artificial Sequence
  anti-HIV_Chain
QVHTFQSGSSMKKSGASVTISCEATGYNIKNYILHWVRQKPGRGFEWVGMIDPINGRPWFGQPFRGRLTLTRDLSTETFYMSLSGLTSDDTATYFCARREADYHDGNGHTLPGMFDFWGPGTLITVSSASTKG

SEQ ID NO: 4536 - protein, 133 aa, Artificial Sequence
  anti-HIV_Chain
QVRLFQSGAAMKKPGASVTISCEASGYNFMNYFVHWVRQRPGRGFEWLGMINPRGGRPWSAQSVQGRLTLTRDISTEMFYMRLDGLRSDDTATYFCARNEADYHDGNGHSLRGMFDYWGQGSLITVSSASTKG

SEQ ID NO: 4537 - protein, 133 aa, Artificial Sequence
  anti-HIV_Chain
QVQLFQSGAAMRKPGASVTISCEASGYNFMNYFVHWVRQRPGRGFEWLGMINPRGGRPWSAQSVQGRLTLTRDTSTEMFYMRLDGLRSDDTATYFCARNEADYHDGNGHSLRGMFDYWGQGSLITVSSASTKG

SEQ ID NO: 4538 - protein, 133 aa, Artificial Sequence
  anti-HIV_Chain
QVRLSQSGAAIKKPGASVTISCETEGYTFINYIIHWVRQPPGRGFEWLGMIDPRNGRPWFGQSVQGRLSLRRDTYTEVVYMTLSGLTSDDTGLYFCARNEPQYHDGNGHSLPGMFDSWGQGTLVAVSSASTKG

SEQ ID NO: 4539 - protein, 133 aa, Artificial Sequence
  anti-HIV_Chain
QVRLFQSGAAMRKPGASVTISCEASGYNFLNYFVHWVRQRPGRGFEWLGMINPRGGRPWSAQSVQGRLTLTRDTSTEMFYMRLDGLRSDDTATYFCARNEADYHDGNGHSLRGMFDYWGQGSLITVSSASTKG

SEQ ID NO: 4540 - protein, 133 aa, Artificial Sequence
  anti-HIV_Chain
QVRLSQSGAAVKKPGASVTIVCETEGYNFIDYIIHWVRQPPGRGFEWLGMIDPRNGRPWSGQKVHGRLSLWRDTSTEKVYMTLTGLTSDDTGLYFCGRNEPQYHDDNGHSLPGMIDYWGQGTMVTVSSASTKG

SEQ ID NO: 4541 - protein, 133 aa, Artificial Sequence
  anti-HIV_Chain
QVRLSQSGAAIKKPGASVTISCETEGYTFINYIIHWVRQPPGRGFEWLGMIDPRNGRPWFGQSVQGRLSLRRDTYTEVVYMTLSGLTSDDAGHYFCARNEPQYHDGNGHSLPGMFDYWGQGTLVAVSSASTKG

SEQ ID NO: 4542 - protein, 133 aa, Artificial Sequence
  anti-HIV_Chain
QVRLFQSGAAMRKPGASVTISCEASGYNFMNYFVHWVRQRPGRGFEWLGMINPRGGRPWSAQSVQGRLTLTRDTSTEMFYMRLDGLRSDDTATYFCARNEADYHDGNGHSLRGMFDYWGQGSLITVSSASTKG

SEQ ID NO: 4543 - protein, 133 aa, Artificial Sequence
  anti-HIV_LightChain
MKLPVRLLVLMFWIPASSSDIVMTQSPLSLPVTPGEPASISCRSSQRLLSSYGHTYLHWYLQKPGQSPQLLIYEVSNRFSGVPDRFSGSGSGTDFTLKISRVEAEDVGVYYCSQSTHVPLTFGQGTKVEIKRK

SEQ ID NO: 4544 - protein, 134 aa, Artificial Sequence
  anti-HIV_Chain
QPYIVQSGPAVKGAGSSVTVTCKVDGDDDGIFSFGTYFMVWVRQAPGQGLQYMGGLVPSYAPTYAHKFEGRITISAAGTPPVVSLTLLNLTNDDAATYFCARERGRHYDSKTRENRRGRYFDMWGRGTRITVSP

SEQ ID NO: 4545 - protein, 134 aa, Artificial Sequence
  anti-HIV_Chain
QPYIVQSGPAVKGAGSSVTVTCRVDGDDDGIFNFGTYFMVWVRQAPGQGLQYMGGLVPSYAPTYAHKFEGRITISAAGTPPVVSLTLINLTNADAATYFCARERGRHYDSKTRENRRGRYFDMWGRGTRITVSP

SEQ ID NO: 4546 - protein, 134 aa, Artificial Sequence
  anti-HIV_Chain
RVHSQVQLVESGPGLVKPSQTLSLTCTVSGGSISNGGHYWNWIRQHPGKGLEWIGHIYNIATTYYNPSLKSRVSISVDTSKNQFSLKLSSVTAADTAVYYCARGSGRWTIGARIYFDNWGQGALVAVSSASTKG

SEQ ID NO: 4547 - protein, 134 aa, Artificial Sequence
  anti-HIV_Chain
SVDERLLEFGGRLVQPGGSLRLSCSASGFTFSNSAMSWVRQAPGKGLEWVSSILSSGVGTFYADSVKGRFTVSRDNSRNTLYLQMKSLRAEDTALYYCAKVQIQQLNFGVITDAGLDVWGKGTTLIVSSASTKG

SEQ ID NO: 4548 - protein, 134 aa, Artificial Sequence
  anti-HIV_Chain
VQSQVYLVQSGGEVKKPGSSVKVSCKASGDSFSSSVITWVRQAPGQGPEWMGRIIPVLGVAAYAQNFYGRVTISADTSSNTAYMELSSLRFEDTAVFYCARETGRGGNLALRQYFFDSWGQGTLVTVSSPSTKG

SEQ ID NO: 4549 - protein, 134 aa, Artificial Sequence
  anti-HIV_Chain
QLQLQESGPGLVKPSETLSLTCSVSDGSINSNSYYWAWIRQSPGKGLEWIGSVYYFGGTYYSPSLKSRVTMSVDRSKNQFSLNVSSVTAADTAIYYCARHVRPYDRSGYPERPNWFDPWGRGTLVTVSSASTKG

SEQ ID NO: 4550 - protein, 134 aa, Artificial Sequence
  anti-HIV_Chain
QVQLHQWGAGLLKPSDTLSLTCGILGVSPPGSLTGYYWTWIRQPPGKGLEWIGEVYHSGSTNYNPSLASRVTISMGTTKTQFSLRLTSVTAADSAVYYCASGKVWGITARPRDAGLDVWGQGTTVTVTSASTKG

SEQ ID NO: 4551 - protein, 134 aa, Artificial Sequence
  anti-HIV_Chain
QVQLVQSGAEVKKPGSSVKVSCRASGGSFGNYAINWVRQAPMQGLEWMGGIIPIFGTTNYAQNFRGRVTINADTFTNTVNMDLSSLRSEDTAVYYCGRSINAAVPGLEGVYYYYGMAVWGQGTTVTVSSASTKG

SEQ ID NO: 4552 - protein, 134 aa, Artificial Sequence
  anti-HIV_Chain
FVQLVESGGGLVQPGGSLRLSCAASGFNFNTYWMNWVRQAPGKGLEWVANMKEDGSEKYYVDSVKGRFTISRDNAKNSLYLQMNSLRAEDTAVYYCARNPESRCIVGRNRGWCRYFDLWGRGSLVTVSPASTKG

SEQ ID NO: 4553 - protein, 135 aa, Artificial Sequence
  anti-HIV_Chain
QLQLDQPGAAMKSLGSSLTITCRVSGDDLGSFHFGTYFMIWVRQGPGQGLEYMGGILPSTKTPTYAHKFRGRVSISAPGVPPVLSLALTNLTYDDTATYFCARERGRHFEPKNRDHLEGKFLDLWGRGTFVRVSP

SEQ ID NO: 4554 - protein, 135 aa, Artificial Sequence
  anti-HIV_Chain
QVQLVQPGTAMKSLGSSLTITCRVSGDDLGSFHFGTYFMIWVRQAPGQGLEYMGGILPSTKTPTYAHKFRGRVSISAPGVPPVLSLALTNLTYDDTATYFCARERGRHFEPKNRDNLEGKFFDLWGRGTFVRVSP

SEQ ID NO: 4555 - protein, 135 aa, Artificial Sequence
  anti-HIV_Chain
QVQLVQPGTAMKTLGSSLTISCRVSGDDGNFHFGTYFMAWVRQVPGQGLEYMGGILPSTKSPTYAHKFRGRVSISTAGVPPVVSLALTNLTYDDTATYFCARERGRHYDSKKQENYRGKFFDLWGRGTWVRVSPT

SEQ ID NO: 4556 - protein, 135 aa, Artificial Sequence
  anti-HIV_Chain
HLVQSGTEVKKPGSSVTVSCKAYGVNTFGLYAVNWVRQAPGQSLEYIGQIWRWKSSASHHFRGRVLISAVDLTGSSPPISSLEIKNLTSDDTAVYFCTTTSTYDQWSGLHHDGVMAFSSWGQGTLISVSAASTKG

SEQ ID NO: 4557 - protein, 135 aa, Artificial Sequence
  anti-HIV_Chain
QVQLVQSGAEVKKPGSSVKVSCKASGGTFSTYAFSWVRQAPIEGLEWMGGIIPIFGTENYAQKFQGRVTITADKSTSTAYMELSSLRSEDTAVYYCARDRSSAIGYCSSISCYKGSFDIWGQGTMVTVSSASTKG

SEQ ID NO: 4558 - protein, 135 aa, Artificial Sequence
  anti-HIV_Chain
QVQLVQSGAEVKKPGSSVKVSCKASGGTFSTYAFSWVRQAPGQGLEWMGGIIPIFGTENYAQKFQGRVTITADKSTSTAYMELSSLRSEDTAVYYCARDRSSAIGYCSSISCYKGSFDIWGQGTMVTVSSASTKG

SEQ ID NO: 4559 - protein, 135 aa, Artificial Sequence
  anti-HIV_Chain
EVQLVESGGGLVQPGGSLRLSCAASGFTFSSYSMNWVRQAPGKGLEWVSYISGSSYTIYYADSVRGRFTISRDNAKNSLYLQMNSLRDEDTAVYFCARATPPNPLNLYNYDSSGSSFDYWGQGTLVTVSSASTKG

SEQ ID NO: 4560 - protein, 135 aa, Artificial Sequence
  anti-HIV_Chain
EVQLVQSGAEVKKPGSSVKVSCKASGGTFSTYAFSWVRQAPGQGLEWMGGIIPIFGTENYAQKFQGRVTITADKSTSTAYMELSSLRSEDTAVYYCARDRSSAIGYCSSISCYKGSFDIWGQGTMVTVSSASTKG

SEQ ID NO: 4561 - protein, 135 aa, Artificial Sequence
  anti-HIV_Chain
EVQLVESGAEVKKPGSSVKVSCKASGGTFSTYAFSWVRQAPGQGLEWMGGIIPIFGTENYAQKFQGRVTITADKSTSTAYMELSSLRSEDTAVYYCARDRSSAIGYCSSISCYKGSFDIWGQGTMVTVSSASTKG

SEQ ID NO: 4562 - protein, 135 aa, Artificial Sequence
  anti-HIV_Chain
PLVQLEPSGVEVKKRGASVKVSCKVSGYSLTELSMHWVRQAPGKGLEWMGSFDPLDGDTIYAQKFQGRVTMTVDTSTDTAYMDLSSLRFEDTAVYYCATPSKAYYYDSPNYEGDFYMDVWGKGTTVIVSSASTKG

SEQ ID NO: 4563 - protein, 136 aa, Artificial Sequence
  anti-HIV_HeavyChain
QIHLVQSGTEVKKPGSSVTVSCKAYGVNTFGLYAVNWVRQAPGQSLEYIGQIWRWKSSASHHFRGRVLISAVDLTGSSPPISSLEIKLTSDDTAVYFCTTTSTYDKWSGLHHDGVMAFSSRGQGTLISVSAASTKG

SEQ ID NO: 4564 - protein, 136 aa, Artificial Sequence
  anti-HIV_HeavyChain
QIHLVQSGTEVKKPGSSVTVSCKAYGVNTFGLYAVNWVRQAPGQGLEYIGQIWRWKSSASHHFRGRVLISAVDLTGSSPPISSLEIKVTSDDTAVYFCTTTSTYDEWSDLHHDGVMAFSSWGQGTLISVSAASTKG

SEQ ID NO: 4565 - protein, 136 aa, Artificial Sequence
  anti-HIV_HeavyChain
QIHLVQSGTEVKKPGSSVTVSCKAYGVNTFGLYAVNWVRQAPGQSLEYIGQIWRWKSSASHHFRGRVLISAVDLTGSSPPISSLEIKLTSDDTAVYFCTTTSTYDRWSGLHHDGVMAFSSWGQGTLISVSAASTKG

SEQ ID NO: 4566 - protein, 136 aa, Artificial Sequence
  anti-HIV_Chain
CNPRVHSEVQLVESGAEVKKPGASVKVACKVSGKKLSDLSIHWVRQAPGKGLEWMGGFDEEDGKISYERKFQGRVSMTEDTARDTAFMEMSSLRSDDTAVYFCAAAPRLDLGELSSGFHFWGLGTLVTVSSASTKG

SEQ ID NO: 4567 - protein, 136 aa, Artificial Sequence
  anti-HIV_Chain
IWAPLIAVTFLVLHCESLGTCCCCQASGGTFNTFAINWVRQAPGQGLEWVGGIIPVFGTASYAQKFQGRVTVTTDESRGTAYMELNSLRSEDTAVYYCARGQTDLNDDLWSDYSTPGFDYWGQGTLVTVSSASTKG

SEQ ID NO: 4568 - protein, 136 aa, Artificial Sequence
  anti-HIV_Chain
LQPRVHSEVQLVESGAEVKKPGASVKVSCKVSGYTLSDLSMHWVRQAPGKGLEWMGGFDEEDGEITYAQKFQGRVSMTEDTSRDTAYMELSSLRSEDTAVYYCATAPRLELGELSSGFHYWGLGTLVTVSSASTKG

SEQ ID NO: 4569 - protein, 136 aa, Artificial Sequence
  anti-HIV_Chain
QSQVHLVQSGAEVKKPGSSVKVSCQASGGTFNTFAINWVRQAPGQGLEWVGGIIPVFGTASYAQKFQGRVTVTTDESRGTAYMELNSLRSEDTAVYYCARGQTDLNDDLWSDYSTPGFDYWGQGTLVTVSSASTKG

SEQ ID NO: 4570 - protein, 136 aa, Artificial Sequence
  anti-HIV_Chain
GSEVQLVESGAEVKKRGASVKVSCKVSGYSLTELSMHWVRQAPGKGLEWMGSFDPLDGDTIYAQKFQGRVTMTVDTSTDTAYMDLSSLRFEDTAVYYCATPSKAYYYDSPNYEGDFYMDVWGKGTTVIVSSASTKG

SEQ ID NO: 4571 - protein, 136 aa, Artificial Sequence
  anti-HIV_Chain
QVQLVQSGGEVKKPGASVKVSCKVSGYSLTELSMHWVRQAPGKGLEWMGVFDPLEGDGVYVQKFRGRVIMTEDTSTDTAYMELTSLRSEDTAIYYCATKAKDYYYESSDYSPYYYYYMDVWGKGTTVTVSSASTKG

SEQ ID NO: 4572 - protein, 136 aa, Artificial Sequence
  anti-HIV_Chain
EVQLVQSGAEVKKPGASVKVSCKVSGYTLTELSMHWVRQAPGKGLEWMGVFDPLEGDGVYAEKFRGRVIMTEDTSTDTGYMELTSLRSEDTAIYYCATKAKDYYYESSDYSPYYYYYMDVWGKGTTVTVSSASTKG

SEQ ID NO: 4573 - protein, 136 aa, Artificial Sequence
  anti-HIV_Chain
QVQLVQSGAEVKKPGASVKVSCKASGYTFTRYHIHWVRHAPGQGLEWMGKINPSRASTKYAKKFQDRVTMTRDTSTSTVYMELSSLRGDDTAVYYCGREMGTFTLLGVVIDHYDFYPMDVWGQGTPVTVSSASTKG

SEQ ID NO: 4574 - protein, 136 aa, Artificial Sequence
  anti-HIV_Chain
SRPPSCLLGCWCCSGFLLPAVILPNLHSPCLSLLESQPPSLADLVSAFAVMDIPIYIGTYRSQASLHSSSTKFPTDFLGSQTGSVAVGQGQISHLRSVEWRLRMWEFITALKVHMFLSRSDRGPRWKNVSSLLNSR

SEQ ID NO: 4575 - protein, 137 aa, Artificial Sequence
  anti-HIV_HeavyChain
QIHLVQSGTEVKKPGSSVTVSCKAYGVNTFGLYAVNWVRQAPGQSLEYIGQIWRWKSSASHHFRGRVIISAVDLTGSSPPISPLEIKNLTSDDTAVYFCTTTSTSDRWSGLHHDGVMAFSSWGQGTLISVSAASTKG

SEQ ID NO: 4576 - protein, 137 aa, Artificial Sequence
  anti-HIV_HeavyChain
QIHLVQSGTEVKKPGSSVTVSCKAYGVNTFGLYAVNWVRQAPGQSLEYIGQIWRWKSSASHHFRGRVIISAVDLTGSSPPISSLEIKNLTSDDTAVYFCTTASTYDKWSGLHHDGVMAFSSWGQGTLISVSAASTKG

SEQ ID NO: 4577 - protein, 137 aa, Artificial Sequence
  anti-HIV_HeavyChain
QIHLVQSGTEVKKPGSSVTVSCKAYGVNTFGLYAVNWVRQAPGQSLEYIGQIWRWKSSASHHFRGRVLISAVDLTGPSPPISSLEIKNLTSDDTAVYFCTTTSTYDKWSGLHHDGVMAFSSWGQGTLISVSAASTKG

SEQ ID NO: 4578 - protein, 137 aa, Artificial Sequence
  anti-HIV_HeavyChain
QIHLVQSGTEVKKPGSSVAVSCKAYGVNTFGLYAVNWVRQAPGQSLEYIGQIWRWKSSASHDFRGRVIISAVDLTGSSPPISSLEIKNLTSDDTAVYFCTATSTPDYWSGLHHDGVMAFSSWGQGTLISVSAASTKG

SEQ ID NO: 4579 - protein, 137 aa, Artificial Sequence
  anti-HIV_HeavyChain
QIHLVQSGTGVKKPGSSVTVSCKAYGVNTFGLYAVNWVRQAPGQGLEYIGQIWRWKSSASHHFRGRVLISAVDLTGSSPPITSLEIKNVTSDDTAVYFCTTTSTYDKWSGLYHDGVMAFSSWGQGTLISVSAASTKG

SEQ ID NO: 4580 - protein, 137 aa, Artificial Sequence
  anti-HIV_HeavyChain
QIHLVQSGTEVKKPGSSVTVSCKAYGVNTFGLYAVNWVRQAPGQSLEYIGQIWRWKSSASHHFRGRVIISAVDLTGSSPPISSLEIKNLTSDDTAVYFCTTTSTSDYWSGLHHDGVMAFSSWGQGTLISVSAASTKG

SEQ ID NO: 4581 - protein, 137 aa, Artificial Sequence
  anti-HIV_HeavyChain
QIHLVQSGTEVKKPGSSVTVSCKAYGVNTFGLYAVNWVRQAPGQSLEYIGQIWRWKSSASHHFRGRVLISAVDLTGSSPPISSLEIKNLTSDDTAVYFCTTTSTYDRWSGLHHDGVMAFSSWGQGTLISVSAASTKG

SEQ ID NO: 4582 - protein, 137 aa, Artificial Sequence
  anti-HIV_HeavyChain
QIHLVQSGTEVRKPGSSVTVSCKAYGVNTFGLYAVNWVRQAPGQSLEYIGQIWRWKSSASHHFRGRVLISAVDLTGSSPPISSLEIKNLTSDDTAVYFCTTTSTYDKWSGLHHDGVMAFSSWGQGTLISVSAASTKG

SEQ ID NO: 4583 - protein, 137 aa, Artificial Sequence
  anti-HIV_HeavyChain
QIHLVQSGTEVKKPGSSVTVSCKAYGVNTFGLYAVNWVRQAPGQSLEYIGQIWRWKSSASHHFRGRVLISAVDLTGSSPPISSLEIKNLTSDDTAVYFCTTTSTYDQWSGLHHDGVMAFSSWGQGTLISVSAASTKG

SEQ ID NO: 4584 - protein, 137 aa, Artificial Sequence
  anti-HIV_HeavyChain
QIHLVQSGTEVKKPGSSVTVSCKAYGVNTFGLYAVSWVRQAPGQRLEYIGQIRRWKSSASHHFRGRVTVSAVDPTGSSPPISSLEIRDLTTDDTAVYFCTTTSTSDYWSGLHNERGTAFSSWGQGTLISVSAASTKG

SEQ ID NO: 4585 - protein, 137 aa, Artificial Sequence
  anti-HIV_HeavyChain
QIHLVQSGTEVKKPGSSVTVSCKAYGVNTFGLYAVNWVRQAPGQGLEYIGQIWRWKSSASHHFRGRVLISAIDLTGSSPPISSLEIKNVTSDDTAVYFCTTMSTYDKWSGLHHDGVMAFSSWGQGTLISVSAASTKG

SEQ ID NO: 4586 - protein, 137 aa, Artificial Sequence
  anti-HIV_HeavyChain
QIHLVQSGTEVKKPGSSVTVSCKAYEVNTFGLYAVNWVRQAPGQSLEYIGQIWRWKSSASHHFRGRVLISAVDLTGSSPPISSLEIKNVTSDDTAVYFCTTTSTHDKWSGLHHDGVMAFSSWGQGTLISVSAASTKG

SEQ ID NO: 4587 - protein, 137 aa, Artificial Sequence
  anti-HIV_HeavyChain
QIHLVQSGTEVKKPGSSVTVSCKAYGVNTFGLYAVNWVRQAPGQGLEYIGQIWRWKSSASHHFRGRVLISAVDLTGSSPPISSLEIKNVTSDDTAVYFCTTTSTYDKWSGLHHDGVVAFSSWGQGTLISVSAASTKG

SEQ ID NO: 4588 - protein, 137 aa, Artificial Sequence
  anti-HIV_Chain
QVTLVQSGAEVKKPGASVRISCRASGFTFDDYSDYSFIPTTYLIHWFRQAPGQGLEWMAWINSVNGGRNIARQFQGRVTVARDRSNSIAFLEFSGLRHDDTAVYFCARDRRDDDRAWLLDPWGQGTRVTVSSASTKG

SEQ ID NO: 4589 - protein, 137 aa, Artificial Sequence
  anti-HIV_Chain
QIHLVQSGTEVKKPGSSVTVSCKAYGVNTFGLYAVNWVRQAPGQSLEYIGQIWRWKSSASHHFRGRVLISAVDLTGSSPPISSLEIKNLTSDDTAVYFCTTTSTYDKWSGLHHDGVMAFSSWGQGTLISVSAASTKG

SEQ ID NO: 4590 - protein, 138 aa, Artificial Sequence
  anti-HIV_Chain
VVQLVQSGAEVRKPGSSLKVSCKSSGGTFSRFVVNWVRQAPGQGLEWMGGMIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 4591 - protein, 138 aa, Artificial Sequence
  anti-HIV_Chain
QVQLVQSGAEVRKPGSSLKVSCKSSGGTFSRFVVNWVRQAPGQGLEWMGGMIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 4592 - protein, 138 aa, Artificial Sequence
  anti-HIV_Chain
EVQLVESGAEVRKPGSSLKVSCKSSGGTFSRFVVNWVRQAPGQGLEWMGGMIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 4593 - protein, 138 aa, Artificial Sequence
  anti-HIV_Chain
QVQLVESGAEVRKPGSSLKVSCKSSGGTFSRYVVNWVRQAPGQGLEWMGGIIPIFGIAKYAQKFQDRVTMTADEPKNTVYLDFNSLRSDDTAVYYCARDRGDTRLLDYGDYEDERYYYGMDVWGQGTTVIVSSASTKG

SEQ ID NO: 4594 - protein, 138 aa, Artificial Sequence
  anti-HIV_Chain
QVQLVQSGAEVRKPGSSLKVSCKSSGGTFSRYVVNWVRQAPGQGLEWMGGMIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 4595 - protein, 138 aa, Artificial Sequence
  anti-HIV_Chain
QVQLVQSGAEVRKPGSSLKVSCKSSGGTFSRYVVNWVRQAPGQGLEWMGGIIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 4596 - protein, 138 aa, Artificial Sequence
  anti-HIV_Chain
QVQLVESGAEVRKPGSSLKVSCKSSGGTFSRYVVNWVRQAPGQGLEWMGGIIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 4597 - protein, 138 aa, Artificial Sequence
  anti-HIV_Chain
QVQLVQSGAEVRKPGSSLKVSCKSSGGTFSRYVVNWVRQAPGQGLEWMGGIIPIFGIAKYAQKFQDRVTMTADEPKNTVYLDFNSLRSDDTAVYYCARDRGDTRLLDYGDYEDERYYYGMDVWGQGTTVIVSSASTKG

SEQ ID NO: 4598 - protein, 138 aa, Artificial Sequence
  anti-HIV_Chain
VVQLVQSGAEVRKPGSSLKVSCKSSGGTFSRYVVNWVRQAPGQGLEWMGGMIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 4599 - protein, 138 aa, Artificial Sequence
  anti-HIV_Chain
FICFSVVVRLLEFGGRLVQPGGSLRLSCSASGFTFSNSAMSWVRQAPGKGLEWVSSILSSGVGTFYADSVKGRFTVSRDNSRNTLYLQMKSLRAEDTALYYCAKVQIQQLNFGVITDAGLDVWGKGTTLIVSSASTKG

SEQ ID NO: 4600 - protein, 138 aa, Artificial Sequence
  anti-HIV_Chain
QVQLVQSGAEVRKPGSSLKVSCKSSGGTFSRYVVNWVRQAPGQGLEWMGGIIPIFGIAKYAQKFQDRVTMTADESKNTVYLDFSSLRSGDTAVYYCARDRGDTRLLDYGDYEDERYYYGMDVWGQGTTVTVSSASTKG

SEQ ID NO: 4601 - protein, 139 aa, Artificial Sequence
  anti-HIV_Chain
QVQLVESGAEVKKPGSSVKVSCKASGGTFNIFAFSWVRQAPGQGLEWMGGIIPIFASPNYAQRFQGRVTITADESTSTVHMELSSLRSEDTAIYYCAKDAHMHIEEPRDYDYIWGTSPYYFDYWGQGTLVTVSSASTKG

SEQ ID NO: 4602 - protein, 139 aa, Artificial Sequence
  anti-HIV_Chain
QVQLVESGAEVKKPGASVKVSCKASGYTFTSHDINWVRQATGQGLEWMGWMNPNSGDTGYAHKFQGRVTMTRNTPISTAYMELSSLRSEDTAVYYCARGRATSRNTPWAHYYDSSGYYGAGDYWGQGTLVTVSSASTKG

SEQ ID NO: 4603 - protein, 139 aa, Artificial Sequence
  anti-HIV_Chain
QVQIRQSGPGLVKPLETLSLSCIVFGGSFIAYHWTWIRQAPLKGLEWIGDIDQGGDITYSPSLKSRVTMSVDRSKSQFSLKLSSVTAADAAVYYCVRGPPNRYAVTSFTSGTHRERSSYYFDYWGPGTLVTVSSASTKG

SEQ ID NO: 4604 - protein, 141 aa, Artificial Sequence
  anti-HIV_Chain
NGGSLRLSCRVSGFGFHLYEMNWVRQAPGKGLEWISSISGSGESTHYSDSITGRFSMSRDEAKDSLYLQMNNLRVEDTAVYYCTRGFSMGDGTGFSFDTWGRGTMVTVSSGLDTVSLASTKGPSVFPLAPCSRSTSDARLS

SEQ ID NO: 4605 - protein, 141 aa, Artificial Sequence
  anti-HIV_Chain
QVQLVQSGAEVKKPGSSVKVSCKASGGTFSTYAISWVRQAPGQGLEWMGGIIPSFSMSNYAQDFQGRLTITADESTSSVYMELNSLRSEDTAVYYCARDFPRFHRLVGNYDFWRGTLDRFSYMDLWGRGTAVTVSSASTKG

SEQ ID NO: 4606 - protein, 141 aa, Artificial Sequence
  anti-HIV_Chain
LVQLVESGGGVVQPGRSLRLSCAASGFTFSTYAMHWVRQAPGKGLEWVAVISYDGSNKFYADSVKGRFTISRDNSKNTLYLQMNSLRAEDTAVYYCARPKFLPGADIVVVVAATPFDYWGQGNPGHRLLSFHQGPIGLPPG

SEQ ID NO: 4607 - protein, 141 aa, Artificial Sequence
  anti-HIV_HeavyChain
MEWSGVFIFLLSVTAGVHSEVQLVESGGGLVKPGGSLRLSCAASGYTFSNYWIGWVRQAPGKGLEWIGDIYPGGNYIRNNEKFKDKTTLSADTSKNTAYLQMNSLKTEDTAVYYCGSSFGSNYVFAWFTYWGQGTLVTVSS

SEQ ID NO: 4608 - protein, 141 aa, Artificial Sequence
  anti-HIV_HeavyChain
MEWSGVFIFLLSVTAGVHSQVQLVQSGPDVKKPGTSMKMSCKTSGYTFSNYWIGWVRQAPGQGLEWIGDIYPGGNYIRNNEKFKDKTTLTADTSTSTAYMQLGSLRSEDTAVYYCGSSFGSNYVFAWFTYWGQGTLVTVSS

SEQ ID NO: 4609 - protein, 143 aa, Artificial Sequence
  anti-HIV_Chain
QVFVQLVQSGGGLVQPGGSVRLSCTASGFLFSTYSMNWVRQAPGKGLEWVSSISTTSNYIYYADSVKGRFTISRSNGQGSLYLQLNSLRVEDTAVYYCARDTKVGAPRQDCYAMDLWGQRDHGHRLLSFHQGPIGLPPGALLQ

SEQ ID NO: 4610 - protein, 144 aa, Artificial Sequence
  anti-HIV_Chain
IILFLVATATGVHSDIQMTQSPSSLSASVGDRVTITCRASQSIDRYLNWYQHKPGKAPKLLIYAASNLHTDVPSRFSGSGAGTYFTLTITSLQPEDFATYYCQQSHSPSFGQESYSIAFGQGTRLEIKRTVAAPSVFIFPPSDE

SEQ ID NO: 4611 - protein, 144 aa, Artificial Sequence
  anti-HIV_Chain
LQQLQVPRLSMWRVFKVAAATGAQTLTVEEPGSSVKVSCKASGGSSTAYGYSWVRQAPGQGFEWMGRIIPFYGIITYAPKFQGRVTITADRSTSTVYMELTSLTFADTALFFCARDFGDPRNGYYFDSWDQGLWLTVSSASTKG

SEQ ID NO: 4612 - protein, 144 aa, Artificial Sequence
  anti-HIV_Chain
QVRLEQSGVAMRKPGASVTLSCQASGYNFVKYIIHWVRQKPGLGFEWVGMIDPYRGRPWSAHKFQGRLSLSRDTSMEILYMTLTSLKSDDTATYFCARAEAASDIHSRPIILTGPGEYGLDLEHMDWTWRILCLLAVAPGCHSQ

SEQ ID NO: 4613 - protein, 145 aa, Artificial Sequence
  anti-HIV_Chain
MFLFLVAGATGVQSQVYLVPFGPEVKKPGSSVKVSCKASGDSFTSSVITWVRQAPGQGPEWMGRVIPVLGVAAYAQKFYGRVTITADTSSNTAYMEVNSLRFEDTAVYYCARETGRGGNLALRQYFFDSWGQGTLVTVSSPSTKG

SEQ ID NO: 4614 - protein, 146 aa, Artificial Sequence
  anti-HIV_Chain
QVQLQESGPGLVKPSGTLSLTCAVSGASISSRNWWTWVRQPPGKGLEWIGEIYESGATNYNPSLKSRVTISVDKSKNQFSLRLTSVTAADTAVYFCARLMTFGGLIGTLDYWGQGTLVTVLQPPPRAHRYHPRNLLQEHLCARVMP

SEQ ID NO: 4615 - protein, 148 aa, Artificial Sequence
  anti-HIV_HeavyChain
MEWSGVFIFLLSVTAGVHSEVQLVESGGGLVKPGGSLRLSCAASGYTFSNYWIGWVRQAPGKGLEWIGDIYPGGNYIRNNEKFKDKTTLSADTSKNTAYLQMNSLKTEDTAVYYCGSSFGSNYVFAWFTYWGQGTLVTVSSGESLKPL

SEQ ID NO: 4616 - protein, 148 aa, Artificial Sequence
  anti-HIV_HeavyChain
MEWSGVFIFLLSVTAGVHSQVQLVQSGPDVKKPGTSMKMSCKTSGYTFSNYWIGWVRQAPGQGLEWIGDIYPGGNYIRNNEKFKDKTTLTADTSTSTAYMQLGSLRSEDTAVYYCGSSFGSNYVFAWFTYWGQGTLVTVSSGESLKPL

SEQ ID NO: 4617 - protein, 149 aa, Artificial Sequence
  anti-HIV_Chain
QARLDQWGTGLLKPSETLSLKCAVFGVLFTDYNWTWVRQSPGKGLEWIGHLDHRGGGNYNPSLESRVTISLDYSKAQFSLHLKSVTVADTALYYCAGAVKGFWFDEVYNWFGPGVREPWLPSPQPPPRAHRSSPWHPPPRAPLVTATVP

SEQ ID NO: 4618 - protein, 149 aa, Artificial Sequence
  anti-HIV_Chain
QARLDQWGTGLLKPSETLSLKCAVFGVLFTDYNWTWVRQSPGKGLEWIGHLDHRGGGNYNPSLESRVTISLDYSKAQFSLHLKSVTVADTALYYCAGAVKGLWFDETYTWFGPWSQGTRVTVASASTKGPSVFPLAPSSKSTSGTRDLS

SEQ ID NO: 4619 - protein, 149 aa, Artificial Sequence
  anti-HIV_Chain
AARLDQWGTGLVKPSETLSLKCAVFGVDFPDYTWTWARQAPGKGLEWIGHRDHRGGSSYNPSLSGRATISLDTSKAQFSLHIKSVTVADTATYYCAGAVAGLWFEDAYNWFGPWSQGTLVTVAAASTKGPSVFPLAPSSKSTSGHASVL

SEQ ID NO: 4620 - protein, 150 aa, Artificial Sequence
  anti-HIV_Chain
LAQLEQSGGGVVKPGGSLRLPCAASGFTFIDYYMAWIRLAPGKGLEWLSYISKNGDYTKYSESLKGRFTISRDNAKNLVILQLNRLRADDTAIYFCARADGLTYFGELLQYIFDLWGQGARVIVSSASTKGPSVFPLAPSSKSTSGHASV

SEQ ID NO: 4621 - protein, 153 aa, Artificial Sequence
  anti-HIV_Chain
QVQLVQSGAEVKKPGASVKVSCKVSGYTLTELSIHWVRQAPGKGLEWMGGFDSEDGEAIYKQNFQGRVTMTEDTSTDTAYMELSRLRSEDTAVYYCATADRFKVAQDEGLFVIFDYWGQGNPGHRLLSLHQGPIGLPPGTLPPKATSGHAARR

SEQ ID NO: 4622 - protein, 154 aa, Artificial Sequence
  anti-HIV_Chain
LVQLVQSGAEVKKPGASVKVSCKVSGYSLTELSIHWVRQAPGKGLEWMGGFDSEDGEAIYKQNFQGRVTMTEDTSTDTAYMELSRLRSEDTAVYYCATADPFKVAQDEGLFVIFDYWGQGTTGHRLLSLHQGPHRLYSLGTLLSRAPIVQTHMA

SEQ ID NO: 4623 - protein, 157 aa, Artificial Sequence
  anti-HIV_Chain
QIHLVQSGTDVKKPGSSVTVSCKAYGVNTFGLYAVNWVRQAPGQSLEYIGQIWRWKSSASHHFRGRVLISAVDLTGSSPPISSLEIKNLTSDDTAVYFCTTTSTYDQWSGLHHDGVMAFSSRGQGTLISVSAASTKGPSVFPLAPSSKSTYGLAHVL

SEQ ID NO: 4624 - protein, 159 aa, Artificial Sequence [sequence omitted]

SEQ ID NO: 4625 - protein, 214 aa, Artificial Sequence
  anti-HIV_LightChain
DIVITQSTKFMSTSVGDRVSITCKASQDVSTAVAWYQQKPGQSPKLLIYWASTRHTGVPDRFTGSGSGTDYTLTISRVQAEDLALYYCQQHYTTPWTFGGGTKLEIKRTVAAPSFVIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4626 - protein, 217 aa, Artificial Sequence
  anti-HIV_Chain
QSVLTQPPSVSAAPGQKVTISCSGSSSNIGNNYVLWYQQFPGTAPKLLIYGNNKRPSGIPDRFSGSKSGTSATLGITGLQTGDEADYFCATWDSGLSADWVFGGGTKLTVLSQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4627 - protein, 219 aa, Artificial Sequence
  anti-HIV_Chain
DIVMTQSPDSLAVSLGERVTMNCKSSQSLLYSTNQKNYLAWYQQKPGQSPKLLIYWANSTESGVPDRFSGSGSGTDFTLTISSVQAEDVAVYYCQQYYSYRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4628 - protein, 251 aa, Artificial Sequence
  anti-HIV_SingleChain
MQVQLEQSGAEVKKPGASVKVSCQASGYRFSNFTVHWVRQAPGQRFEWMGWINPYNGNKEFSAKFQDRVTFTADTSANTAYMELRSLRSADTAVYYCARVGEWGWDDSPQDNYYMDVWGKGTTVIVSSGGGGSGGGGSGGGGSDIELTQSPGTLSLSPGERATFSCRSSHSIRSRRVAWYQHKPGQAPRLVIHGVSNRASGISDRFSGSGSGTDFTLTITRVEPEDFALYYCQVYGASSYTFGQGTKLERK

SEQ ID NO: 4629 - protein, 446 aa, Artificial Sequence
  anti-HIV_LightChain
EVKLEESGGGLVQPGGSRKLSCAASGFTFSSFGMHWVRQAPEKGLEWVAYISSGSSTLHYADTVKGRFTISRDNPKNTLFLQMKLPSLCYGLLGSRNLSHRLLSQNDTPICLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4630 - protein, 460 aa, Artificial Sequence
  anti-HIV_Chain
EVQLVESGGGLVKPGGSLRLTCVASGFTFSDVWLNWVRQAPGKGLEWVGRIKSRTDGGTTDYAASVKGRFTISRDDSKNTLYLQMNSLKTEDTAVYSCTTDGFIMIRGVSEDYYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4631 - protein, 471 aa, Artificial Sequence
  anti-HIV_Chain
MEWSGVFMFLLSVTAGVHSQVQLQQSGPEVVKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4632 - protein, 215 aa, Artificial Sequence
  anti-influenza_Fab
IVLTQSPATLSVSPGERATLSCRASQVISHNLAWYQQKPGQAPRLLIYGASTRASGIPARFSGSGSGTDYTLTITSLQPEDFAVYYCQHYSNWPPRLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4633 - protein, 227 aa, Artificial Sequence
  anti-influenza_Fab
VQLVESGGGVVQPGKSPRLSCAASGPTFSSYAVHWVRQAPGKGLEWVTLISYDGANQYYADSVKGRFTISRDNSKNTVYLQMNSLRPEDTAVYYCAVPGPVFGIFPPWSYFDNWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4634 - protein, 505 aa, Artificial Sequence
  anti-influenza_Fab
AGSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVSPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGSGRLVPR

SEQ ID NO: 4635 - protein, 219 aa, Artificial Sequence
  anti-influenza_Fab
QVQLVQSGGGVVQPGRSLRLSCAASEFTFRMYATHWVRQAPGKGLEWVALISYDGSNKYYADSVKGRFTISRDNSMNTVYLQMNTLRPEDTAVYYCARDLGGYFIRGIMDVWGQGTLVTVSSASTKGPSVFPLAPSSGGTAALGCLVKDYFPEPVTVSWNSGALTSGVHTFPAVLQSSGLYSLSSVVTVPSSSLGTQTYICNVNHKPSNTKVDKRVEPK

SEQ ID NO: 4636 - protein, 214 aa, Artificial Sequence
  anti-influenza_Fab
ELQMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4637 - protein, 331 aa, Artificial Sequence
  anti-influenza_Fab
ADPGDTICIGYHANNSTDTVDTVLEKNVTVTHSVNLLEDSHNGKLCKLKGIAPLQLGKCNIAGWLLGNPECDLLLTASSWSYIVETSNSENGTCYPGDFIDYEELREQLSSVSSFEKFEIFPKTSSWPNHETTKGVTAACSYAGASSFYRNLLWLTKKGSSYPKLSKSYVNNKGKEVLVLWGVHHPPTGTDQQSLYQNADAYVSVGSSKYNRRFTPEIAARPKVRDQAGRMNYYWTLLEPGDTITFEATGNLIAPWYAFALNRGSGSGIITSDAPVHDCNTKCQTPHGAINSSLPFQNIHPVTIGECPKYVRSTKLRMATGLRNIPSIQSR

SEQ ID NO: 4638 - protein, 179 aa, Artificial Sequence
  anti-influenza_Fab
GLFGAIAGFIEGGWTGMIDGWYGYHHQNEQGSGYAADQKSTQNAIDGITNKVNSVIEKMNTQFTAVGKEFNNLERRIENLNKKVDDGFLDIWTYNAELLVLLENERTLDFHDSNVRNLYEKVKSQLKNNAKEIGNGCFEFYHKCDDACMESVRNGTYDYPKYSEESKLNREEIDGVSGR

SEQ ID NO: 4639 - protein, 214 aa, Artificial Sequence
  anti-influenza_Apo
QSVLTQPPSVSVAPGQTARITCGGNDIGRKSVHWNQQKPGQAPVLVVCYDSDRPSGIPERFSGSNSGNTATLTISRVEAGDEADYYCQVWDSSSDHVIFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4640 - protein, 229 aa, Artificial Sequence
  anti-influenza_Apo
EVQLVQSGAEVKKPGASVKVSCKASGYTFTDYHINWVRQAPGQGLEWMGWIHPNSGDTNYAQKFQGWVTMTRDTAISTAYMEVNGLKSDDTAVYYCARGGLEPRSVDYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 4641 - protein, 111 aa, Artificial Sequence
  anti-influenza-A_kappa_LightChain_V-Region
DIVMTQSPDSLAVSLGARATINCKSSQSVTFNYKNYLAWYQQKPGQPPKVLIYWASARESGVPDRFSGSGSGTDFTLTISSLQAEDVAVYYCQQHYRTPPTFGQGTKVEIK

SEQ ID NO: 4642 - protein, 111 aa, Artificial Sequence
  anti-influenza-A_kappa_LightChain_V-Region
DIVMTQSPDSLAVSLGERATINCKSSQSVSSNNKNYLAWYQQKPGQPPKVLIYWASARESGVPDRFSGSGSGTDFTLTISSLQAEDVAVYYCQQHYRTPPTFGQGTKVEIK

SEQ ID NO: 4643 - protein, 111 aa, Artificial Sequence
  anti-influenza-A_kappa_LightChain_V-Region
DIVMTQSPDSLAVSLGERATINCRSSQSVSSNNKNFLAWYQEKPGQPPKVLIYWASARESGVPDRFSGSGSGTDFTLTISGLQAEDVAVYYCQQHYRTPPTFGQGTKVEIK

SEQ ID NO: 4644 - protein, 111 aa, Artificial Sequence
  anti-influenza-A_kappa_LightChain_V-Region
DIVMTQSPDSLAVSLGERATINCKSSQSVTFNYKNYLAWYQQKPGQPPKLLIYWASTRESGVPDRFSGSGSGTDFTLTISSLQAEDVAVYYCQQHYRTPPTFGQGTKVEIK

SEQ ID NO: 4645 - protein, 113 aa, Artificial Sequence
  anti-influenza-A_kappa_LightChain_V-Region
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGQGTKVEIK

SEQ ID NO: 4646 - protein, 111 aa, Artificial Sequence
  anti-influenza-A_kappa_LightChain_V-Region
DIQMTQSPDSLAVSLGARATINCKSSQSVTFNYKNYLAWYQQKPGQPPKVLIYWASARESGVPDRFSGSGSGTDFTLTISSLQAEDVAVYYCQQHYRTPPTFGQGTKVEIK

SEQ ID NO: 4647 - protein, 129 aa, Artificial Sequence
  anti-influenza-A_HeavyChain_V-Region
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDSQLRSLLYFDWLSQGYFDYWGQGTLVTVSS

SEQ ID NO: 4648 - protein, 129 aa, Artificial Sequence
  anti-influenza-A_HeavyChain_V-Region
QVQLVQSGGGVVQPGRSLRLSCVASGFTFSTYAMHWVRQAPGRGLEWVAVISYDGNYKYYADSVKGRFSISRDNSNNTLHLEMNTLRTEDTALYYCAKDSQLRSLLYFEWLSQGYFDPWGQGTLVTVSS

SEQ ID NO: 4649 - protein, 129 aa, Artificial Sequence
  anti-influenza-A_HeavyChain_V-Region
QVQLVQSGGGVVQPGRSLRLSCAASGFTFSTYGMHWVRQAPGKGLEWVAVISYDGNYKYYADSVKGRFTISRDNSKNTLYLEMNSLRTEDTALYYCAKDSQLRSLLYFDWLSQGYFDHWGQGTLVTVSS

SEQ ID NO: 4650 - protein, 129 aa, Artificial Sequence
  anti-influenza-A_HeavyChain_V-Region
QVQLVQSGGGVVPPGRSLRLSCAASGFTFSTYGMHWVRQAPGKGLEWVAVISYDGNYKYYADSVRGRFTISRDNSKNTLNLDMNSLRTEDTALYYCAKDSQLRSLLYFDWLSQGYFDHWGQGTLVTVSS

SEQ ID NO: 4651 - protein, 129 aa, Artificial Sequence
  anti-influenza-A_HeavyChain_V-Region
QVQLVESGGGVVQPGRSLRLSCAASGFTFSTYAMHWVRQAPGKGLEWVAVISYDANYKYYADSVKGRFTISRDNSKNTLYLQMNSLRAEDTAVYYCAKDSQLRSLLYFEWLSQGYFDYWGQGTLVTVSS

SEQ ID NO: 4652 - protein, 129 aa, Artificial Sequence
  anti-influenza-A_HeavyChain_V-Region
QVQLVESGGGVVQPGRSLRLSCAASGFTFSTYAMHWVRQAPGKGLEWVAVISYDGNYKYYADSVKGRFTISRDNSKNTLYLQMNSLRAEDTAVYYCAKDSQLRSLLYFEWLSQGYFDPWGQGTLVTVSS

SEQ ID NO: 4653 - protein, 129 aa, Artificial Sequence
  anti-influenza-A_HeavyChain_V-Region
QVQLVQSGGGVVQPGRSLRLSCVASGFTFSTYAMHWVRQAPGRGLEWVAVISYDGNYKYYADSVKGRFSISRDNSNNTLHLEMNTLRTEDTALYYCAKDSQLRSLLYFEWLSQGYFDPWGQGTLVTVTS

SEQ ID NO: 4654 - protein, 110 aa, Artificial Sequence
  anti-influenza-A_LightChain_V-Region
NFMLTQPPSASGTPGQRVTISCSGSSSNIGGNTVHWFQQLPGTAPKLLIYTNSLRPSGVPDRFSGSKSGTSASLAISGLQSEDEADYYCAAWDDSLNGQVFGGGTKLTVL

SEQ ID NO: 4655 - protein, 130 aa, Artificial Sequence
  anti-influenza-A_HeavyChain_V-Region
QVQLLESGGGVVQPGRSLRLSCAASGFTFSNYGMHWVRQAPGKGLEWVAIISFDGSKKYYANSVKGRSTISRDNSKNTLSLQMNSLGPEDTALYYCAKLPSPYYFDSRFVWVAASAFHFWGQGILVTVSS

SEQ ID NO: 4656 - protein, 44 aa, Artificial Sequence
  anti-influenza_Chain
NVPEWSYIVEKANPANDLCYPGNFNDYEELKHLLSRINHFEKIQ

SEQ ID NO: 4657 - protein, 54 aa, Artificial Sequence
  anti-influenza_Chain
SGRLVPRGSPGSGYIPEAPRDGQAYVRKDGEWVLLSTFLGKPIPNPLLGLDSTG

SEQ ID NO: 4658 - protein, 97 aa, Artificial Sequence
  anti-influenza_Chain
MSLLTEVETPIRNEWGCRCNGSSDPLAIAANIIGILHLILWILDRLFFKCIYRRFKYGLKGGPSTEGVPKSMREEYRKEQQSAVDADDGHFVSIELE

SEQ ID NO: 4659 - protein, 100 aa, Artificial Sequence
  anti-influenza_Chain
MNNATFNCTNINPITHIRGSIIITICVSLIVILIVFGCIAKIFINKNNCTNNVIRVHKRIKCPDCEPFCNKRDDISTPRAGVDIPSFILPGLNLSEGTPN

SEQ ID NO: 4660 - protein, 100 aa, Artificial Sequence
  anti-influenza_Chain
ELTQSPSSLSASVGDSVTITCRTSERISTYLNWYQQKPGKAPRLLVSGASTLQGGVPSRFSGSGSGTAFTLTINSLQPEDFATYYCQQSYSTPLTFGGGT

SEQ ID NO: 4661 - protein, 100 aa, Artificial Sequence
  anti-influenza_Chain
MTQSPSSMSVSLGDTVSITCHASQDISGHIGWLQQKPGKSFKGLIYHGTNLEDGVPSRFSGSGSGADFSLTISSLESEDFADYYCVQYVQFPWTFGGGTK

SEQ ID NO: 4662 - protein, 102 aa, Artificial Sequence
  anti-influenza_Chain
DIQVTQSPSSLSASVGDRVTISCRAQSLSSYLHWYQQKPGQPPKLLIYAATTLQSGVPSRFSGSGSGTDFTLTISTFQAEDVATYYCQQSRTFGQGTKVEIK

SEQ ID NO: 4663 - protein, 102 aa, Artificial Sequence
  anti-influenza_Chain
DIQMTQSPSSLSASVGDRVTISCRAQSLSSYLHWYQQKPGQPPKLLIYAATTLQSGVPSRFSGSGSGTDFTLTISTFQAEDVATYYCQQSRTFGQGTKVEIK

SEQ ID NO: 4664 - protein, 103 aa, Artificial Sequence
  anti-influenza_Chain
DIQITQSPSSLSASVGDRVTITCRTSQSLSSYLHWYQQKPGKAPKLLIYAASSLQSGVPSRFSGSGSGTDFTLTISSLQPEDFATYYCQQSRTFGQGTKVEIK

SEQ ID NO: 4665 - protein, 103 aa, Artificial Sequence
  anti-influenza_Chain
DIQMTQSPSSLSASVGDRVTITCRTSQSLSSYLHWYQQKPGKAPKLLIYAASSLQSGVPSRFSGSGSGTDFTLTISSLQPEDFATYYCQQSRTFGQGTKVEIK

SEQ ID NO: 4666 - protein, 103 aa, Artificial Sequence
  anti-influenza_Chain
DIQVTQSPSSLSASVGDRVTISCRASQRLNSYLHWYQQTPGQAPKLLIYATSTLQSGVSPRFSGSGSGTDFTLTISSLQPEDVATYYCQLSRTFGHGTKVEIK

SEQ ID NO: 4667 - protein, 103 aa, Artificial Sequence
  anti-influenza_Chain
DIQMTQSPSSLSASVGDRVTISCRASQRLNSYLHWYQQTPGQAPKLLIYATSTLQSGVSPRFSGSGSGTDFTLTISSLQPEDVATYYCQLSRTFGHGTKVEIK

SEQ ID NO: 4668 - protein, 103 aa, Artificial Sequence
  anti-influenza_Chain
DIQVTQSPSSLSASVGDRITISCRTSQSLRSYLHWYQQKPGKAPKLLIYASSTLQSGVPSRFSGSGSGTDFTLTISNLQPEDFATYYCQLSRTFGQGTKVEIK

SEQ ID NO: 4669 - protein, 103 aa, Artificial Sequence
  anti-influenza_Chain
DIQMTQSPSSLSASVGDRITISCRTSQSLRSYLHWYQQKPGKAPKLLIYASSTLQSGVPSRFSGSGSGTDFTLTISNLQPEDFATYYCQLSRTFGQGTKVEIK

SEQ ID NO: 4670 - protein, 103 aa, Artificial Sequence
  anti-influenza_Chain
DIQMTQSPSSLSASVGDRVTITCRTSQSLSSYTHWYQQKPGKAPKLLIYAASSRLSGVPSRFSGSGSGTDFTLTISSLQPEDFATYYCQQSRTFGQGTKVEIK

SEQ ID NO: 4671 - protein, 103 aa, Artificial Sequence
  anti-influenza_Chain
DIQMTQSPSSLSASVGDRVTITCRTSQSLSSYTHWYQQKPGKAPKLLIYAASSRGSGVPSRFSGSGSGTDFTLTISSLQPEDFATYYCQQSRTFGQGTKVEIK

SEQ ID NO: 4672 - protein, 103 aa, Artificial Sequence
  anti-influenza_Chain
DIQMTQSPSSLSASVGDRVTITCRTSQSLSSYDHWYQQKPGKAPKLLIYAASSRLSGVPSRFSGSGSGTDFTLTISSLQPEDFATYYCQQSRTFGQGTKVEIK

SEQ ID NO: 4673 - protein, 106 aa, Artificial Sequence
  anti-influenza_Chain
EIVMTQSPDTLSVSPGERATLSCRASQSVNRRLAWYQQKPGQAPRLLIHDASTRATGIPARFSGSGSGTEFTLTISSLQSEDFAVYYCQQYDNWLSFGQGTRLEIK

SEQ ID NO: 4674 - protein, 106 aa, Artificial Sequence
  anti-influenza_Chain
DIQLTQSPSSLSASVGDRVTITCRASQGILNCLAWYQQKPGKVPNLLMYAASTLQSGVPSRFSGSGFGTDFTLTISSLQPEDVATYYCQTYGGVSTFGGGTKVEIR

SEQ ID NO: 4675 - protein, 106 aa, Artificial Sequence
  anti-influenza_Chain
SYVLTQPPSVSVAPGQTARISCGGSNIGGKSVHWYQQKPGQAPVLVVYDDSGRPSGIPERFSGSNSGDTATLTISRVEAGDEADYFCQVWDNFGGVFGTGTKVTVL

SEQ ID NO: 4676 - protein, 106 aa, Artificial Sequence
  anti-influenza_Chain
DIQMTQSPSSLSASVGDRVTITCRTSQSISSYLNWYQQKPGKAPKLLIYAASSLQSGVPSRFSGSGSGTDFTLTISGLQPEDFATYYCQQSYSMPAFGQGTKLEIK

SEQ ID NO: 4677 - protein, 106 aa, Artificial Sequence
  anti-influenza_Chain
DIQMTQSPLSVSVSVGDRVTIACRASQSIDKFLNWYQQKPGKAPKLLIYGASNLHSGAPSRFSASGSGTDFTLTITNIQTEDFATYLCQQSFSVPAFGGGTKVEIK

SEQ ID NO: 4678 - protein, 106 aa, Artificial Sequence
  anti-influenza_Chain
DIQMTQSPSSLSASVGDRVTITCRASQSISTYLNWYQKRPGKAPKLLVYGASTLQSGVPSRFSGSGSGTDFTLTIASLQPEDSATYYCQQTYSIPLFGQGTRLEIK

SEQ ID NO: 4679 - protein, 106 aa, Artificial Sequence
  anti-influenza_Chain
DIQMTQSPSSLSASVGDRVTITCRASQSISTYLNWYQKRPGKAPKLLVYGASSLQSGVPSRFSGSGSGTDFTLTIASLQPEDSAVYYCQQTYSIPLFGQGTRLEIK

SEQ ID NO: 4680 - protein, 106 aa, Artificial Sequence
  anti-influenza_Chain
DIQMTQSPSSLSASVGDRVTITCRASQSISRYLNWYQQKPGKAPKLLIYGASTLQNGAPSRFSGSGSGTDFTLTISSLQPEDSATYLCQQSYSVPAFGGGTKVEVK

SEQ ID NO: 4681 - protein, 106 aa, Artificial Sequence
  anti-influenza_Chain
GIQMTQSPSSLSASVGDRVTITCRASQSISRYLNWYLQKPGKAPKLLISGASSLQSGVPSRFSGTGSGTEFTLTISSLQPEDFATYYCQQTFSIPLFGQGTKVEIK

SEQ ID NO: 4682 - protein, 107 aa, Artificial Sequence
  anti-influenza_Chain
DIQMTQSPSSLSASVGDRVSITCQASQDISRYLNWYQQKPGEAPKLLIYDASNLETGVPSRFSGSGSGTDFTFTISSLQPEDIATYFCQQYGYLPLTFGPGTKVDSK

SEQ ID NO: 4683 - protein, 107 aa, Artificial Sequence
  anti-influenza_Chain
DIQMTQSPSSFSVSLGDRVTITCKASEDIYNRLAWYQQKPGNAPRLLISDTTNLWIGVPSRFSGSGSGKDYTLSITSLQSEDVATYYCQQYWSSRTFGGGTKLEIKR

SEQ ID NO: 4684 - protein, 107 aa, Artificial Sequence
  anti-influenza_Chain
DIQMTQSPSSFSVSLGDRVTITCKASEDIYNRVAWYQQKPGNAPRLLMSDATSLGAGVPSRFSGSGSGKDHTLSITSLQTEDVATYYCQQYWNTRTFGGGTKLEIKR

SEQ ID NO: 4685 - protein, 107 aa, Artificial Sequence
  anti-influenza_Chain
DIQMTQSPSSLSASVGDRVTITCRASQSISTYLNWYQQKPGIPPKLLINVASSLQSGVPSRFSGSGSGTDFTLTISSLQPEDFASYYCQQTYSSPPTFGQGTKVEIK

SEQ ID NO: 4686 - protein, 107 aa, Artificial Sequence
  anti-influenza_Chain
DIQMTQSPSTLSGSVGDRVTITCRASQNIGPWLAWYQQESGKAPKLLISRASILESGVPSRFSGTGTGTEFTLTISSLQPDDFATYYCQHYNAYWGTFGQGTKVEIN

SEQ ID NO: 4687 - protein, 107 aa, Artificial Sequence
  anti-influenza_Chain
VIWMTQSPSLLSASTGDRVTISCRMSQGISSYLAWYQQKPGKAPELLIHTAYTLKSGVPSRFSGSGSGKDFTLTISGLQSEDFATYYCQQYYSFPYTFGQGTKVEIK

SEQ ID NO: 4688 - protein, 107 aa, Artificial Sequence
  anti-influenza_Chain
DIQMTQSPSSVSASVGDRVTITCRASQDVSTWLAWYQLKPGKAPKLLIYAASSLQSGVPSRFSGSGSGTDFTLTVSSLQPEDFATYYCQQANSFPFTFGPGTKVDIK

SEQ ID NO: 4689 - protein, 107 aa, Artificial Sequence
  anti-influenza_Chain
DIQLTQSPSFLSASVGDGVTITCRASQDIYIYLAWYQQKPGKAPKLLIYAASTLQGGVPSRFSGSGSGTEFTLTINNLQPEDFATYFCQQLNGYPLTFGGGTKVEIK

SEQ ID NO: 4690 - protein, 107 aa, Artificial Sequence
  anti-influenza_Chain
DIQLTQSPSSLSASVGDRVTLTCQASQDIRKFLNWYQQKPGKGPKLLIYDASNLQRGVPSRFSGGGSGTDFTLIISSLQPEDVGTYYCQQYDGLPFTFGGGTKLEIK

SEQ ID NO: 4691 - protein, 107 aa, Artificial Sequence
  anti-influenza_Chain
DIQLTQSPSSLSASIGDRVTITCQASQDIRNSLNWYEHKPGKAPKLLIHDASNLETGVPSRFSGGGSGTDFTLTISSLQPEDFATYYCQQANSFPLTFGGGTKVEIK

SEQ ID NO: 4692 - protein, 107 aa, Artificial Sequence
  anti-influenza_Chain
DIQLTQSPSSLSASVGDRVTITCRASQGIRNDLGWYQQKPGNAPKRLIFGASSLQSGVPSRFSGSGSGTEFTLTISSLQPEDFATYYCLQHNSYPYTFGQGTKLEIK

SEQ ID NO: 4693 - protein, 107 aa, Artificial Sequence
  anti-influenza_Chain
DIQLTQSPSSLSASVGDRVTITCRASQSISRYLNWYQQKPGKAPKLLLFAASTLLDGVPSRFSGSGSGTDFTLTISSLQPEDFATYYCQRNHSPSWTFGQGTRVEIK

SEQ ID NO: 4694 - protein, 107 aa, Artificial Sequence
  anti-influenza_Chain
DIQMTQSPSSLSASVGDRVTMTCRASQNIRSYLNWYQQRPGTAPKLLIYAASTLHSGVPSRFSGGGSGTDFTLTINNLQPEDFASYYCQQSYDNPQTFGQGTKVEIK

SEQ ID NO: 4695 - protein, 107 aa, Artificial Sequence
  anti-influenza_Chain
DIQMTQSPSSLSASVGDRVTITCRANQDIGIYLNWYQQNPGKVPKLLLHGASSLQGGVPSRFSASGSGTDFTLTIHSLQPEDLATYYCQQSRRLPYTFGQGTRVELK

SEQ ID NO: 4696 - protein, 107 aa, Artificial Sequence
  anti-influenza_Chain
DIQMTQSPSTLSASIGDRVTITCRASQSIASWLAWYQQKPGKAPKLLIYEAVNLESGVPSRFSGSGSGTDFTLTISSLQPDDFATYFCQHYGTISQTFGGGTKVEIK

SEQ ID NO: 4697 - protein, 107 aa, Artificial Sequence
  anti-influenza_Chain
DIQMTQSPSSLSASVGDRVTITCRASQSISSYLNWYQHKPGKAPKVLMYAVSILQSGVPSRFSGSGSGADFTLTISSLQPEDFATYYCQQSYSSPLTFGGGTKVEIK

SEQ ID NO: 4698 - protein, 107 aa, Artificial Sequence
  anti-influenza_Chain
DIQMTQSPSSLSASVGDRVTITCRASQNIKRYFNWYQQKPGKAPKLLIYAASNLENGVPSRFSGSGSGTDFTLTISSLQPEDFATYYCQQSFSKSWTFGQGTNVDIK

SEQ ID NO: 4699 - protein, 107 aa, Artificial Sequence
  anti-influenza_Chain
DIQMTQSPSSLSASVGDRVTITCRASQNIYKYLNWYQQRPGKAPKGLISAASGLQSGVPSRFSGSGSGTDFTLTITSLQPEDFATYYCQQSYSPPLTFGGGTRVEIK

SEQ ID NO: 4700 - protein, 107 aa, Artificial Sequence
  anti-influenza_Chain
DIQMTQSPSSLSSSVGDRVTITCRASQSIGAYVNWYQQKAGKAPQVLIFGASNLQSGVPSRFSGSGSGTDFTLTISSLQPEDFATYFCQQTYSTPITFGQGTRLEIK

SEQ ID NO: 4701 - protein, 107 aa, Artificial Sequence
  anti-influenza_Chain
DIQMTQSPSSLSASVGDRVTISCRASQSISTYLNWYQQQPGKAPKVLIFGATNLQSGVPSRFSGSGSGTDFTLTISSLQPEDFATYYCQQSYNTPLIFGQGTKLEIK

SEQ ID NO: 4702 - protein, 107 aa, Artificial Sequence
  anti-influenza_Chain
DIQMTQSPSSLSASVGDRVTISCRASQSISTYLNWYQQQPGKAPKVLISGATNLQSGVPSRFSGSGSGTDFTLTISSLQPEDFATYYCQQSYNTPLIFGQGTKLEIK

SEQ ID NO: 4703 - protein, 107 aa, Artificial Sequence
  anti-influenza_Chain
DIQMTQSPSSLSASVGDRLTITCRASQSISTYLHWYQQKPGKAPKLLIYAASSLQSGVPSRFSGSRSGTDFTLTISSLQPDDFATYYCQQSYSPPLTFGPGTKVDMK

SEQ ID NO: 4704 - protein, 107 aa, Artificial Sequence
  anti-influenza_Chain
DIQMTQSPSSLSASVGDRVTITCRASQSISNYLNWYQHKPGEAPKLLNYAASSLQSGVPSRFSASGSGTDFTLTISSLQPEDFATYYCQQSYNTPITFGQGTRLEIK

SEQ ID NO: 4705 - protein, 107 aa, Artificial Sequence
  anti-influenza_Chain
DIQMTQSPSSLSASVGDRVTITCRASQSISNYLNWYQHKPGEAPKLLNYAASSLQSGVPSRFSASGSGTDFTLSISGLQPEDFATYYCQQSYNTPITFGPGTRLEIK

SEQ ID NO: 4706 - protein, 107 aa, Artificial Sequence
  anti-influenza_Chain
DIQMTQSPSSLSASVGDRVTITCRASQSISTYLNWYQQKPGKAPKLLIYAASSLHSGVPSRFSGSGSGTDFALTISSLQPEDFATYYCQQSYSPPITFGQGTRLEIK

SEQ ID NO: 4707 - protein, 107 aa, Artificial Sequence
  anti-influenza_Chain
DIQMTQSPSSLSASVGDRVTITCRASQTISTYLNWYQQKSGKAPKLLIYAASGLQSGVPSRFSGSGSGTDFTLTISSLQPEDFATYFCQQSYNTPLTFGQGTKVEIK

SEQ ID NO: 4708 - protein, 107 aa, Artificial Sequence
  anti-influenza_Chain
DIQMTQSPSSLSASVGDRVTISCRASQSISTYLNWYQQQPGKAPKVLISGATDLQSGVPSRFSGSGSGTDFTLTISSLQPEDFATYYCQQSYNTPLIFGQGTKLEIK

SEQ ID NO: 4709 - protein, 107 aa, Artificial Sequence
  anti-influenza_Chain
DIQVTQSPSSLSASVGDRVTITCRASQNIYKYLNWYQQRPGKAPKGLISAASGLQSGVPSRFSGSGSGTDFTLTITSLQPEDFATYYCQQSYSPPLTFGGGTRVDIK

SEQ ID NO: 4710 - protein, 107 aa, Artificial Sequence
  anti-influenza_Chain
QSVLTQPPSESVSPGQTASVTCSGHKLGDKYVSWYQQKPGQSPVLLIYQDNRRPSGIPERFIGSNSGNTATLTISGTQALDEADYYCQAWDSSTAVFGGGTKLTVLG

SEQ ID NO: 4711 - protein, 107 aa, Artificial Sequence
  anti-influenza_Chain
DIQLTQSPSSLSASVGDRVTITCRASQGISTYLAWYQQKPGKVPKLLIYAASTLQSGVPSRFSGSGSGTDFTLTISSLQPEDVATYYCQKYNSAPSFGPGTKVDIKR

SEQ ID NO: 4712 - protein, 107 aa, Artificial Sequence
  anti-influenza_Chain
SVLTQPPSASGSRGQSITISCTGSTSDIGSYNYVSWYQQHPGTAPKVILYEVSQRPSGVPDRFSGSKSGNTAFLTVSGLQAEDEADYYCASYAGNNIYVFGSGTKVT

SEQ ID NO: 4713 - protein, 107 aa, Artificial Sequence
  anti-influenza_Chain
SALTQPPSASGSRGQSITISCTGSTSDIGSYNYVSWYQQHPGTAPKVILYEVSQRPSGVPDRFSGSKSGNTAFLTVSGLQAEDEADYYCASYAGNNIYVFGSGTKVT

SEQ ID NO: 4714 - protein, 107 aa, Artificial Sequence
  anti-influenza_Chain
EIVLTQSPATLSLSPGERATLSCRASQSVSTFLAWYQQKPGQAPRLLMYDASNRATGIPARFSGSGSGTDFTLTISSLEPEDFAIYYCQQRSHWPPIFGQGTRLEIK

SEQ ID NO: 4715 - protein, 107 aa, Artificial Sequence
  anti-influenza_Chain
DIQMTQSPASLSVSVGETVTITCRASEKIYSNLAWYQQKEGKSPQLLVYAAIRLADGVPSRFSGSGSGTQFSLKINSLQSEDFGTYYCQHFWGTPLTFGAGTKLELK

SEQ ID NO: 4716 - protein, 107 aa, Artificial Sequence
  anti-influenza_Chain
DIQMTQSPSSVSASVGDRVTITCRASQDISTWLAWYQQKPGKAPKLLIYAASSLQSGVPSRFSGSGSGTDFTLTISSLQPEDFATYFCQQANSFPPTFGQGTKLEIK

SEQ ID NO: 4717 - protein, 107 aa, Artificial Sequence
  anti-influenza_Chain
DIQMTQSPSSVSASVGDRVTITCRASQDISTWLAWYQQKPGKAPKLLIYAASSLQSGVPSRFSGSGSGTDFTLTISSLQPEDFATYFCQQANSFPPTFGCGTKLEIK

SEQ ID NO: 4718 - protein, 107 aa, Artificial Sequence
  anti-influenza_Chain
DIQMTQSPSSVSASVGDRVTITCRASQDISTWLAWYQQKPGKCPKLLIYAASSLQSGVPSRFSGSGSGTDFTLTISSLQPEDFATYFCQQANSFPPTFGQGTKLEIK

SEQ ID NO: 4719 - protein, 107 aa, Artificial Sequence
  anti-influenza_Chain
DIQMTQSPSSVSASVGDRVTITCRASQDISTWLAWYQQKPGKAPKLLIYAASSLQSGVPSRFSGSGSGTDFTLTISSLQPEDFATYYCQQANSFPPTFGQGTKLEIK

SEQ ID NO: 4720 - protein, 107 aa, Artificial Sequence
  anti-influenza_Chain
DIQMTQSPSSVSASVGDRVTITCRASQDISTWLAWYQQKPGKAPKLLIYAASSLQSGVPSRFSGSGSGTDFTLTISSLQPEDFATYYCQQANSFPPTFGCGTKLEIK

SEQ ID NO: 4721 - protein, 107 aa, Artificial Sequence
  anti-influenza_Chain
DIQMTQSPSSVSASVGDRVTITCRASQDISTWLAWYQQKPGKCPKLLIYAASSLQSGVPSRFSGSGSGTDFTLTISSLQPEDFATYYCQQANSFPPTFGQGTKLEIK

SEQ ID NO: 4722 - protein, 107 aa, Artificial Sequence
  anti-influenza_Chain
EIVLTQSPATLSLSPGERATLSCRASRSITTFLAWYQQKPGQAPRLLIYDASNRATGVPARFSGSGSGTDFTLTINSLEPDDFAIYYCQQRDHWPPIFGQGTRLEIK

SEQ ID NO: 4723 - protein, 107 aa, Artificial Sequence
  anti-influenza_Chain
EIVLTQSPATLSLSPGERATLSCRASRSITTFLAWYQQKPGQAPRLLIYDASNRATGVPARFSGSGSGTDFTLTINSLEPDDFAIYYCQQRDHWPPIFGCGTRLEIK

SEQ ID NO: 4724 - protein, 108 aa, Artificial Sequence
  anti-influenza_Chain
EIVLTQSPGTLSLSPGERATLSCRASQTVSSSYLAWYQQKPGQAPRLLIYGASSRATGIPDRFSGSGSGTDFTLTISRLEPEDFAVYYCQQYGNSPYTFGQGTKLEIK

SEQ ID NO: 4725 - protein, 108 aa, Artificial Sequence
  anti-influenza_Chain
EIVLTQSPGTLSVSPGERATLSCRASQSISSGYLAWYQQKPGQAPRLLIYGASSRATGIPDRFSGSGSGTDFTLTISRLEPEDFAVYYCQQYGTSPQTFGQGTKVEIK

SEQ ID NO: 4726 - protein, 108 aa, Artificial Sequence
  anti-influenza_Chain
EVVLTQSPGTLSLSPGQRATLSCRASQSVSSSYLAWYQQKPGQAPRLLIYDASNRATGIPDRFSGSGSGTDFTLTISRLEPEDFAVYYCQQYGSSPYTFGQGTKLEIK

SEQ ID NO: 4727 - protein, 108 aa, Artificial Sequence
  anti-influenza_Chain
DIQLTQSPSSLSASVGDRVTITCRASQGIITYLNWYQQKPGKAPKLLIYATYSLQNGVPSRFSGSGSGTDFTLTISSLQPEDFATYYCQQSYSSLMFTFGQGTKLDIK

SEQ ID NO: 4728 - protein, 108 aa, Artificial Sequence
  anti-influenza_Chain
ETVLTQSPGTLSLTPGERATLSCRVGQSVSGSHLAWYQQKPGQAPRLLIYGASSRATGIPDRFGGSVSGTDFTLTISRLEPEDSAVYYCQQYGDSRYTFGQGTKLEIK

SEQ ID NO: 4729 - protein, 108 aa, Artificial Sequence
  anti-influenza_Chain
EIVLTQSPGTLSLSPGERATLSCRASQSVSSSQLAWYQQKPGQAPRLIIYGASTRATGIPDRFSGSGSGTDFTLTIGRLEPEDFAVFFCQQYSTSPPTFGQGTKVDFK

SEQ ID NO: 4730 - protein, 108 aa, Artificial Sequence
  anti-influenza_Chain
DIVLTQSPGTLSLSPGERATLSCRASQSVSSSYLAWYQQKPGQAPRLVMYGAATRATGIPDRFSGSGSGPDFTLTISRLEPEDFAMYYCQQYGNSPITFGQGTRLEIK

SEQ ID NO: 4731 - protein, 108 aa, Artificial Sequence
  anti-influenza_Chain
EIVLTQSPATLSLSPGERATLSCRASQSVSSYLAWYQQKPGQAPRLLIYDASNRATGIPARFSGSGSGTDFTLTISSLEPEDFAVYYCQQRSHWPPITFGQGTRLEIK

SEQ ID NO: 4732 - protein, 108 aa, Artificial Sequence
  anti-influenza_Chain
SYELTQPPSVSVSPGQTARITCSGDALPKQNAYWYQQKPGQAPVLLIYKDSERPSGIPERFSGSSSGTTVTLTISGVQAEDEADYYCQSADSSGTSWVFGGGTKLTVL

SEQ ID NO: 4733 - protein, 108 aa, Artificial Sequence
  anti-influenza_Chain
SYVLTQAPSVSVAPGQTARITCGGNAIGSKKVHWYQHKAGQAPVLVVYDDTDRPSGIPERFSGSNSWSTATLTINRVEAGDEADYYCQVWDFTIDHVVFGGGTKLTVL

SEQ ID NO: 4734 - protein, 108 aa, Artificial Sequence
  anti-influenza_Chain
EIVLTQSPGTLSLSPGERATLSCRASQSVSSSYLAWYQKKPGQAPRLLIYGASTRATGIPDRFTGSGSGTDFTLSISRLEPEDFAVYYCQHFGTSVFTFGGGTKVEIK

SEQ ID NO: 4735 - protein, 108 aa, Artificial Sequence
  anti-influenza_Chain
EIVMTQSPATLSVSPGERATLSCRASQSVGNSLAWYQQRPGQAPRLLIYGASTRATGIPPRFSGSGSGTEFTLTISSLQTEDFAVYYCQQYINWRPLSFGGGTKVEIK

SEQ ID NO: 4736 - protein, 108 aa, Artificial Sequence
  anti-influenza_Chain
QESGAELVRPGASVKLSCKDSGYTFTTYWMNWVKQRPEQGLEWIGRIDPYDSETHYNQKFKDKAILTVDKSSNTAYMQLSSLTSEDSAVYYCVRGGSTVAYFGVWGQG

SEQ ID NO: 4737 - protein, 108 aa, Artificial Sequence
  anti-influenza_Chain
EIVLTQSPGTLSLSPGERATLSCRASQRVSSYLAWYQQKPGQAPRLLIYGASTRAAGIPDRFSGSGSGTDFTLTISRLEPEDSAVYYCQQYGRTPLTFGGGTKVEIKR

SEQ ID NO: 4738 - protein, 108 aa, Artificial Sequence
  anti-influenza_Chain
EIVMTQSPGTLSLSPGERATLSCRASQSVSSSYLAWYQQKPGQAPRLLIFGASSRATGIPDRFSGSGSGTDFTLTISRLEPEDFAVYYCQQYGSSLTFGGGTKLEIKR

SEQ ID NO: 4739 - protein, 108 aa, Artificial Sequence
  anti-influenza_Chain
EIVLYQSPGTLSLSPGERATLSCRASQRVSSYLAWYQQKPGQAPRLLIYGASTRAAGIPDRFSGSGSGTDFTLTISRLEPEDSAVYYCQQYGRTPLTFGGGTKVEIKR

SEQ ID NO: 4740 - protein, 108 aa, Artificial Sequence
  anti-influenza_Chain
DIVLTQAPSVSVSPGQTASITCSGDRLGEKFASWYQQKPGQSPVLVIYEDSKRPSGIPDRFSGSNSGNTATLTISGTQIMDEGDFFCQAWDSSTVVFGGGTKLTVLGQ

SEQ ID NO: 4741 - protein, 108 aa, Artificial Sequence
  anti-influenza_Chain
DIELTQSPSVSVSPGQTASITCSGDKLGDKFVCWYQQKAGQSPIVVIYQDDKRPSGIPERFSGSNSGNTATLTISGTQAMDEADYFCQAWDSTTVVFGGGTKLTVLGQ

SEQ ID NO: 4742 - protein, 108 aa, Artificial Sequence
  anti-influenza_Chain
QSVLTQPPSASGSRGQSITISCTGSTSDIGSYNYVSWYQQHPGTAPKVILYEVSQRPSGVPDRFSGSKSGNTAFLTVSGLQTDDEADYYCASYAGNNIYVFGSGTKVT

SEQ ID NO: 4743 - protein, 109 aa, Artificial Sequence
  anti-influenza_Chain
NFMLTQPHSVSESPGKTVTISCTGSGGNIARNYVQWYQQRPGSAPVTVILEDDKRPSGIPDRFSGSIDRSSNSASLTISGLRTEDEALYYCQSYDDSDLVVFGGGTKLT

SEQ ID NO: 4744 - protein, 109 aa, Artificial Sequence
  anti-influenza_Chain
MLEPLQILSICSFILSALHFMAWTIGHLNQIKRGVNLKIQIRNPNKEAINREVSILRHNYQKEIQAKETMKKILSDNMEVLGDHIVVEGLSTDEIIKMGETVLEVEELQ

SEQ ID NO: 4745 - protein, 109 aa, Artificial Sequence
  anti-influenza_Chain
DIRLTQSPATLSVSPGERATLSCRASHSVSRNLAWYQQKPGRAPRLLVYDTSSRATGIPARFSGSGSGTEFTLTISSLQSEDFAVYYCQQYNNWPRTFGQGTKVDIKRT

SEQ ID NO: 4746 - protein, 109 aa, Artificial Sequence
  anti-influenza_Chain
EIVMTQSPGTLSLSPGERATLSCRASQSVSSSYLAWYQQKPGQAPRLLIYGASTRATGVPDRFHGGGSGTDFTLTISRLEPEDFAVYYCQQYDTSSGLTFGGGTKVEIK

SEQ ID NO: 4747 - protein, 109 aa, Artificial Sequence
  anti-influenza_Chain
EIVMTQFPATLSVSPGERVTLSCRASQSVSNNLAWYQQKPGQPPRLLIYDASTRATGVPAKFSGTGSGTEFTLSISSLQSEDFAVYYCQQYHNWPPSYSFGLGTKLEIK

SEQ ID NO: 4748 - protein, 109 aa, Artificial Sequence
  anti-influenza_Chain
EIILAQSPGTLSLSPGERATLSCRASQFVSTRSLAWYQQRPGQAPRLLIYGASSRATGIPDRFSGSGSGTDFTLTISRLEPEDFAVYYCQHYGYSPRYAFGQGSKVEIK

SEQ ID NO: 4749 - protein, 109 aa, Artificial Sequence
  anti-influenza_Chain
EIVLTQSPGTLSLSPGERATLSCRASHFVNYRSLAWYQQTPGQVPRLLIYGASTRATGIPDRFSGSGSGTDFTLTISRLEPEDFAVYFCQQYGGSPRYTFGQGTRLEIK

SEQ ID NO: 4750 - protein, 109 aa, Artificial Sequence
  anti-influenza_Chain
EIVLTQSPGTLSLSPGERATLSCRASHFVIGRAVAWYQQKPGQAPRLLIYGASSRATGIPDRFSGSGSGTDFTLTISRLETEDFAVFYCQHYGSSPRYAFGQGTKLEIK

SEQ ID NO: 4751 - protein, 109 aa, Artificial Sequence
  anti-influenza_Chain
EIVLTQSPATLSLSPGERATLSCRASQSVGNYLAWYQQKPGQAPRLLIYDSSNRAPGIPARFSGSGSGTDFTLTISSLAPEDFAVYYCQQRSKWPPMYSFGHGTKLEIK

SEQ ID NO: 4752 - protein, 109 aa, Artificial Sequence
  anti-influenza_Chain
QAVVTQEPSLTVSPGGTVTLTCGSSTGPVTSGHYPYWFQQKPGQAPRTLISATSNTHSWTPARFSGSLLGGRAALTLSGAQPEDEADYYCFLSYSGAWVFGGGTTLTVL

SEQ ID NO: 4753 - protein, 109 aa, Artificial Sequence
  anti-influenza_Chain
AIQMTQSPSSLSASVGDRVTITCRASQNIRSYLNWYQQKPGKAPNLLIYGTTSLESGVPSRFSGSGSGTDFTLTISSLQPEDFATYYCQQSYHTPQTFGQGTKVEIKRT

SEQ ID NO: 4754 - protein, 109 aa, Artificial Sequence
  anti-influenza_Chain
DIQMTQSPSSLSASVGDRITITCRASQGIDNYLAWFQQKPGKVPELLIYAASTLQSGVPSRFSGSGSGTGFTLTISSLQPEDVATYYCQKYDSAPLTFGGGTKVDIKRT

SEQ ID NO: 4755 - protein, 109 aa, Artificial Sequence
  anti-influenza_Chain
DIQLTQSPSSLSASVGDRVTITCRASQGITDYLAWYQQKPGTIPKLLIYAASTLQSGVPSRFSGGGYGTDFTLTISSLQPEDVATYYCQKYNSAPLTFGGGTKVEIKRT

SEQ ID NO: 4756 - protein, 109 aa, Artificial Sequence
  anti-influenza_Chain
DIVMTQSPFSLSLSPGERATLSCRASQSISNYLAWYQQKPGQAPRLLIYDSSNRATGVPARFSGSGSGTDFTLTISSLEPEDFAVYYCQQRSNWMYTFGQGTKVEIKRT

SEQ ID NO: 4757 - protein, 109 aa, Artificial Sequence
  anti-influenza_Chain
DIQMTQSPSSLSASVGDRVTITCRASQGISSYLAWYQQKPGKVPTLLIYDASTLRSGVPSRFSGSGSATDFTLTISSLQPEDVATYYCQRYNSAPPITFGQGTRLEIKR

SEQ ID NO: 4758 - protein, 109 aa, Artificial Sequence
  anti-influenza_Chain
EIVMTQSPGTLSLSPGERATLSCRASQSVSSSYLAWYQQKPGQAPRLLIYDASSRATDIPDRFSGSGSGTDFTLTISRLEPEDFAVYYCQQYGSSLWTFGQGTKVEIKR

SEQ ID NO: 4759 - protein, 109 aa, Artificial Sequence
  anti-influenza_Chain
SYVLTQPPSVSVAPGQTARITCGGNNIGSKSVHWYQQKPGQAPVLVVYDDSDRPSGIPERFSGSNSGNTATLTISRVEAGDEADYYCQVWDSSSDHAVFGGGTQLTVLG

SEQ ID NO: 4760 - protein, 109 aa, Artificial Sequence
  anti-influenza_Chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGGGTKVEIKR

SEQ ID NO: 4761 - protein, 109 aa, Artificial Sequence
  anti-influenza_Chain
SYVLTQPPSVSVAPGQTARITCGGNNIGSKGVHWYQQKPGQAPVLVVYDDSDRPSGIPERFSGSNSGNTATLTISRVEAGDEADYYCQVWDSSSDHVVFGGGTKLTVLG

SEQ ID NO: 4762 - protein, 109 aa, Artificial Sequence
  anti-influenza_Chain
EIVLTQSPGTLSLSPGERATLSCRASQSVSSNYLGWTQQKPGQAPRLLIYGASSRASGIPDRFSGGGSGTDFTLTISRLEPEDFAVYYCQQYGSSPLTFGGGTKVEIKR

SEQ ID NO: 4763 - protein, 109 aa, Artificial Sequence
  anti-influenza_Chain
QSVVTQPPSVSVAPGQTARITCGGNNIGSKSVHWYQQKPGQAPVLVVYDDSDRPSGIPERFSGSNSGNTATLTISRVEAGDEADYYCQVWDSSSDHYVFGTGTKVTVLG

SEQ ID NO: 4764 - protein, 109 aa, Artificial Sequence
  anti-influenza_Chain
SYVLTQPPSESVAPGQTARITCGGNNIGRNSVHWYQQKPGQAPVLVVYDDSDRPSGIPERFSGSKSGNTATLIISRVEVGDEADYYCQVWHSSSDHYVFGTGTKVTVLG

SEQ ID NO: 4765 - protein, 109 aa, Artificial Sequence
  anti-influenza_Chain
EIVMTQSPGTLSLSPGQRATLSCRASQSVSSSYLAWYQQKPGQAPRLLMYGASSRATGIPDRFSGSGSGTDFTLTISRLEPEDFAVYYCQQYGSSSLTFGGGTKLEIKR

SEQ ID NO: 4766 - protein, 109 aa, Artificial Sequence
  anti-influenza_Chain
QAGLTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVLG

SEQ ID NO: 4767 - protein, 109 aa, Artificial Sequence
  anti-influenza_Chain
QSVVTQPPSESVAPGQTARITCGGHNIGSNSVHWYQQKPGQAPVLVVYDNSDRPSGIPERFSGSNSGNTATLTISRVEAGDEADYYCQVWGSSSDHYVFGTGTKVTVLG

SEQ ID NO: 4768 - protein, 109 aa, Artificial Sequence
  anti-influenza_Chain
EIVLTQSPGTLSLSPGERATLSCRASQSVSSNYLGWYQQKPGQAPRLLIYGASSRASGIPDRFSGGGSGTDFTLTISRLEPEDFAVYYCQQYGSSPLTFGGGTKVEIKR

SEQ ID NO: 4769 - protein, 109 aa, Artificial Sequence
  anti-influenza_Chain
EIVLTQSPATLSVSPGERATLSCRASQSVDSNLAWYQQKPGQAPRLLVYSASTRATGIPARFSGSGSGTEFTLAISSLQSEDFAVYYCQHYTNWPPRLTFGGGSKVEIK

SEQ ID NO: 4770 - protein, 109 aa, Artificial Sequence
  anti-influenza_Chain
EIVLTQSPATLSVSPGERATLSCRASQSVSHNLAWYQQKPGQAPRLLVYSASTRATGIPARFSGSGSGTEFTLAISSLQSEDFAVYYCQHYTNYPPRLTFGGGSKVEIK

SEQ ID NO: 4771 - protein, 109 aa, Artificial Sequence
  anti-influenza_Chain
EIVMTQSPATLSVSPGERATLSCRASQSVDSNLAWYQQKPGQAPRLLVYSASTRATGIPARFSGSGSGTEFTLAISSLQSEDFAVYYCQHYTNWPPRLTFGGGSKVEIK

SEQ ID NO: 4772 - protein, 109 aa, Artificial Sequence
  anti-influenza_Chain
EIVLTQSPATLSVSPGERATLSCRASQSVSSNLAWYQQKPGQAPRLLVYSASTRATGIPARFSGSGSGTEFTLAISSLQSEDFAVYYCQHYTNWPPRLTFGGGSKVEIK

SEQ ID NO: 4773 - protein, 109 aa, Artificial Sequence
  anti-influenza_Chain
EIVLTQSPATLSVSPGERATLSCRASQSVDHNLAWYQQKPGQAPRLLVYSASTRATGIPARFSGSGSGTEFTLAISSLQSEDFAVYYCQHYTNWPPRLTFGGGSKVEIK

SEQ ID NO: 4774 - protein, 109 aa, Artificial Sequence
  anti-influenza_Chain
EIVLTQSPATLSVSPGERATLSCRASQSVSHNLAWYQQKPGQAPRLLVYSASTRATGIPARFSGSGSGTEFTLAISSLQSEDFAVYYCQHYTNWPPRLTFGGGSKVEIK

SEQ ID NO: 4775 - protein, 109 aa, Artificial Sequence
  anti-influenza_Chain
EIVLTQSPATLSVSPGERATLSCRASQSVSHNLAWYQQKPGQAPRLLVYSASTRATGIPARFSGSGSGTEFTLAISSLQSEDFAVYYCQHYTNFPPRLTFGGGSKVEIK

SEQ ID NO: 4776 - protein, 109 aa, Artificial Sequence
  anti-influenza_Chain
EIVLTQSPATLSVSPGERATLSCRASQSVDSNLAWYQQKPGQAPRLLVYSASTRATGIPARFSGSGSGTEFTLAISSLQSEDFAVYYCQHYTNFPPRLTFGGGSKVEIK

SEQ ID NO: 4777 - protein, 109 aa, Artificial Sequence
  anti-influenza_Chain
EIVLTQSPATLSVSPGERATLSCRASQSVDSNLAWYQQKPGQAPRLLVYSASTRATGIPARFSGSGSGTEFTLAISSLQSEDFAVYYCQHYTNYPPRLTFGGGSKVEIK

SEQ ID NO: 4778 - protein, 109 aa, Artificial Sequence
  anti-influenza_Chain
ETTLTQSPATLSVSPGERATLSCRASQVISHNLAWYQQKPGQAPRLLIYGASTRASGIPARFSGSGSGTDYTLTITSLQSEDFAVYYCQHYSNWPPRLTFGGGTKVEIK

SEQ ID NO: 4779 - protein, 109 aa, Artificial Sequence
  anti-influenza_Chain
EIVLTQSPATLSVSPGERATLSCRASQVISHNLAWYQQKPGQAPRLLIYGASTRASGIPARFSGSGSGTDYTLTITSLQSEDFAVYYCQHYSNWPPRLTFGGGTKVEIK

SEQ ID NO: 4780 - protein, 109 aa, Artificial Sequence
  anti-influenza_Chain
EIVLTQSPATLSVSPGERATLSCRASQVISHNLAWYQQKPGQAPRLLIYGASTRASGIPARFSGSGSGTDYTLTITSLQPEDFAVYYCQHYSNWPPRLTFGGGTKVEIK

SEQ ID NO: 4781 - protein, 109 aa, Artificial Sequence
  anti-influenza_Chain
EIVMTQSPATLSVSPGERATLSCRASQVISHNLAWYQQKPGQAPRLLIYGASTRASGIPARFSGSGSGTDYTLTITSLQSEDFAVYYCQHYSNWPPRLTFGGGTKVEIK

SEQ ID NO: 4782 - protein, 109 aa, Artificial Sequence
  anti-influenza_Chain
EIVLTQSPATLSVSPGERATLSCRASQVISHNLAWYQQKPGQAPRLLIYGASTRASGIPARFSGSGSGTDYTLTITSLQSEDFAVYYCQHYSNFPPRLTFGGGTKVEIK

SEQ ID NO: 4783 - protein, 109 aa, Artificial Sequence
  anti-influenza_Chain
EIVLTQSPATLSVSPGERATLSCRASQVISHNLAWYQQKPGQAPRLLIYGASTRASGIPARFSGSGSGTDYTLTITSLQSEDFAVYYCQHYSNYPPRLTFGGGTKVEIK

SEQ ID NO: 4784 - protein, 109 aa, Artificial Sequence
  anti-influenza_Chain
EIVLTQSPATLSVSPGERVTLSCRASQSVANNLAWYQQKPGQSPRLLIYGASTRDTGIPARFSGSGSGTEFTLTISSLQSEDFAVYYCQQYNNWPPMYTFGQGTKLEIK

SEQ ID NO: 4785 - protein, 109 aa, Artificial Sequence
  anti-influenza_Chain
DIVMTQSPSTLSASVGDRVTITCRASQSIGNWLAWYQQKPGKAPKLLIYKVSTLESGVPSRFSGSGSGTEFTLTINSLQPDDFATYYCQRYTSNSQGFTFGQGTKLEIK

SEQ ID NO: 4786 - protein, 109 aa, Artificial Sequence
  anti-influenza_Chain
DIVMTQSPATLSVSPGERATLSCRASQVVGTNLAWYQQKPGQAPRLLIYAASTRATGIPARFSGSGFGTDFTLTISSLQSEDFAVYYCQQYNNWPLSFGGGTKVEIRRT

SEQ ID NO: 4787 - protein, 109 aa, Artificial Sequence
  anti-influenza_Chain
DIQMTQSPSSLSASVGDRVTIVCRASQGINTHLHWYQQKPGKAPKLLIYSASTLHTGVPSRLSGSGSGTDFTLSISSLQPEDFATYYCQQSYNYPRTFGQGTNVDIKRT

SEQ ID NO: 4788 - protein, 109 aa, Artificial Sequence
  anti-influenza_Chain
DILMTQSPSSLSASVGDRVTITCRASQDIRNRLAWYQQKPGKAPKRLIYAASSLQSGVPSRFSGSGSGTEFTLTINSLQPEDFATYYCLQHNSYPWTFGPGTKVEIKRT

SEQ ID NO: 4789 - protein, 109 aa, Artificial Sequence
  anti-influenza_Chain
DIVMTQSPATLSVSPGEGATLSCRASQGIGSNLAWYQHKPGQAPRLLIYAASTRATGVPARFSGSGSGTEFTLTISSLQSEDLAVYFCQQYNTWPLTFGGGTKVEIIRT

SEQ ID NO: 4790 - protein, 109 aa, Artificial Sequence
  anti-influenza_Chain
DIVMTQSPSTLSASVGDRVTITCRASQTIYRWLAWYQQKPGKAPKVLIYKASTLESGVPSRFSGSGSGTEFTLAISSLQPDDFATYYCQQYNSFPYRFGQGTKVEIKRT

SEQ ID NO: 4791 - protein, 109 aa, Artificial Sequence
  anti-influenza_Chain
DIVMTQSPSSLSASVGDRVSITCRASQTITRFLNWYQQKPGKGPKLLIYAASTVHRGVPSRFSGSGSGTDFTLTISSLQPEDFATYYCQQSYSAPFTFGPGTTVDIRRT

SEQ ID NO: 4792 - protein, 109 aa, Artificial Sequence
  anti-influenza_Chain
DIVMTQPPATLSVSPGERATLSCGASQGLGSNLAWYQQKPGQAPRLLIYAASTRATGITARFSGSGSGTEFTLTINSLQSEDFALYYCQQYTYWPLTFGGGTKVEIKRT

SEQ ID NO: 4793 - protein, 109 aa, Artificial Sequence
  anti-influenza_Chain
DIVLTQSPATLSVSPGERATLSCRASQSVNRNLAWFQQIPGQAPRLLIFDASTRAADIPARFSGGGSGAEFTLTVSSLQPEDFAVYYCQQYDKWPPGFGQGTKVEIKRT

SEQ ID NO: 4794 - protein, 110 aa, Artificial Sequence
  anti-influenza_Chain
QSVLTQPPSASGAPGQRVTLSCSGSGSNIGSNTVSWYQQLPGTAPKLLVFTNNQRPSGVPDRFSGSKSGTSASLAISGLQSEDEADYYCAAWDDSLNGQLFGGGTKLTVL

SEQ ID NO: 4795 - protein, 110 aa, Artificial Sequence
  anti-influenza_Chain
QSVLTQPPSVSAAPGQRVTISCSGTSSNIGKNYVSWYQQLPGAAPKLLIYDNDKRPSGIPDRFSGSKSGTSATLGITGLQTGDEADYYCGTWDSSLSVGMFGGGTRLTVL

SEQ ID NO: 4796 - protein, 110 aa, Artificial Sequence
  anti-influenza_Chain
ETTLTQSPATLSVSPGERATLSCRASQSVSRNLAWYQQKPGQAPRLLIYGASSRATGIPDRFSGSGSGTDFTLTISRLEPEDFAVYYCQQYGSSSITFGQGTRLEIKRTV

SEQ ID NO: 4797 - protein, 110 aa, Artificial Sequence
  anti-influenza_Chain
QSVLTQPPSASGTPGQRVTISCSGSSSNIGSNTVNWYKQLPGTAPRLLIYSNDQRPSGVPDRFSGSKSGTSASLAISGLQSEDEANYYCAAWDDSLSGWVFGGGTKLTVL

SEQ ID NO: 4798 - protein, 110 aa, Artificial Sequence
  anti-influenza_Chain
QSALTQPRSVSGSPGQSVTISCTGSSSDVGASNSVSWYQQHPGKAPKLVIYDVTERPSGVPHRFSGSKSGNTASLTVSGLQPEDEADYFCCAYGGKYLVVFGGGTKVTVL

SEQ ID NO: 4799 - protein, 110 aa, Artificial Sequence
  anti-influenza_Chain
QSALTQPASVSGSPGQSITISCTGTSSDVGGYNYVSWYQQHPGKAPKLLIYEVTNWPSGVSNRFSGSKSGNTASLTISGLQAEDEADYYCSSYAGSSTWVFGGGTRVTVL

SEQ ID NO: 4800 - protein, 110 aa, Artificial Sequence
  anti-influenza_Chain
QTVVTQEPSLTVSPGGTVTLTCASSTGAVTSSYFPNWFQQKPGQAPRPLIYSTTIRHSWTPARFSGSLLGGKAALTLSGVQPEDEADYYCLLYSGGDPVAFGGGTKLTVL

SEQ ID NO: 4801 - protein, 110 aa, Artificial Sequence
  anti-influenza_Chain
QSVLTQSPSVSAAPGQKVTISCSGSDSNIGDYFVCWYQHLPGKPPQLLIYENNKRPSGIPDRFSGSKSGTSATLGITGIQTGDEADYYCATWDGSLSAWVFGGGTKLTVL

SEQ ID NO: 4802 - protein, 110 aa, Artificial Sequence
  anti-influenza_Chain
QSALTQPRSVSGSPGQSITISCTGGSSDIGASNSVSWYQQHPGKAPKLVIFDVTERPSGVPHRFSGSKSGNTASLTVSGLQPDDEADYFCCAYGGKYLVVFGGGTKVTVL

SEQ ID NO: 4803 - protein, 110 aa, Artificial Sequence
  anti-influenza_Chain
QAVVTQEPSLAVSPGGTVTLTCGSSTGAVTRGHYPYWFQQKPGQAPRALIYDSAGNRHSWTPARFSGSLLGGKAALTLSGAQPEDEAEYYCLLSYSGVWVFGGGTKLTVL

SEQ ID NO: 4804 - protein, 110 aa, Artificial Sequence
  anti-influenza_Chain
EIVMTQSPATLSVSPGERVTLSCRASQSITDGLAWYQQKSGQAPRLLIYGASTRATGIPARFSGSGSGTEFTLTISSLQSEDFAVYYCQQYNNWPPVTFGQGTKVEIKRT

SEQ ID NO: 4805 - protein, 110 aa, Artificial Sequence
  anti-influenza_Chain
SSELTQPPSASGTPGQRVTISCSGSTSNIGYNPVSWYQQVPGTAPKLLIYSNTERPSGVPDRFSGSKSGTSASLAISGLQSEDEADYYCAAWDDTLNGPVFGGGTKVTVL

SEQ ID NO: 4806 - protein, 110 aa, Artificial Sequence
  anti-influenza_Chain
QSALTQPASVSGSPGQSITISCTGTSSDVGGYNYVSWYQQHPGEAPKLMISDVSNRPSGVSNRFSGSKSGNTASLTISGLQAEDEADYYCTSYTSSNTLVFGGGTKLTVL

SEQ ID NO: 4807 - protein, 110 aa, Artificial Sequence
  anti-influenza_Chain
QSVLTQPPSVSAAPGQKVTISCSGSSSNIGHNFVSWYQQLPATAPKLLIYDTDKRPSGIPDRFSGSKSGTSATLGITGLQTGDEADYYCGTWDSSLSSVIFGGGTKLTVL

SEQ ID NO: 4808 - protein, 110 aa, Artificial Sequence
  anti-influenza_Chain
DIQMTQSPSTLSASVGDRVTITCRASQTINNYLAWYQQKPGKAPKLLIYKASSLESGVPSRFSGSGSGTEFTLTISSLQPDDFATYYCQEYNNDSPLTFGGGTKVEIKRT

SEQ ID NO: 4809 - protein, 110 aa, Artificial Sequence
  anti-influenza_Chain
DIELTQDPSVSVAPGQTARIPCVRFNMGPTSVHWYQQKPGQAPVLVVYDDSDRPSGIPERFSGSNSGDSATLTISRVEAGDEADYYCQVWDMSSDRRVFGGGTTLTVLGQ

SEQ ID NO: 4810 - protein, 110 aa, Artificial Sequence
  anti-influenza_Chain
DIVMTQSPGTLSLSPGERATLYCRASQSVRSGYLAWYQHKPGQAPLLLFYDASGRATGIPDRFSGSGSGTDFTLTISRLEPEDFAVYYCLQYGSSPRTFGQGTKVEIKRT

SEQ ID NO: 4811 - protein, 110 aa, Artificial Sequence
  anti-influenza_Chain
DIVLTQSPSFLSASVGDRVTITCRASQLISSYFAWYQQKPGKPPKLLIYAASTLQSGVPSRFSGSGSGTQFSLTISSLQPEDFATYYCQQLNSYPPITFGQGTRLEIKRT

SEQ ID NO: 4812 - protein, 110 aa, Artificial Sequence
  anti-influenza_Chain
DITLTQSPATLSVSPGERATLSCRASQSVSSNLAWYQQKPGQAPRLLIYGASNRATDIPARFSGSGSGTEFTLTISSLQSEDFAVYYCQQFNDWPFLTFGGGTKVEIKRT

SEQ ID NO: 4813 - protein, 110 aa, Artificial Sequence
  anti-influenza_Chain
DIVMTQSPSFLSASVGDRVTITCRTSQVISSYLAWYQQRPGKAPKLLIYAASTLQSGVPSRFSGSGSGTRFSLTISNLQPEDFATYFCQQLTTYPPITFGQGTRLEIKRT

SEQ ID NO: 4814 - protein, 110 aa, Artificial Sequence
  anti-influenza_Chain
DIVLTQSPSVSVAPGQTARITCGGNDIGSKSVHWYQQKPGQAPVLVVFDDRDRPSGIPERFSGSNSGNTATLTISRVEAGDEADYYCQVWDITSDLVVFGGGTKLTVVGQ

SEQ ID NO: 4815 - protein, 110 aa, Artificial Sequence
  anti-influenza_Chain
DIVMTQPPGTLSVSPGERATLSCRASQSVSTNLAWYQQKPGQAPRLLIHGASTRATGIPARFSGSGSGAEFTLTISSLQSEDVAVYYCQQYDNWLPITFGPGTKVDIQRT

SEQ ID NO: 4816 - protein, 110 aa, Artificial Sequence
  anti-influenza_Chain
DPMLTQTASPVSAAVGGTVTINCQASQSVYNKNNLAWYQQKLGQPPKLLIYAASTLTSGVPSRFKGSGSGTQFTLTISDLECDDAATYYCAGDYSGGIYAFGGGTKVEIK

SEQ ID NO: 4817 - protein, 110 aa, Artificial Sequence
  anti-influenza_Chain
ELVMTQTPASVSAAVGGTVTISCQSSESVYKNNNLAWFQQKLGQPPKLLIYDASKLASGVPSRFSGSGSGTQFTLTISDLECDDAATYYCAGDYSGSNYAFGGGTKLEIK

SEQ ID NO: 4818 - protein, 110 aa, Artificial Sequence
  anti-influenza_Chain
EPMLTQTASSVSAAVGGSVTISCQSSQSVDSNNQLSWYQQKPGQPPKLLIYAASTLTSGVPSRFKGSGSGTQFTLTISDLECDDAATYYCAGDYSGGIYAFGGGTEVVVK

SEQ ID NO: 4819 - protein, 110 aa, Artificial Sequence
  anti-influenza_Chain
DPMLTQTAASVSAAVGGTVTISCQSSESVYKNNNLAWFQQKLGQPPTLLIWDASKLASGVPSRFSGSGSGTQFTLTISDLECDDAATYYCAGDYSGVNYAFGGGTEVVVK

SEQ ID NO: 4820 - protein, 110 aa, Artificial Sequence
  anti-influenza_Chain
ELVMTQTPASVSAAVGGTVTISCQSSESVYKNNNLAWFQQKLGQPPKLLIYDASKLASGVPSRFSGSGSGTQFTLTISDLECDDAATYYCAGDYSGSNYAFGGGTEVVVK

SEQ ID NO: 4821 - protein, 110 aa, Artificial Sequence
  anti-influenza_Chain
DPMLTQTASSVSATVGGTVTISCQSSQSVDNNKDLAWFQQKPGHSPKLLIYFASRLASGVPSRFKGSGSGTHFTLTISDLECDDAATYYCAGDYSGANYAFGGGTKLEIK

SEQ ID NO: 4822 - protein, 110 aa, Artificial Sequence
  anti-influenza_Chain
DPMLTQTASPVSAAVGGTVTINCQSSQSVYNNNRLSWFQQKPGQPPKLLIYSASTLASGVSSRFKGSGSGTQFTLTISDLECDDAATYYCAGDYSGGIYAFGGGTELEIL

SEQ ID NO: 4823 - protein, 110 aa, Artificial Sequence
  anti-influenza_Chain
ELVLTQTPASVSAAVGGTVSISCQSSQSVYKNNNLAWFQQKLGQPPTLLIWDASKLASGVPSRFSGSGSGTQFTLTISDLECDDAATYYCAGDYSGVNYAFGGGTKLEIK

SEQ ID NO: 4824 - protein, 110 aa, Artificial Sequence
  anti-influenza_Chain
ELDLTQTPASVSAAVGGTVTISCQSSESVYKNNNLAWFQQKLGQPPTLLIWDASKLASGVPSRFSGSGSGTQFTLTISDLECDDAATYYCAGDYSGVNYAFGGGTEVVVK

SEQ ID NO: 4825 - protein, 110 aa, Artificial Sequence
  anti-influenza_Chain
DIQMTQSPSSLSASVGDRVTITCQSSESVYKNNNLAWYQQKPGKPPKLLIWDASKLASGVPSRFSGSGSGTDFTLTISSLQPEDVATYYCAGDYSGVNYAFGGGTEVVVK

SEQ ID NO: 4826 - protein, 111 aa, Artificial Sequence
  anti-influenza_Chain
DIVMTQSPDSLAVSLGERATINCKSSQSVTFNNKNYLAWYQQKPGQPPKLLIYWASTRESGVPDRFSGSGSGTDFTLTISSLQAEDVAVYYCQQHYRTPPTFGQGTKVEIK

SEQ ID NO: 4827 - protein, 111 aa, Artificial Sequence
  anti-influenza_Chain
QSALTQPASVSGSPGQSITISCTGTGSDVGSSNLVSWYQQHPAKAPKLIIYEVTKRPSGVSNRFSGSKSGNTASLTISGLQAEDEADYYCCSYAGSSSSRVFGTGTKVTVL

SEQ ID NO: 4828 - protein, 111 aa, Artificial Sequence
  anti-influenza_Chain
QSVLTQPPSASGTPGQRVTISCSGSTSNIGSNAVNWYQQLPGTAPKLLIYSNNQRPSGVPDRFSGSKSGTSASLAISGLQSEDEADYYCAAWDDSLSGSWVFGGGTKLTVL

SEQ ID NO: 4829 - protein, 111 aa, Artificial Sequence
  anti-influenza_Chain
ETTLTQSPGTLSLSPGERATLSCRVSQSVSSNYLAWYQQKPGQAPRLLIYGASSRATGIPDRFSGSGSGTDFTLTISRLEPEDFAVYYCQQYGTSPRAFGHGTKVEIKRTV

SEQ ID NO: 4830 - protein, 111 aa, Artificial Sequence
  anti-influenza_Chain
QSVLTQPPSVSGAPGQRVTISCGGSRSNIGAGYDVHWYQQFPGTAPKVVIYGNNNRPSGVPDRFSGSKSGTSASLAITGLQAEDEANYYCQSYDTNLGGSIFGGGTQVTVL

SEQ ID NO: 4831 - protein, 111 aa, Artificial Sequence
  anti-influenza_Chain
NFMLTQPHSVSESPGKTVTISCTGSSGSIASNYVQWYQQRPGSAPTTVIYEDYQRPSGVPDRFSGSIDSSSNSASLTISGLKTEDEADYYCQSYDDSDHLIFGGGTKLTVL

SEQ ID NO: 4832 - protein, 111 aa, Artificial Sequence
  anti-influenza_Chain
QSMLTQPPSASGTPGQRVTISCSGSSSNIGSNTVNWFKHLPGTAPKLLIYRNDLRPSGVPDRFSGSKSGTSASLAISGLQSEDEADYYCATWDDSLNGFYVFGTGTKVTVL

SEQ ID NO: 4833 - protein, 111 aa, Artificial Sequence
  anti-influenza_Chain
DIQLTQSPSSLSASAGDRVSMTCRASQIISSSLNWYQQKPGKAPKLLIYAASNLQSGVPSRFSGSGSGTDFTLTISSLQPEDFATYYCQQSYSTPPELTFGGGTKVDIKRT

SEQ ID NO: 4834 - protein, 111 aa, Artificial Sequence
  anti-influenza_Chain
SYVLTQPPSASGTPGQRVTISCSGSTFNIGSNAVDWYRQLPGTAPKLLIYSNNQRPSGVPDRFSGSRSGTSASLAISGLQSEDEADYYCAAWDDILNVPVFGGGTKLTVLG

SEQ ID NO: 4835 - protein, 111 aa, Artificial Sequence
  anti-influenza_Chain
QSALTQPAAVSGSPGQSITISCTGTSSDVGGYNYVSWYQQHPGKAPKLMIYEVSNRPSGVSNRFSGSKSGNTASLTISGLQAEDEADYYCSSYTSSSTYVFGTGTKVTVLG

SEQ ID NO: 4836 - protein, 111 aa, Artificial Sequence
  anti-influenza_Chain
SYVLTQPPSVSGTPGQRVTISCSGSRSNVGDNSVYWYQHVPEMAPKLLVYKNTQRPSGVPARFSGSKSGTSASLAIIGLQSGDEADYYCVAWDDSVDGYVFGSGTKVTVLG

SEQ ID NO: 4837 - protein, 111 aa, Artificial Sequence
  anti-influenza_Chain
SVLTQPPSVSAAPGQKVTISCSGSSSNIGNDYVSWYQQLPGTAPKLLIYDNNKRPSGIPDRFSGSKSGTSATLGITGLQTGDEANYYCATWDRRPTAYVVFGGGTKLTVLG

SEQ ID NO: 4838 - protein, 111 aa, Artificial Sequence
  anti-influenza_Chain
QSALTQPRSVSGSPGQSVTISCTGTSSDVGGYNYVSWYQQHPGKAPKLMIYDVSKRPSGVPDRFSGSKSGNTASLTISGLQAEDEADYYCSSYTSSSTHVFGTGTKVTVLG

SEQ ID NO: 4839 - protein, 111 aa, Artificial Sequence
  anti-influenza_Chain
SYVLTQPPSASGTPGQRVTISCSGSSSNIGSNYVYWYQQLPGTAPKLLIYRDGQRPSGVPDRFSGSKSGTSASLAISGLRSDDEADYYCATWDDNLSGPVFGGGTKLTVLG

SEQ ID NO: 4840 - protein, 111 aa, Artificial Sequence
  anti-influenza_Chain
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTKVTVLG

SEQ ID NO: 4841 - protein, 111 aa, Artificial Sequence
  anti-influenza_Chain
TVLTQPPSVSGAPGQRVTISCTGSSSNIGAGYDVHWYQQLPGTAPKLLIYGNSNRPSGVPDRFSGSKSGTSATLGITGLQTGDEADYYCGTWDSSLSAYVFGTGTKVTVLG

SEQ ID NO: 4842 - protein, 111 aa, Artificial Sequence
  anti-influenza_Chain
GSALTQPRSVSGSPGQSVTISCTGTSSDVGGYNYVSWYQQHPGKAPKLMIYDVSKRPSGVPDRFSGSKSGNTASLTISGLQAEDEADYYCSSYTSSSTHVFGTGTKVTVLG

SEQ ID NO: 4843 - protein, 111 aa, Artificial Sequence
  anti-influenza_Chain
EIVLTQSPGTLSLSPGERATLSCRASQSVSSSYLAWYQQKPGQAPRLLIFGASTRATGIPDRFSGSGSGTDFTLTISRLEPEDFAVFYCQQYGSLPLTFGGGTKVEIKGTV

SEQ ID NO: 4844 - protein, 111 aa, Artificial Sequence
  anti-influenza_Chain
EIVLTQSPGTLSLSPGERATLSCRASQSVRSNNLAWYQHKPGQAPRLLIFGASSRATGIPDRFSGSGSGTDFTLTISRLEPEDFAVYYCQQYGSSPALTFGGGTKVEIKRT

SEQ ID NO: 4845 - protein, 111 aa, Artificial Sequence
  anti-influenza_Chain
QSLEESGGGLVKPGGSLTLTCTVSGLSLYSNEINWVRQAPGNGLEWIGAIAGSGSADYASWAKGRSTITRNTDLNTVTLKMTSLTAADTATYFCASFWDLWGPGTLVTVSS

SEQ ID NO: 4846 - protein, 111 aa, Artificial Sequence
  anti-influenza_Chain
QSVEESGGGLVKPGGSLTLTCTVSGLSLYSNEINWVRQAPGNGLEWIGAIAGSGSADYASWAKSRSTITRNTNLNTVTLKMTSLTAADTATYFCASFWDLWGPGTLVTVSS

SEQ ID NO: 4847 - protein, 111 aa, Artificial Sequence
  anti-influenza_Chain
QSLEESGGGLVKPGGSLTLTCTVSGLSLYSNEINWVRQAPGNGLEWIGAIAGSGSADYASWAKSRSTITRNTNLNTVTLKMTSLTAADTATYFCASFWDLWGPGTLVTVSS

SEQ ID NO: 4848 - protein, 111 aa, Artificial Sequence
  anti-influenza_Chain
NIVLTQSPASLAVSLGQRATISCRASESVDIYGNSFMHWYQQKPGQPPKLLIYLASKLECGVCARFNGSGCRTDFTLAIDPVEGDDGATYYCQQNYEDPWTFGGGTKLEIK

SEQ ID NO: 4849 - protein, 111 aa, Artificial Sequence
  anti-influenza_Chain
NIVLTQSPASLAVSPGQRATISCRASESIDIYGNSFMHWYQKKPGQPPKLLIYRASNLESGVPARFNGSGSRTDFTLTIDPVEGDDGATYYCQQNYEDPWTFGGGTKLEIK

SEQ ID NO: 4850 - protein, 111 aa, Artificial Sequence
  anti-influenza_Chain
EIVLTQSPATLSLYPGERATLSCRASQSVSRYLAWYQQKPGQAPRLLIYDASNRATGIPARFSGSGSGTDFTLTISSLEPEDFAVYYCQQRSNWLKITFGQGTRLEIKGTV

SEQ ID NO: 4851 - protein, 112 aa, Artificial Sequence
  anti-influenza_Chain
DIVMTQSPDSLAVSLGERATINCKSSQSVLYSSNNKNYLAWYQQKPGQPPKLLIDWASTRESGVPDRFSGSGSGTDFTLTISNLQVEDVAVYYCQQYYRSPSFGQGTKLEIK

SEQ ID NO: 4852 - protein, 112 aa, Artificial Sequence
  anti-influenza_Chain
DIVMTQTPLSLSVTPGQPASISCKSSQSLLHSDGKTYLYWYLQKPGQSPQLLIYEVSNRFSGVPDRFSGSGSGTDFTLKISRVEAEDVGVYYCMQNILLPLTFGGGTKVEIK

SEQ ID NO: 4853 - protein, 112 aa, Artificial Sequence
  anti-influenza_Chain
EIVMTQTPLSLSVTPGQPASISCRSSQSLLHSDGKTYLYWYLQKPGQPPQLLISEVFNRFSGVPDRFSGSGSGTDFTLKISRVEAEDVGVYYCMQSLQLPLTFGGGTKVEIK

SEQ ID NO: 4854 - protein, 112 aa, Artificial Sequence
  anti-influenza_Chain
DIVMTQSPLSLPVTPGEPASISCRASQSLLHSNGYNYLDWYLQKPGQSPQLLIQLGSTRASGVPDRFSGSGSGTDFTLEISRVEAEDVGVYYCMQALQLPLAFGQGTRLEIK

SEQ ID NO: 4855 - protein, 112 aa, Artificial Sequence
  anti-influenza_Chain
DIVMTQSPLSLPVSPGEPASISCRSSQSLLHGNGYNYLDWYLQKPGQSPRLLIYLGSNRASGVPDRFSGSGSGTDFTLKISRVEAEDVGVYYCMQALQTPLTFGGGTKVEIK

SEQ ID NO: 4856 - protein, 112 aa, Artificial Sequence
  anti-influenza_Chain
QSVLTQPPSVSGAPGQRVTISCTGSSSNIGAGYDVHWYQQLPGTAPKLLIYDNNNRPSGVPDRFSGSKSGASASLAITGLQAEDEAHYYCQSYDNSLSGSVFGGGTQLTVLS

SEQ ID NO: 4857 - protein, 112 aa, Artificial Sequence
  anti-influenza_Chain
QSVLTQPPSVSGAPGQRVTISCTGSSSNIGSDYDVHWYKQLPGTAPKLLIFGNSNRPSGVPDRFSGSKSGTSASLAITGLQAEDEADYYCQSYDSSLSGFHVFGSGTKVTVL

SEQ ID NO: 4858 - protein, 112 aa, Artificial Sequence
  anti-influenza_Chain
QSVLTQPPSVSAAPGQKVTISCSGSSSNIGNDYVSWYQQLPGTAPKLLIYDNNKRPSGIPDRFSGSKSGTSATLGITGLQTGDEANYYCATWDRRPTAYVVFGGGTKLTVLG

SEQ ID NO: 4859 - protein, 112 aa, Artificial Sequence
  anti-influenza_Chain
EIVLTQSPGTLSLSPGERATLSCRASQSVSSSYLAWYQQKPGQAPRLLIYGASTRATGIPDRFSGRGSGTDFTLTISSLEPEDFAVYYCQNYGSPFLFTFGPGTKVDIKRTV

SEQ ID NO: 4860 - protein, 112 aa, Artificial Sequence
  anti-influenza_Chain
DIQLTQSPLSPPVTLGQPASISCRSSQSLLYTDGFTYLSWYHQRPGQSPRRLIYKISNRDSGVPDRFSGSGSGTDFTLKISRVEAEDVGVYYCMQATHWPLTFGEGTKVEIK

SEQ ID NO: 4861 - protein, 112 aa, Artificial Sequence
  anti-influenza_Chain
DIELTQEPSASGTPGQRVTISCSGDTSNIGSNTVSWFQLLPGTAPKLLIFTDNQRPSGVPGRFSGSKSGTSASLAISGLQSEDETDYYCAAWDDSLNGWVFGGGTKLTVLGQ

SEQ ID NO: 4862 - protein, 112 aa, Artificial Sequence
  anti-influenza_Chain
DIVLTQSPSASGSPGQSVTISCTGTSSDVGGYDYVSWYQQHPGKAPKLMIYEVRKRPSGVPDRFSGSKSGNTASLTVSGLQAEDEAYYYCASYAGTYIHLFGGGTKLTVLGQ

SEQ ID NO: 4863 - protein, 112 aa, Artificial Sequence
  anti-influenza_Chain
QEQLMESGGGLVKPGGSLTLTCTVSGLSLYSNEINWVRQAPGNGLEWIGAIAGSGSADYASWAKSRSTITRNTNLNTVTLKMTSLTAADTATYFCASFWDLWGPGTLVTVSS

SEQ ID NO: 4864 - protein, 112 aa, Artificial Sequence
  anti-influenza_Chain
QQQLMESGGGLVKPGGSLTLTCTVSGLSLYSNEINWVRQAPGNGLEWIGAIAGSGSADYASWAKSRSTITRNTDLNTVTLKMTSLTAADTATYFCASFWDLWGPGTLVTVSS

SEQ ID NO: 4865 - protein, 112 aa, Artificial Sequence
  anti-influenza_Chain
QQQLVESGGGLVKPGGSLTLTCRVSGLSLFSNEINWVRQAPGNGLEWIGAIGGGGSADYASWAKSRSTITRNTNLNTVTLRMTSLTAADTAAYFCASFWDLWGPGTLVTVSS

SEQ ID NO: 4866 - protein, 112 aa, Artificial Sequence
  anti-influenza_Chain
EVQLVESGGGLVKPGGSLRLSCAASGLSLFSNEINWVRQAPGKGLEWIGAIGGGGSADYASWAKSRFTISRDNAKNSLYLQMNSLRAEDTAVYFCASFWDLWGPGTLVTVSS

SEQ ID NO: 4867 - protein, 112 aa, Artificial Sequence
  anti-influenza_Chain
DIVMTQSPLSLPVTPGEPASISCRSSQSLLRSNGYNYLDWYLQKPGQSPQLLIYLGSNRASGVPDRFSGSGSGTDFTLKISRVEAEDVGVYYCMQALQTPYTFGQGTKLEIK

SEQ ID NO: 4868 - protein, 113 aa, Artificial Sequence
  anti-influenza_Chain
DIVMTQSPDFLPVSLGERATINCKSSQRVLYSSNNKNYLAWYQLKPGQPPKLIIYWASTRESGVPDRFSGSGSGTEFTLTISSLQAEDVAVYYCQQYYSRPYTFGQGTKLEIK

SEQ ID NO: 4869 - protein, 113 aa, Artificial Sequence
  anti-influenza_Chain
DIVMTQSPDSLAVSLGERATINCKSSQSVLYSSNNKNYLAWYQQKPGQPPKLLIYWASTRESGVPDRISGSGSGADFTLTISSLQAEDVAVYYCQQYFATPRTFGQGTKVEIK

SEQ ID NO: 4870 - protein, 113 aa, Artificial Sequence
  anti-influenza_Chain
DIVMTQSPDSLAVSLGERATINCKSSQSVLYSSNNKSHLAWYQQKPGQPPKLLIYWASTRESGVPDRFSGSGSGTDFTLIISSLQAEDVAVYYCQQYYFSPLTFGGGTKVEIK

SEQ ID NO: 4871 - protein, 113 aa, Artificial Sequence
  anti-influenza_Chain
DIVMTQSPDSLAVSLGERATINCRSSQSIFHNSNNENYLAWYQQKPGQPPKLLIYWASTRESGVPDRFSGSGSGTDFTLTISSLQAEDVAVYFCQQYYNAPLTFGGGTKVEIK

SEQ ID NO: 4872 - protein, 113 aa, Artificial Sequence
  anti-influenza_Chain
EIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVEIKR

SEQ ID NO: 4873 - protein, 113 aa, Artificial Sequence
  anti-influenza_Chain
DIVLTQPPSVSVAPGQTATITCGGNYIGSKSVNWYQQRPGHAPVLVVYDDSDRPSGIPDRFSGSNSRSTATTATLTISRVEAGDEADYYCQVWETSEDLWVFGGGTKLTVLGQ

SEQ ID NO: 4874 - protein, 114 aa, Artificial Sequence
  anti-influenza_Chain
DVVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVDIKR

SEQ ID NO: 4875 - protein, 114 aa, Artificial Sequence
  anti-influenza_Chain
DIQMTQSPDSLAVSLGEKATINCKSSQSILNSSNNKNYLAWYQQKPGQPPKLLIYWASTRESGVPDRFSGSGSGTDFTLTISSLQAEDVAVYYCQQYYSSPPTFGQGTKVEIKR

SEQ ID NO: 4876 - protein, 114 aa, Artificial Sequence
  anti-influenza_Chain
EIVLTQSPATLSLYPGERATLSCRASQSVSRYLAWYQQKPGQAPRLLIYDASNRATGIPARFSGSGSGTDFTLTISSLEPEDFAVYYCCDRQQRSNWLKITFGQGTRLEIKGTV

SEQ ID NO: 4877 - protein, 114 aa, Artificial Sequence
  anti-influenza_Chain
DIVMTQSQKFVSTSVGDRVSVTCKASQNVGSNVAWYQHKPGHSPTALIYSASHRYSGVPDRFTGSESGTDFTLTISNVQSEDLAEYFCQQYYSYPYTFGGGTKLEIKRADAAPT

SEQ ID NO: 4878 - protein, 114 aa, Artificial Sequence
  anti-influenza_Chain
DIEMTQSPLSLPVTPGESASISCRSSQSLLHSNGYNYLDWYLQKPGQSPQLLIYLGSSRASGVPDRFSGSGSGTDFTLKISRVEAEDVGVYYCMQGLQTPYTFGQGTKLEIKRT

SEQ ID NO: 4879 - protein, 114 aa, Artificial Sequence
  anti-influenza_Chain
DIEMTQSPLSLPVTPGEPASISCRSSQSLLHSNGYNHLAWYLQKPGRSPHLLIYLASTRASGVPDRFSGSGSGTDFTLKISRVEAEDVGIYYCMQSLQTSITFGQGTRLEIKRT

SEQ ID NO: 4880 - protein, 115 aa, Artificial Sequence
  anti-influenza_Chain
QVQLVQSGAEVKKPGSSVRVSCKTSGGTFSSYAVTWVRQAPGQGLEWMGGIIGMFGTTNYAQKFQGRLTITADEMTSTAYMELSSLRSEDTAVYYCARGSYYYETTLDYWGRGTL

SEQ ID NO: 4881 - protein, 115 aa, Artificial Sequence
  anti-influenza_Chain
EVQLVQSGAEVKKPGSSVKVSCKTSGGTFSSYAVTWVRQAPGQGLEWMGAIIGMFGTTNYAQKFQGRVTITADELTSTAYMELSSLRSDDTAVYYCARGSYYYESSLDYWGKGTL

SEQ ID NO: 4882 - protein, 115 aa, Artificial Sequence
  anti-influenza_Chain
QVQLVQSGAEVKKPGSSVKVSCKTSGGTFSSYAVTWVRQAPGQGLEWMGGIIGMFGTTNYAQKFQGRVTITADELTSTAYMELSSLRSEDTAVYYCARGSYYYESSLDYWGRGTL

SEQ ID NO: 4883 - protein, 115 aa, Artificial Sequence
  anti-influenza_Chain
EVQLVQSGAEVKKPGASVKVSCKASGYTFTGYYVYWVRQAPGQGLEWMGWISAYNGNTNYAQKFQGRVTITADKSTSTAYMELSSLRSEDTAVYYCARSRSLDVWGQGTTVTVSS

SEQ ID NO: 4884 - protein, 115 aa, Artificial Sequence
  anti-influenza_Chain
DIVMTQSPLSLPVTPGEPASISCRSSQSLLHSNGHIYFDWYLQKPGQSPQLLIYLVSKRASGVPDRFSGSGSGTDFTLKISRVEAEDVGVYYCMQALETPFTFGPGTKVHIKRTV

SEQ ID NO: 4885 - protein, 115 aa, Artificial Sequence
  anti-influenza_Chain
QSALTQPASVSGSPGQSITISCTGTSSDVGAYNYVSWYQHHPGKAPKLMIYDVTYRPSGVSTRFSGSKSGNTASLTISGLQAEDEADYYCSSQSRSSTLVIFGGGTKLTVLGQPK

SEQ ID NO: 4886 - protein, 115 aa, Artificial Sequence
  anti-influenza_Chain
DIVLTQSPVSLAVSLGESATVNCKSSQSVLSNSKNLNYLAWYQHKPGQPPKLLIYWASTRESGVPDRFSGSGSGTDFTLTISSLQAEDVAVYYCQQHYSIPLTFGPGTKVDIKRT

SEQ ID NO: 4887 - protein, 116 aa, Artificial Sequence
  anti-influenza_Chain
DIVLTQSPLSLPVTPGEPASISCRSSQSLLDSNGYNYLDWYLQKPGQSPQLLIYLASYRAPGVPDRFSGSGSGTDFTLKISRVEAEDVGLYYCMQALQTPPMYTFGQGTKLEIKRT

SEQ ID NO: 4888 - protein, 117 aa, Artificial Sequence
  anti-influenza_Chain
LESGGGLVQPGGSLRLSCAASGITFSSYAMSWVRQAPGKGLEWVSTVNSGGGSTYYGDSVRGRFTISRDNSKSTLYLQLNSLRAEDTAIYYCAKDKGRPIFGLVTPSYYMDVWGNGT

SEQ ID NO: 4889 - protein, 117 aa, Artificial Sequence
  anti-influenza_Chain
QEQLVQSGAEVKKPGASVKVSCKASRKSFIGYYVHWVRQAPGQGLEWMGWISPDSDATKYAQKFQGSVIMTRDTSVSTVYMELSRLTSDDTALYYCLLFRGGNSLSWGQGTLVTVSS

SEQ ID NO: 4890 - protein, 117 aa, Artificial Sequence
  anti-influenza_Chain
QVQLQESGPGLVKPSETLSLTCTVSGSSISNYYWSWIRQSPGKGLEWIGFIYYGGNTKYNPSLKSRVTISQDTSKSQVSLTMSSVTAAESAVYFCARASCSGGYCILDYWGQGTLVT

SEQ ID NO: 4891 - protein, 117 aa, Artificial Sequence
  anti-influenza_Chain
EVQLVESGGGLVQPGGSLRLSCAASGFTFSIYAMSWVRQAPGKGLEWVSAISSSGDSTYYADSVKGRFTISRDNARNTLYLQMNSLRAEDTAVYYCARAYGYTFDPWGQGTLVTVSS

SEQ ID NO: 4892 - protein, 118 aa, Artificial Sequence
  anti-influenza_Chain
QVQLQESGPGLVKPSETLSLTCTVSGYSFDSGYYWGWLRQPPGKGLEWIGSIYHSRNTYYNPSLKSRVTISVDTSKNQFSLQLSSVTAADTAVYYCARGTWYSSNLRYWFDPWGKGTL

SEQ ID NO: 4893 - protein, 118 aa, Artificial Sequence
  anti-influenza_Chain
QPVLTQPPSASASLGASVTLTCTLSSAYSNYKVDWYQQRPGKGPRFVMRVGTGGIVGSKGDGIPDRFSVLGSGLNRYLTIKNIQEEDESDYHCGADHGSGSNFVSPYVFGGGTKLTVL

SEQ ID NO: 4894 - protein, 118 aa, Artificial Sequence
  anti-influenza_Chain
QVQLVQSGADVKKPGSSVTVSCKASGGSFSNYGINWVRQAPGQGLEWMGGIIPLINAPNYAPKFQGRVTITADMFSNIVSLQLTSLRTDDTAVYYCARRKMTTAIDYWGQGTLVTVSS

SEQ ID NO: 4895 - protein, 118 aa, Artificial Sequence
  anti-influenza_Chain
QVQLVQSGAEVKKPGSSVKVSCRESGGTFNGYTITWVRQAPGQGLEWMGGIIPMMGTVNYAQKLQGRVTITTDYFTKTAYMDLNNLRSEDTAMYYCVKIRYTGQQLLWGQGTLVTVSS

SEQ ID NO: 4896 - protein, 118 aa, Artificial Sequence
  anti-influenza_Chain
QVQLVQSGAEVKKPGASVKVSCKASGHTFTGYYIHWVRQAPGQGLEWMGWINPDSGATSSAQNFQGRVTMTGDTSSSTAYMELSRLSFDDTAVYYCARVLFTSPFDFWGEGTLVTVSS

SEQ ID NO: 4897 - protein, 118 aa, Artificial Sequence
  anti-influenza_Chain
QPVLSQPPSASASLGASVTLTCTLSSGFDNYQVAWYQQRPGKGPRFVMRVGNGGNVASKGDGIPDRFSVSGSGLNRYLTIKNIQEDDESDYYCGADHGSGNNFVSPYVFGGGTKLTVL

SEQ ID NO: 4898 - protein, 118 aa, Artificial Sequence
  anti-influenza_Chain
EVQLVESGAEVKKPGASVKVSCKASGYTFSRYYIHWVRQAPGQELEWMGWINPDSGDTNYAQKFRGRVTMARDTSISTVYMELNSLRYDDTAVYFCARIIWSSSGMDVWGQGTTVTVS

SEQ ID NO: 4899 - protein, 118 aa, Artificial Sequence
  anti-influenza_Chain
EVQLLESGGGVVQPGRSLRLSCAASGFTFRTYGMHWVRQAPGKGLEWVAVISHDGNLKYYGGSVKGRFTISRDNSKNALYLQMNSLRVDDTALYYCARGIGITDAFDIRGQGTMVVVS

SEQ ID NO: 4900 - protein, 118 aa, Artificial Sequence
  anti-influenza_Chain
EVQLVESGGGLVQPGGSLRLSCTASGLSVSSTYMNWVRQAPGKGLEWVSVFYSETRTYYADSVKGRFTVSRHNSNNTLYLQMNSLRVEDTAVYYCARVQRLSYGMDVWGQGTTVTVSS

SEQ ID NO: 4901 - protein, 118 aa, Artificial Sequence
  anti-influenza_Chain
EVQLVESGGGLVQPGGSLRLSCTASGLSVSSTYMNWVRQAPGKGLEWVSVFYSETRTYYADSVKGRFTVSRHNSNNTLYLQMNSLRAEDTAVYYCARVQRLSYGMDVWGQGTTVTVSS

SEQ ID NO: 4902 - protein, 118 aa, Artificial Sequence
  anti-influenza_Chain
DMQLVESGGGLVPPGGSLRLSCAASGFSVSDNYINWVRQAPGKGLDWVSVFYSADRTSYADSVKGRFTVSSHDSKNTVYLQMNSLRAEDTAVYYCARVQKSYYGMDVWGQGTTVTVSS

SEQ ID NO: 4903 - protein, 119 aa, Artificial Sequence
  anti-influenza_Chain
EVQLVESGPVLVKPTETLTVTCTVSGFSVDNDRMGVSWIRQPPGKALEWLAHIFSNDEKSYSTSLRSRLTISKDTSKRQVVLSMTDMDPVDTATYYCARAPSEYAAMDVWGQGTMVTVS

SEQ ID NO: 4904 - protein, 119 aa, Artificial Sequence
  anti-influenza_Chain
QVQVVQSGTEVKKPGSSVKVSCQTSGGRFMSYAITWVRQAPGQGLEWMGGIVPVFGTANYAQKFQGRVTITTDDSTRTAYMELSSLRSEDTAVYYCGFRYGSGYGFDSWGQGTLVTVSS

SEQ ID NO: 4905 - protein, 119 aa, Artificial Sequence
  anti-influenza_Chain
EVQLVESGAGVKKPGSSVKVSCKASGNTFSSNAISWVRQAPGQGLEWMGGILGMLRTTNYAQKFQGRVTITADEFMNTAYMELSSLTSEDTAVYYCARSSGYYPDYFHLWGQGTLVTVS

SEQ ID NO: 4906 - protein, 119 aa, Artificial Sequence
  anti-influenza_Chain
QVQLQESGPGLVKPSETLSLTCTVSGSSISNYYWSWIRQSPGKGLEWIGFIYYGGNTKYNPSLKSRVTISQDTSKSQVSLTMSSVTAAESAVYFCARASCSGGYCILDYWGQGTLVTVS

SEQ ID NO: 4907 - protein, 119 aa, Artificial Sequence
  anti-influenza_Chain
EVQLVESGGGLVQPGGSLRISCAASGFTVSSNYMSWVRQAPGKGLEWVSVIYSGGSTYYADSVKGRFSFSRDNSKNTVFLQMNSLRAEDTAVYYCARCLSRMRGYGLDVWGQGTTVTVS

SEQ ID NO: 4908 - protein, 119 aa, Artificial Sequence
  anti-influenza_Chain
QVQLQESGPGLVKPSETLSLTCTVSGASISSDYWSWIRLPPGKGLEWIGYIYNRGSTKYTPSLKSRVTISLDTAENQFSLRLRSVTAADTAIYYCARHVGGHTYGIDYWGQGTLVTVSS

SEQ ID NO: 4909 - protein, 119 aa, Artificial Sequence
  anti-influenza_Chain
QVQLQESGPGLVKPSETLSLTCTVSGASISSDYWSWIRLPPGKGLEWIGYIYNRGSTKYTPSLKSRVTISLDTAENQFSLRLRSVTAADTAVYYCARHVGGHTYGIDYWGQGTLVTVSS

SEQ ID NO: 4910 - protein, 119 aa, Artificial Sequence
  anti-influenza_Chain
QVQLQESGPRLVKPSESLSLTCTVSGGSISNSFWGWIRQPPGEGLEWIGYVYNSGNTKYNPSLKSRVTISRDTSKSQLYMKLRSVTAADTAVYYCARHDDASHGYSISWGHGTLVTVSS

SEQ ID NO: 4911 - protein, 119 aa, Artificial Sequence
  anti-influenza_Chain
EVHLQQSGPELVKPGASVKMSCEASGYTFTDYYVAWVKQSPGESFEWIGRVNPYSGGTSYNQKFKGKATLIVDKSSSTAYMELSSLTSEDSAVYYCARWDYGVYEGYIDYWGQGSALTV

SEQ ID NO: 4912 - protein, 120 aa, Artificial Sequence
  anti-influenza_Chain
QVQLVQPGAEVKKPGSSVKVSCKASGGIFSPYAISWVRQAPGQGLEWMGGIIAIFGTTNYAQKFQGRVTITADKSTTTAYLELNSLRFEDTAVYYCARGGRYYVDYFDYWGQGTLVSVSS

SEQ ID NO: 4913 - protein, 120 aa, Artificial Sequence
  anti-influenza_Chain
QVQLQESGPDLVKPGASVKMSCKASGYSFTYYHMHWVKQTHGKSLEWIGRIPYNGGTNYSQRFKGKAVFTVDMSSSTAYMELRSLTSEDSAVYYCARDANYEGDWYFDVWGQGTTVTVSS

SEQ ID NO: 4914 - protein, 120 aa, Artificial Sequence
  anti-influenza_Chain
QVQLVQSGAEVKEPGSAMKVSCKASGGTFSSDAFCWVRQAPGRGLEWMGGIIPVFQTANYGPNFQGRVTISADVYTTTLYLELSGLTSEDTAVYFCARSGDGYNYYFPLWGQGTLVTVSS

SEQ ID NO: 4915 - protein, 120 aa, Artificial Sequence
  anti-influenza_Chain
QITLRESGPTLVKPTQTLTLTCTFSGFSLSTNGVNVGWIRQPPGKALEWLALIYWDDDKRYSPSLKRRLTITKDTSKNQVVLTLTNMDPVDTATYYCAHRPDFYGDFEYWGPGTLVTVSS

SEQ ID NO: 4916 - protein, 120 aa, Artificial Sequence
  anti-influenza_Chain
QVQLVQSGSEVKKPGTSVKVSCTASGSVFTNYGISWVRQAPGQGLEWMGGIIPLFGAAKYAQKFQGRVTITADESTKTVYMELSRLTSKDTAIYFCAKAPRVYEYYFDQWGQGTPVTVSS

SEQ ID NO: 4917 - protein, 120 aa, Artificial Sequence
  anti-influenza_Chain
QVQLVQSGADLKKPGASVKVSCKASGYTFTDYYIHWVRQAPGQGLEWMGWINPESGDTKYAQKFQGRVTMTRDTSITTAYMELGRLRSDDTAVYYCARDVSTTWSWFAPWGQGTLVTVSS

SEQ ID NO: 4918 - protein, 120 aa, Artificial Sequence
  anti-influenza_Chain
QVQLQESGPGLVKPSETLSLTCSVSGGSINYYYWSWIRQPPGKGLECIGYISDTGRTYYNPSLRSRVTISVDTSKNQFSLNLTSMTAADTAVYYCARDPTGSRQKNAFDMWGQGTMVTVS

SEQ ID NO: 4919 - protein, 120 aa, Artificial Sequence
  anti-influenza_Chain
QVQLQESGPRVVRPSETLSLTCTVSGGSISSYNWIWIRQPPGKGLEWIGHIYDYGRTFYNSSLQSRPTISVDASKNQLSLRLTSVTASDTAVYYCARPLGILHYYAMDLWGQGTTVTVSS

SEQ ID NO: 4920 - protein, 120 aa, Artificial Sequence
  anti-influenza_Chain
QVQLQESGPGLVKPSETLSLTCSVSGGSISSDFWSWIRQPPGKGLEWIGYVYNRGSTKYSPSLKSRVTISADMSKNQFSLNMSSVTAADTAVYYCAKNGRSSTSWGIDVWGKGTTVTVSS

SEQ ID NO: 4921 - protein, 120 aa, Artificial Sequence
  anti-influenza_Chain
QVQLQESGPGLVKPSETLSLTCTVSGGSISAYHWSWIRQPPGKGLEWIGHIFDSGSTYYNPSLKSRVTISLDASKNQLSLRLTSVTASDTAIYYCARPLGSRYYYGMDVWGQGTTVTVSS

SEQ ID NO: 4922 - protein, 120 aa, Artificial Sequence
  anti-influenza_Chain
EVQLVESGGGLVQPGGSLRISCAASGFTVSSNYMSWVRQAPGKGLEWVSVIYSGGSTYYADSVKGRFSFSRDNSKNTVFLQMNSLRAEDTAVYYCARCLSRMRGYGLDVWGQGTTVTVSS

SEQ ID NO: 4923 - protein, 120 aa, Artificial Sequence
  anti-influenza_Chain
QVQLQESGPGLVKPSETLSLTCTVSGSSISNYYWSWIRQSPGKGLEWIGFIYYGGNTKYNPSLKSRVTISQDTSKSQVSLTMSSVTAAESAVYFCARASCSGGYCILDYWGQGTLVTVSS

SEQ ID NO: 4924 - protein, 120 aa, Artificial Sequence
  anti-influenza_Chain
QVQLQQSGAEVKKPGSSVKVSCKVSGVIFSGSAISWVRQAPGQGLEWMGGISPLFGTTNYAQKFQGRVTITADQSTNTTYMEVNSLRYEDTAVYFCARGPKYYSEYMDVWGKGTTVTVSS

SEQ ID NO: 4925 - protein, 120 aa, Artificial Sequence
  anti-influenza_Chain
QVQLVQSGAEVKKPGSSVKVSCKASGGTFSSYAISWVRQAPGQGLEWMGGIMGMFGTTNYAQKFQGRVTITADEFTSAAYMELRSLRSEDTAVYYCARSSGYYPEYFQDWGQGTLVTVSS

SEQ ID NO: 4926 - protein, 120 aa, Artificial Sequence
  anti-influenza_Chain
QMQLVQSGAEVKKPGSSVKVSCKASGGTFSSYAITWVRQAPGQGLEWMGGIIGMFGSTNYAQNFQGRVTITADESTSTAYMELSSLRSEDTAVYYCARSTGYYPAYLHHWGQGTLVTVSS

SEQ ID NO: 4927 - protein, 120 aa, Artificial Sequence
  anti-influenza_Chain
EVQLVESGAEVKKPGSSVKVSCKASGGTFSSYGISWVRQAPGQGLEWMGDIIGMFGSTNYAQNFQGRLTITADESTSTAYMELSSLRSEDTAVYYCARSSGYYPAYLPHWGQGTLVTVSS

SEQ ID NO: 4928 - protein, 120 aa, Artificial Sequence
  anti-influenza_Chain
EVQLVESGAEVKKPGSSVKVSCKASGGTFSSYAISWVRQAPGQGLEWMGGIIGMFGTANYAQKFQGRVTITADEFTSTAYMELSSLRSEDTAVYYCARGNYYYESSLDYWGQGTLVTVSS

SEQ ID NO: 4929 - protein, 120 aa, Artificial Sequence
  anti-influenza_Chain
QVQLVQSGAEVKKPGSSVKVSCKASGGPFRNFAINWVRQAPGQGLEWMGGIIAVFGTTKYAHKFQGRVTITADDSTNTAYMELGSLKSEDTAVYYCARGPHYYSSYMDVWGEGTTVTVSS

SEQ ID NO: 4930 - protein, 120 aa, Artificial Sequence
  anti-influenza_Chain
EVALVETGAEVKKPGSSVKVPCKSSGSPFRSNAVSWVRQAPGQGLEWVGGILGVFGSPSYAQKFQGRVTITADESTNTVHMELRGLRSEDTAVYYCARGPTYYYSYMDVWGKGTTVTVSS

SEQ ID NO: 4931 - protein, 120 aa, Artificial Sequence
  anti-influenza_Chain
QMQLVQSGAEVKKPGSSVKVSCKASGGTFSSYAISWVRQAPGQGLEWMGGIFGMFGTANYAQKFQGRVTITADEFTSAAYMELSSLGSEDTAMYYCARSSGYYPQYFQDWGQGTLVTVSS

SEQ ID NO: 4932 - protein, 120 aa, Artificial Sequence
  anti-influenza_Chain
QVQLVQSGAEVKKPGSSVKVSCKASGVTFSYYAMSWVRQAPGQGLEWMGGISPMFGTTTYAQKFQGRVTITADDSTSTAYMEVRSLRSEDTAVYYCARSSNYYDSVYDYWGQGTLVTVSS

SEQ ID NO: 4933 - protein, 120 aa, Artificial Sequence
  anti-influenza_Chain
EVQLVETGAEVKKPGSSVKVPCKSSGSPFRSNAVSWVRQAPGQGLEWVGGILGVFGSPSYAQKFQGRVTITADESTNTVHMELRGLRSEDTAVYYCARGPTYYYSYMDVWGKGTTVTVSS

SEQ ID NO: 4934 - protein, 120 aa, Artificial Sequence
  anti-influenza_Chain
QVHLVQSGAEVRKPGASVKVSCKVSGYTLNELSIHWLRQAPGRGLEWMGSFDPEDGETIYAQKFQGRVTMTGDTSTDTAYLELTSLRSEDTALYYCARGWGAVTSPFDFWGQGTLVTVSS

SEQ ID NO: 4935 - protein, 120 aa, Artificial Sequence
  anti-influenza_Chain
EVQLVQSGAEVKKPGSSMKVSCKASGSIFSNYGISWVRQAPGQGLEWMGGIIPIFGAANYAQKFQGRVTITADESTSTVYMEVRSLRSEDTAVYYCARRQQLYKGYYHHWGQGTLVTVSS

SEQ ID NO: 4936 - protein, 120 aa, Artificial Sequence
  anti-influenza_Chain
QVQLVQSGAGVKKPGSSMKVSCKASGSIFSNYGISWVRQAPGQGLEWMGGIIPIFGAANYAQKFQGRVTITADESTSTVYMEVRSLRSEDTAVYYCARRQQLYKGYYHHWGQGTLVTVSS

SEQ ID NO: 4937 - protein, 120 aa, Artificial Sequence
  anti-influenza_Chain
QVQLQESGPGLVKPSETLSLTCTVSGGLIGTGSYYWGWIRQTPGKGMEWIGSISYSGSTYYHPSLKSRVTISDDTSKNQLFLKLRSVTAADTAQYYCARYNWGIRYFDFWGRGTLVTVSS

SEQ ID NO: 4938 - protein, 120 aa, Artificial Sequence
  anti-influenza_Chain
QVQLVQSGAEVRKPGSSVKVSCKVSGGIIRKYAINWVRQAPGQGLEWMGGIIAIFNTANYAQKFQGRVTITADESTSTVYMELSSLRSEDTALYYCARGMNYYSDYFDYWGQGSLVTVSP

SEQ ID NO: 4939 - protein, 120 aa, Artificial Sequence
  anti-influenza_Chain
QVQLVQSGGGVVQPGRSLRLSCAASGFTFRSHAMHWVRQAPGKGPEWVALISYDEVNKFYADSVKGRFTISRDVSKNTVFLQMNSLSADDTAVYYCARGHSGSYRLFDFWGQGTLVTVSS

SEQ ID NO: 4940 - protein, 120 aa, Artificial Sequence
  anti-influenza_Chain
QVQLVESGGGLVQPGGSLRLSCAASGFIFGDFAIHWVRQASGKGLEWVARIRSGLNRFETAYAASVEGRLTISRDDSKSMAYLQMNNVKAEDTAVYLCTYLVGAVGFQHWGQGTLVTVSS

SEQ ID NO: 4941 - protein, 120 aa, Artificial Sequence
  anti-influenza_Chain
QVQLVESGGGVVQPGRSLRLSCAASGFTFSSYGIYWVRQAPGKGLEWVAFISYDEINKFYADSVKGRFTISRDNSKNTVFLQMNSLRDEDTAVYYCAKPLRGSYRYFDLWGRGTVVTVSS

SEQ ID NO: 4942 - protein, 121 aa, Artificial Sequence
  anti-influenza_Chain
QVQLQESGPDLVKPGASVMISCKASGYSFTYYYMHWVKQSHGKTLEWIGRIYPYNGDTNYNRRFKDKAILTVDESSSTAYMELRSLTSEDSAVYFCARDANYEGDWYFDVWGQGTTVTVSS

SEQ ID NO: 4943 - protein, 121 aa, Artificial Sequence
  anti-influenza_Chain
QVQLVQSGGGVVQPGRSLRLSCAASGFTFSSYAMHWVRQAPGKGLEWVAIISYDGNDQYYTDSVKGRFTISRDSSKVYLQMHRLRPEDTAVYYCAKEFETSGYFHGSFDYWGQGILVTVSS

SEQ ID NO: 4944 - protein, 121 aa, Artificial Sequence
  anti-influenza_Chain
QVQVVQSGAEVKKPGSSVRVSCQASGGTFMNYAIIWVRRAPGQGLEWMGGIIPVFPTPNYAQMFQGRVTISTDESRSTSFLELTNLRYEDTAVYYCARRIYHGGNSGFDFWGQGTLVTVSS

SEQ ID NO: 4945 - protein, 121 aa, Artificial Sequence
  anti-influenza_Chain
QVQLQESGPGLLKPSDTLALTCTVSGGSITSDYWSWIRQPPGRGLDWIGFFYNGGSTKYNPSLKSRVTISADTSKNQLSLKLTSVTAADTGVYYCARHDAKFSGSYYVASWGQGTRVTVSS

SEQ ID NO: 4946 - protein, 121 aa, Artificial Sequence
  anti-influenza_Chain
QVQLQESGPGLLKPSDTLALTCTVSGGSITSDYWSWIRQPPGRGLDWIGFFYNGGSTKYNPSLKSRVTISADTSKNQLSLKLTSVTAADTGVYYCARHDVKFSGSYYVASWGQGTRVTVSS

SEQ ID NO: 4947 - protein, 121 aa, Artificial Sequence
  anti-influenza_Chain
QVQLQESGPGLVKPSETLSVTCKVSGDSISSYSWSWIRQPPGKGLEWVGYLYYSGSTKYNPSLKSRTTISVDTSTNQLSLKLSFVTAADTAVYFCARTGSESTTGYGMDVWGQGTTVTVSS

SEQ ID NO: 4948 - protein, 121 aa, Artificial Sequence [sequence omitted]

SEQ ID NO: 4949 - protein, 121 aa, Artificial Sequence
  anti-influenza_Chain
QVQLVQSGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSS

SEQ ID NO: 4950 - protein, 121 aa, Artificial Sequence
  anti-influenza_Chain
EVQLVETGAEVKKPGASVKVSCKASGYTFTSYYMHWVRQAPGQGLEWMGWINPNSGGTNYAQKFQGRVTMTRDTSISTAYMELSRLRSDDTAVYYCAREGKWGPQAAFDIWGQGTMVTVSS

SEQ ID NO: 4951 - protein, 121 aa, Artificial Sequence
  anti-influenza_Chain
EVQLVESGAEVKKPGSSVKVSCKASGGTFSFYSMSWVRQAPGQGLEWMGGIIPMFGTTNYAQKFQGRVTITAVESTSTAYMEVSSLRSEDTAVYYCARGDKGIYYYYMDVWGKGTTVTVSS

SEQ ID NO: 4952 - protein, 121 aa, Artificial Sequence
  anti-influenza_Chain
EVQLVETGAEVKKPGSSVKVSCKASGGTFRTHAISWVRQAPGQGLEWMGGIIAIFGTANYAQKFQGRITITADESTSTAYMELSSLRSEDTAVYFCARGSGYHISTPFDNWGQGTLVTVSS

SEQ ID NO: 4953 - protein, 121 aa, Artificial Sequence
  anti-influenza_Chain
EVQLVQSGAEVKKPGSSVKVSCKASGGIFRSNSISWVRQAPGQGLEWMGGIFALFGTTDYAQKFQGRVTITADESSTTVYLELSSLTSEDTAVYYCARGSGYTTRNYFDYWGQGTLVTVSS

SEQ ID NO: 4954 - protein, 121 aa, Artificial Sequence
  anti-influenza_Chain
EVQLVESGAEVKKPGSSVKVSCKASGGIFNSYAISWVRQAPGQGLEWMGGIIAIFHTPKYAQKFQGRVTITADESTNTAYMELRSLKSEDTALYYCARGSTYDFSSGLDYWGQGTLVTVSS

SEQ ID NO: 4955 - protein, 121 aa, Artificial Sequence
  anti-influenza_Chain
QVQLVQSGAEVKKPGSSVKVSCKSSGGNFNNYAVSWVRQAPGQGLEWMGGISPIFGSTNHAQKFQGRVTISADIFTNTAYMELSSLRSDDTAIYYCARGRGYYFYHAMDVWGQGSTVTVSS

SEQ ID NO: 4956 - protein, 121 aa, Artificial Sequence
  anti-influenza_Chain
QVQLVQSGAEVKKPGSSVKVSCKASGGTFNNYAINWVRQAPGQGLEWMGGISPIFGSVNYAQKLQGRVTITADVFTSTAYMELSSLRSEDTAVYYCAKGSGYYYYYGLDVWGLGTTVTVSS

SEQ ID NO: 4957 - protein, 121 aa, Artificial Sequence
  anti-influenza_Chain
QVQLVESGGGVVQPGRSLRLSCAASGFTFTNYAMHWVRQAPGKGLEWVAVISFDEDNKSYADYVKGRFTISRDNSNNRLYLQMNSLRAEDTAVYYCARGPEGVWGRSIDSWGQGTLVTVSS

SEQ ID NO: 4958 - protein, 121 aa, Artificial Sequence
  anti-influenza_Chain
QVQLVQSGGDLVQPGGSLRLSCAASGFTFSRYSMNWVRQAPGMGLEWVAYISDTSRTIYYADSVKGRFTISRDNAKNSLYLQMKSLRDEDTAVYYCARDPDTPFVRAFDSWGQGTLVTVSS

SEQ ID NO: 4959 - protein, 121 aa, Artificial Sequence
  anti-influenza_Chain
QVQLVESGGGLVQPGGSLRLSCVASGFTFSRFSMNWVRQAPGMGLEWVSYISDTGRTIYYADSVKGRFTISRDNDKNTLYLQMKSLRDEDSAFYYCARDPDTPFVRAFDSWGQGVLVTVSS

SEQ ID NO: 4960 - protein, 121 aa, Artificial Sequence
  anti-influenza_Chain
QVQLQESGPDLVKPGASVKMSCKASGYSFTYYHMHWVKQTHGKSLEWIGRIYPYNGGTNYSQRFKGKAVFTVDMSSSTAYMELRSLTSEDSAVYYCARDANYEGDWYFDVWGQGTTVTVSS

SEQ ID NO: 4961 - protein, 122 aa, Artificial Sequence
  anti-influenza_Chain
QGQLVQSGAEVKKSGSSVKVSCKTSGGTFNSHAISWVRQAPGQGLEWIGGIIPMFGTTNYAQKLKGRIAITADQLPTTAYLELSSLRSEDTAVYYCARGQRYYYDRDGMDVWGQGTMVTVSS

SEQ ID NO: 4962 - protein, 122 aa, Artificial Sequence
  anti-influenza_Chain
QVHLVQSGAEVKKPGSSVRLSCSASGGPFSGFAISWLRQAPGQGLEWLGGISAVFGTATYAQKFQGRVTITADQFTSTSHMDLSRLTYDDTAVYYCARSGGYLPQNNWIDPWGQGTLVIVSS

SEQ ID NO: 4963 - protein, 122 aa, Artificial Sequence
  anti-influenza_Chain
QVQLVQSGAEVKKAGSSVKVSCQSSGVTFSMYAVSWVRQAPGQGLEWMGGIIPLFGTTTYAQKFEGRLTITADTSTNMAYLELRSLRSEDTAVYFCARAGTTVTRFNWFDPWGQGTLVTVSS

SEQ ID NO: 4964 - protein, 122 aa, Artificial Sequence
  anti-influenza_Chain
QVQLVQSGAEVKKPGSSLKVSCKASGVTFSMYTISWVRQAPGQGLEWMGGIIPLFGTANYEQKFQGRVTITADTSTNTAYMELSSLRSEDTAVYYCARAGTTLTRFNWFDPWGQGTLVTVSS

SEQ ID NO: 4965 - protein, 122 aa, Artificial Sequence
  anti-influenza_Chain
MADNMTTTQIEWRMKKMAIGSSTHSSSVLMKDIQSQFEQLKLRWESYPNLVKSTDYHQKRETIRLATEELYLLSKRIDDSILFHKTVIANSSIIADMIVSLSLLETLYEMKDVVEVYSRQCL

SEQ ID NO: 4966 - protein, 122 aa, Artificial Sequence
  anti-influenza_Chain
EVQLVQSGGGLVQPGGSLRLACVVSGFTVTSNYITWVRQAPGKGLEWVSVIYSHGRAYYSASVNGRFTISRHTSKNTVYLEMNSLRPEDTAVYYCAGGGLVGGYDEYFFDYWGQGTLATVSS

SEQ ID NO: 4967 - protein, 122 aa, Artificial Sequence
  anti-influenza_Chain
QVQLVQSGAEVKKPGASVKVSCKASGYTFTGYYMHWVRQAPGQGLEWMGWINPNSGDTNYAQKFQGRVTMTRDTSITTAYMELSSLRSDDTAVYYCARDSPYSSSWSFFDYWGQGPLVTVSS

SEQ ID NO: 4968 - protein, 122 aa, Artificial Sequence
  anti-influenza_Chain
EVQLVESGGGLVQPGGSLRLSCAASGFIFRNYWMSWVRQAPGKGLEWVANIKQDGREKYYVDSLRGRVNISRDNAENSLYLHMNSLRVEDTAVYFCARARMVVVTGDGFDVWGHGTMVTVSS

SEQ ID NO: 4969 - protein, 122 aa, Artificial Sequence
  anti-influenza_Chain
EVQLLESGGGLVQPGGSLRLSCAASGFAFSSYGMSWVRQAPGKGLEWVSAFSGSGTSTYYADSVKGRFTISRDKSKNTLYLQMNSLRAEDTAIYYCAKPPGPYIVVAGLFENWGRGTLVTVS

SEQ ID NO: 4970 - protein, 122 aa, Artificial Sequence
  anti-influenza_Chain
EVQLVESGGGVVQPGRSLRLSCAASGFSFSNYAMHWVRQAPGKGLEWVALISFDGSDKYYADSVKGRFTMSRDNSKNTLYLQMNSLRAEDTAVYYCARDEPYCGGDCFAFDVWGQGTMVTVS

SEQ ID NO: 4971 - protein, 122 aa, Artificial Sequence
  anti-influenza_Chain
QVQLQQSGPGLVKPSQTLSLTCTVSGGPVSGGGYSWNWIRQRPGQGLEWVGFMFHSGSPRYNPTLKSRITISVDTSKNLVSLKLSSVTAADTAVYFCARVGQMDKYYAMDVWGQGTTVTVSS

SEQ ID NO: 4972 - protein, 122 aa, Artificial Sequence
  anti-influenza_Chain
QVQLVQSGGGLVKPGGSLRLSCAASGFTFSSYSMNWVRQAPGKGLEWVSSISSSSSYIYYVDSVKGRFTISRDNAKNSLYLQMNSLRAEDTAVYYCARGGGSYGAYEGFDYWGQGTLVTVSS

SEQ ID NO: 4973 - protein, 122 aa, Artificial Sequence
  anti-influenza_Chain
QVQLVQSGGGVVQPGRSLRLSCAASGFNFSSYGMHWVRQAPGKGLEWLSVIWSGGSNKYYADSVKGRFTISRDDSKNTVYLQMNSLRDEDTAVYYCARAHTALTRFRWLDPWGQGILVTVSS

SEQ ID NO: 4974 - protein, 122 aa, Artificial Sequence
  anti-influenza_Chain
QVQLVQSGGGVVQRGRSLRLSCAASGFTFRTYGMHWVRQAPGKGLECVALISYDGTNKYYADSVKGRFTISRDNSKDTLYLQMNSLRAEDTGVYYCASLDYDFSYYYHRDVWGPGTTVTVSS

SEQ ID NO: 4975 - protein, 122 aa, Artificial Sequence
  anti-influenza_Chain
QVQLVESGGGLVQPGGSLRLSCAASGFTFSDYWMVWVRQAPGKGLVWVSRISSDGSTTSYADSVKGPFTISRDNAKNTLYLQMNSLRAEDTAVYYCARVATPYYYESGFDYWGQGALVTVSS

SEQ ID NO: 4976 - protein, 123 aa, Artificial Sequence
  anti-influenza_Chain
QFQLVQSGPEVKKPGTSVKVSCKASGYTSTTYGISWVRQVPGQGLEWMGWINPYNGNPHYGQKFQGRVTLTRDTSTNTAYLEILSLRSDDTAVYYCARDGWGQQLVPYYFDYWGQGTLVTVSS

SEQ ID NO: 4977 - protein, 123 aa, Artificial Sequence
  anti-influenza_Chain
QVQLAQSGAEVKRPGSSVKVSCTASGGIFRKNAISWVRQAPGQGLEWMGGIIAVFNTANYAQKFQGRVKITADESGNTAYMELSSLRSDDTAVYYCASHPKYFYGSGSYPDFWGQGTLVTVSS

SEQ ID NO: 4978 - protein, 123 aa, Artificial Sequence
  anti-influenza_Chain
QVQLQESGPGLVKPSETLSLTCTVSRGSIGHYFWSWIRQPPGKGLEWIGYISYSGSTKYNPSLRSRVTISVDTSKNQFSLNLNSVTATDTALYYCAREDYDILTGAGPGMEVWGQGTTVTVSS

SEQ ID NO: 4979 - protein, 123 aa, Artificial Sequence
  anti-influenza_Chain
QVQLQESGPGLVKPSETLSLTCTVSGASINSHYWSWIRQPPGKGLEWIGYVYYSGSTTYNPSLKSRVTLSVDTSKNQFSLNLSSVTAADTAFYYCARHPYDVLTGSGDWFDPWGQGTLVTVSS

SEQ ID NO: 4980 - protein, 123 aa, Artificial Sequence
  anti-influenza_Chain
QVQLVQSGAEVKRPGSSVKVSCTASGGIFRKNAISWVRQAPGQGLEWMGGIIAVFNTANYAQKFQNRVKITADESGNTAYMELSSLTSDDTAVYYCASHPKYFYGSGSYPDFWGQGTLVTVSS

SEQ ID NO: 4981 - protein, 123 aa, Artificial Sequence
  anti-influenza_Chain
EVQLVESGAEVKKPGSSVKVSCKASGGTFRSYAVSWVRQAPGQGLEWMGGIIAIFGTTNYAQKFQDRVTITADDLPSTAYMELTSLRSEDTAVYFCVRGRGYYLGGDYGSLDSWGQGTLVTVS

SEQ ID NO: 4982 - protein, 123 aa, Artificial Sequence
  anti-influenza_Chain
EVQLVESGGGLVQPGRSLRLSCVGSGFNFDGYAMQWVRQVPGKGLEWVSGISWHSDSTGYADSVRGRFTISRDNAKNSLYLQMDSLRPEDTAFYYCGKSIGHVGGSYRHPIDYWGQGTLVTVS

SEQ ID NO: 4983 - protein, 123 aa, Artificial Sequence
  anti-influenza_Chain
QVQLQASGPGLVKPSETLSLTCTVSGDSITSGAYYWTWIRQHPGKGLEWIGYIYYSGNTYYNPSLKSRVTISLDTSKNQFSLKVNSVTAADTAVYYCARAASTSVLGYGMDVWGQGTTVTVSS

SEQ ID NO: 4984 - protein, 123 aa, Artificial Sequence
  anti-influenza_Chain
QVQLVQSGAEVKKPGSSVRVSCKASGSIFRNYAMSWVRQAPGQGLEWMGGIIAIFGTPKYAQKFQGRVTITADESTSTVYMELSGLRSEDTAMYYCARIPHYNFGSGSYFDYWGQGTLVTVSS

SEQ ID NO: 4985 - protein, 123 aa, Artificial Sequence
  anti-influenza_Chain
QLQLQESGPRLVKPSETLSLTCSVSGVSISSSNYYWGWIRQPPGKGLEWIGTIYHSGSTYYNPSLKSRLIISVDTSKNQFYLQLTSLTAADSAVYYCATGGGFGWSQTYFGYWGQGTLVTASS

SEQ ID NO: 4986 - protein, 123 aa, Artificial Sequence
  anti-influenza_Chain
EVQLQQSGPELVKPGASVKMSCKASGYTFTSFIMYWVKQKPGQGLEWLGYIDPYNDGTKYNEKFEGKATLTSDKSSSTAYMELSSLTSEDSAVYYCAKRGNYGNGFAYWGQGTLVTVSAAKTS

SEQ ID NO: 4987 - protein, 123 aa, Artificial Sequence
  anti-influenza_Chain
QVQLLESGGDVVQPGTSLRLSCAASGFSLWTSGMHWVRQAPGKGLEWVAVMSYDETKKYYADSVRGRFSISRDNSRNTLYLQMNSLRVEDTAVYFCAKPRLDYLDYFHAADSWGQGTLVSVSS

SEQ ID NO: 4988 - protein, 123 aa, Artificial Sequence
  anti-influenza_Chain
QVQLVESGAEVRKPGESLRISCKAHGDSFTSYWIGWVRQLPGKGLEWMAVIYPRDSETKFSPAFHGQVSISVDKSTSTVHLQWNSLKASDTAVYYCARSPGYSGYLYGWFDPWGQGTPVTVSS

SEQ ID NO: 4989 - protein, 123 aa, Artificial Sequence
  anti-influenza_Chain
QVQLVESGPGLVKPSETLSLTCTVSGDSVINSAYYWDWIRQPPGKGLEWVGSVYYSGITYYNPSLKSRVTISVDTSKNQFSLRLSYVTAADTALYYCARRGGGWQYYYGMDVWGQGTTVTVSS

SEQ ID NO: 4990 - protein, 123 aa, Artificial Sequence
  anti-influenza_Chain
QVQLVQSGAEVKKPGASVKVSCKASGYIFTGYYIHWVRQAPGQGLEWMGRIDPNGSGTTYAQKFQGRVTLTMDTSITTAYMELSRLRFDDTAIYYCARWDWNFDLYLGWFDPWGQGTPVTVAS

SEQ ID NO: 4991 - protein, 123 aa, Artificial Sequence
  anti-influenza_Chain
EVQLVQSGAEVKKPGASVKVSCKASGYIFTGYYIHWVRQAPGQGLEWMGRIDPNGAGTTYAQKFQGRVTLTMDTSITTAYMELSRLRFDDTAIYYCARWDWNFDLYLGWFDPWGQGTPVTVAS

SEQ ID NO: 4992 - protein, 123 aa, Artificial Sequence
  anti-influenza_Chain
QVQLVQSGAEVKKPGASVKVSCKASGYTFNAHHMHWVRQAPGQGLGWMGWIDPNNDGTIYAQKFQGRVTLTMDTSIHTAYMELSGLRYDDTAIYYCVRWAWNFDFFLGWFDPWGQGTLVTVAS

SEQ ID NO: 4993 - protein, 123 aa, Artificial Sequence
  anti-influenza_Chain
EVQLVQSGAEVKKPGESLKISCKVSGYSFTSQWIGWVRQMPGKGLEWIGMMYPGDSDTIYSPSFQGQVTISADNSISTAYLQWSSLKASDTAIYYCASGPGYSGYHYGWFDTWGQGTLVTVSS

SEQ ID NO: 4994 - protein, 123 aa, Artificial Sequence
  anti-influenza_Chain
EVQLVQSGAEVKKPGESLKISCKVSGYSFTSQWIGWVRQMPGKGLEWIGMMYPGDADAIYSPSFQGQVTISADNSISTAYLQWSSLKASDTAIYYCASGPGYSGYHYGWFDTWGQGTLVTVSS

SEQ ID NO: 4995 - protein, 123 aa, Artificial Sequence
  anti-influenza_Chain
EVQLVQSGAEVKKPGESLKISCKVSGYSFTSQWIGWVRQMPGKGLEWIGMMYPGESETIYSPSFQGQVTISADNSISTAYLQWSSLKASDTAIYYCASGPGYSGYHYGWFDTWGQGTLVTVSS

SEQ ID NO: 4996 - protein, 123 aa, Artificial Sequence
  anti-influenza_Chain
EVQLVQSGAEVKKPGESLKISCKVSGYSFTSQWIGWVRQMPGKGLEWIGMMYPGDADTIYSPSFQGQVTISADNSISTAYLQWSSLKASDTAIYYCASGPGYSGYHYGWFDTWGQGTLVTVSS

SEQ ID NO: 4997 - protein, 123 aa, Artificial Sequence
  anti-influenza_Chain
EVQLVQSGAEVKKPGESLKISCKVSGYSFTSQWIGWVRQMPGKGLEWIGMMYPGSSDTIYSPSFQGQVTISADNSISTAYLQWSSLKASDTAIYYCASGPGYSGYHYGWFDTWGQGTLVTVSS

SEQ ID NO: 4998 - protein, 123 aa, Artificial Sequence
  anti-influenza_Chain
EVQLVQSGAEVKKPGESLKISCKVSGYSFTSQWIGWVRQMPGKGLEWIGMMYPGDSDAIYSPSFQGQVTISADNSISTAYLQWSSLKASDTAIYYCASGPGYSGYHYGWFDTWGQGTLVTVSS

SEQ ID NO: 4999 - protein, 123 aa, Artificial Sequence
  anti-influenza_Chain
EVQLVQSGAEVKKPGESLKISCKVSGYSFTSQWIGWVRQMPGKGLEWIGMMYPGDTDTIYSPSFQGQVTISADNSISTAYLQWSSLKASDTAIYYCASGPGYSGYHYGWFDTWGQGTLVTVSS

SEQ ID NO: 5000 - protein, 123 aa, Artificial Sequence
  anti-influenza_Chain
EVQLVQSGAEVKKPGESLKISCKVSGYSFTSQWIGWVRQMPGKGLEWIGMMYPGESDTIYSPSFQGQVTISADNSISTAYLQWSSLKASDTAIYYCASGPGYSGYHYGWFDTWGQGTLVTVSS

SEQ ID NO: 5001 - protein, 124 aa, Artificial Sequence
  anti-influenza_Chain
QVQLVQSGAEVKKPGSSVKVSCKASGGIFISQAISWVRQAPGQGLEWMGGIIPMFGATNYAQKFQGRVTITADKSTNTVYMELSSLTSEDTAVYYCARLGSGSYHNGPNWFDPWGQGTLVTVSS

SEQ ID NO: 5002 - protein, 124 aa, Artificial Sequence
  anti-influenza_Chain
QVQLQESGPGLVKPSETLSLNCAVSGGSISNYYWSWIRQPPGKGLEWIGYISYNGRPKYNPSLTSRVTISVDTSKDQFSLELRSVTAADTALYYCARETRFGELLSPYDAFEIWGQGTMVTVSS

SEQ ID NO: 5003 - protein, 124 aa, Artificial Sequence
  anti-influenza_Chain
QVQLQESGPGLVKPSETLSLTCTVSGGSVSSETYYWSWIRQPPGKGLEWIGYIYYIGNTDYRPSLKSRVTISLDTSKNQFSLKLSSVTAADTAVYYCARGAYYDSSGYPAFYIWGQGTMVTVSS

SEQ ID NO: 5004 - protein, 124 aa, Artificial Sequence
  anti-influenza_Chain
QVQLQESGPGLVKPSETLSLTCAVSGVSISNIDFYWGWIRQPPGKGLEWIGNIYYTGITFYNPSLSSRVAISIDTSKNQFSLTLTSVTAADTAMYYCARHYGDSEAINDAFDIWGQGTMLTVSS

SEQ ID NO: 5005 - protein, 124 aa, Artificial Sequence
  anti-influenza_Chain
QVQLVESGAEVKKFGASVKVSCKASGYTLIDYYMHWVRVAPGQGLEWMGWINPINGGTNYAQKFQGRVTMTRDTSINTAYMDLSSLRSDDTAMYYCTRGRPIGRNWEPRDKDYWGQGTPVTVSS

SEQ ID NO: 5006 - protein, 124 aa, Artificial Sequence
  anti-influenza_Chain
QVQLVQSGAEVKKPGSSVTVSCKTSGHTFISYAISWLRQAPGQGLEWMGGIVPIFGTVNYTQKFQGRLTITADESTSTAYMDLSRLTFEDTAIYFCAREAGYHSSFSGVYFDYWGQGTLLTVSS

SEQ ID NO: 5007 - protein, 124 aa, Artificial Sequence
  anti-influenza_Chain
EVQLQQSGPELVKPGASVKISCKASGYTFTDYNMHWVKQSLGKSLEWIGYIYPNNGGTGYNQKFESKATLTVDNSSSTAYMELRTLTSEDSAVYYCVRSGAYYFNYLVPYFDYWGQGTTLTVSS

SEQ ID NO: 5008 - protein, 124 aa, Artificial Sequence
  anti-influenza_Chain
EVQLQQSGPELVKPGASVKISCKASGYTFTGYNMHWVKQSHGKSLEWIGKIYPNNGVTGYNQEFRSKATLTVDNSSSTAYMELRSLTSEDSAIYFCVRSGAYYVNYLVPYFDYWGQGTTLTVSS

SEQ ID NO: 5009 - protein, 125 aa, Artificial Sequence
  anti-influenza_Chain
QVQLVQSGAEVKKPGSSVKVSCKASGVTSSNYPITWVRQAPGQGLEWMGGVLPLFGVTNYAQKFQGRVTISADKSTNTAYMELSSLRSEDTAVYYCARGKRPGYCSGGVCSSDYWGQGTLVTVSS

SEQ ID NO: 5010 - protein, 125 aa, Artificial Sequence
  anti-influenza_Chain
QVQLQESGPGLVKPSQTLSLTCTVSGGSISSGTYYWSWIRHHPGKGLEWIGYIYHSGSAYYNPSLESRVTMSVDTSKNQFSLKLSSVTAADTAIYYCARAENLLSPYLAEGFDPWGQGTLVTVSS

SEQ ID NO: 5011 - protein, 125 aa, Artificial Sequence
  anti-influenza_Chain
EVQLVQSGAEVKKPGESLKISCQASGYSFTSRWIGWVRQMPGKGLEWVGFIYPSDSDVRYSPSFRGQVTISADKSISTAYLQWSSLKASDTAMYFCARLGGNKDYGDYLWYFDLWGRGALVTVSS

SEQ ID NO: 5012 - protein, 125 aa, Artificial Sequence
  anti-influenza_Chain
QVQLVESGGGVVQPGRSLRLSCAASGFTFSSYGMHWVRQAPGKGLEWVAVIWYDGDNKYYGDSVKGRFTISRDNSKNTLFLQMNSLRAEDTAVYYCAKDTADHGDYVDLGFFDAWGQGTLVTVSS

SEQ ID NO: 5013 - protein, 125 aa, Artificial Sequence
  anti-influenza_Chain
EVQLVQSGAELKMPGESLKISCKASGYTFTNYWIGWVRQTPGKGLEWMGIIFPPDSQTSYSPSFQGQVTFSVDNSISVAYIQWSSLKASDTAIYYCARSGIFDWSAPLVEAFDIWGQGTVVTVSS

SEQ ID NO: 5014 - protein, 125 aa, Artificial Sequence
  anti-influenza_Chain
EVQLVQSGAEVKKPGESLKISCKGSGYSFSDYWIGWVRQMPGEGLEWMGIIYPASSEIRYSPSFQGLVTISADKSINTASLQWSSLKASDTAIYYCARHASCSARSCYWGPVDYWGQGTLVTVSS

SEQ ID NO: 5015 - protein, 125 aa, Artificial Sequence
  anti-influenza_Chain
QVQLVESGGGVVQPGRSLRLSCAASEITFITYAMHWVRQAPGKGLEWVALISDDGSNKFYADSVKGRFTISRDNSKNTLYLQMNSLRAEDTAAYYCAREGVYFDSGTYRGYFDYWGQETLVTVSS

SEQ ID NO: 5016 - protein, 125 aa, Artificial Sequence
  anti-influenza_Chain
QVQLQESGPGLVKPSQTLSLTCTVSGGSISSGNYYWNWVRQHPGKGLEWIGYIYYRGSTFYNPSLKSRVTISIDTSKNQFSLRLSSVTAADTAVYYCAKDTRSSLDNYQYGMDVWGQGTTVTVSS

SEQ ID NO: 5017 - protein, 125 aa, Artificial Sequence
  anti-influenza_Chain
EVQLLESGGGLVQPGGSLRLSCAASGFSFSTYAMSWVRQAPGKGLEWVSGISGSGESTYYADSVKGRFTVSRDNSKNTLYLQMNSLRAEDTAVYYCAKQGDHIAWLLRGINFDYWGQGVLVTVSS

SEQ ID NO: 5018 - protein, 125 aa, Artificial Sequence
  anti-influenza_Chain
QVQLVESGGGVVQPGRSLRLSCAASGFAFHNRAMHWVRQAPGKGLEWVALIYFDGSKQYYADSVKGRFTISRDNSKNTVFLQMNSLRPEDTAVYYCAVPGPIFGIFPPWSYFDHWGQGILVTVSS

SEQ ID NO: 5019 - protein, 125 aa, Artificial Sequence
  anti-influenza_Chain
EVQLVESGGGVVQPGRSLRLSCAASGFAFHNRAMHWVRQAPGKGLEWVALIYFDGSKQYYADSVKGRFTISRDNSKNTVFLQMNSLRPEDTAVYYCAVPGPIFGIFPPWSYFDHWGQGILVTVSS

SEQ ID NO: 5020 - protein, 125 aa, Artificial Sequence
  anti-influenza_Chain
EVQLVQSGGGVVQPGKSLRLSCAASGLTFSSYAVHWVRQAPGKGLEWVTLISYDGANQYYADSVKGRFTISRDNSKNTVYLQMNSLRPEDTAVYYCAVPGPVFGIFPPWSYFDNWGQGILVTVSS

SEQ ID NO: 5021 - protein, 125 aa, Artificial Sequence
  anti-influenza_Chain
QVQLVESGGGVVQPGKSLRLSCAASGLTFSSYAVHWVRQAPGKGLEWVTLISYDGANQYYADSVKGRFTISRDNSKNTVYLQMNSLRPEDTAVYYCAVPGPVFGIFPPWSYFDNWGQGILVTVSS

SEQ ID NO: 5022 - protein, 125 aa, Artificial Sequence
  anti-influenza_Chain
QVQLVESGGGVVQPGKSPRLSCAASGPTFSSYAVHWVRQAPGKGLEWVTLISYDGANQYYADSVKGRFTISRDNSKNTVYLQMNSLRPEDTAVYYCAVPGPVFGIFPPWSYFDNWGQGILVTVSS

SEQ ID NO: 5023 - protein, 125 aa, Artificial Sequence
  anti-influenza_Chain
EVQLVESGGGVVQPGKSLRLSCAASGLTFSSYAVHWVRQAPGKGLEWVTLISYDGANQYYADSVKGRFTISRDNSKNTVYLQMNSLRPEDTAVYYCAVPGPVFGIFPPWSYFDNWGQGILVTVSS

SEQ ID NO: 5024 - protein, 125 aa, Artificial Sequence
  anti-influenza_Chain
QVQLVQSGAELKRPGASVKVSCKTSGYSFNNYGINWVRQAPGQGLEWMGWISAYTGNTHYAKNFEGRVTLTTDTSTSTAYMEVRSLRSDDSAVYFCARAMIQGVVTLYLRPGDYWGQGTLVTVSS

SEQ ID NO: 5025 - protein, 125 aa, Artificial Sequence
  anti-influenza_Chain
QVQLVQSGAEVKQPGASVKVSCKASGYTFNAYYIHWVRQAPGQGLEWMGWINPNFGGTHYARKFQGRVTMTRDASINTAYMELDRLISDDTAVYYCVRWRAAAVIMDQFYKMDVWGQGTLVTVSS

SEQ ID NO: 5026 - protein, 125 aa, Artificial Sequence
  anti-influenza_Chain
QVQLVQSGPELKKPGSSVKLSCMATGGTFINYAFSWVRQAPGQGLEWLGGIIPVYGTSNHVEKLQGRVTITADASTNTAYMELSGLRFDDTAVYFCAASTATSGTYYAMRPFDFWGQGTLVSVSS

SEQ ID NO: 5027 - protein, 126 aa, Artificial Sequence
  anti-influenza_Chain
EVQLVESGGGVVQPGGSLRLSCIASAFNLGIFGMHWVRQAPGKGLEWVAFIRYDGGKTFYADSVKGRFTISRDNSKNTLYLQMNSLRTEDTALYYCARDATADYYGPGSYPNWLDPWGQGTLVTVS

SEQ ID NO: 5028 - protein, 126 aa, Artificial Sequence
  anti-influenza_Chain
EVQLVESGPALVKPTQTLTLTCSFSGFSLSTSGMSVSWIRQPPGKALEWLALIDWDDDTYYITYSSSLKTRLTISKDTSKSQVVLTMTNMDPVDTATYYCARTLRVSGDYVRDFDLWGRGTLVTVS

SEQ ID NO: 5029 - protein, 126 aa, Artificial Sequence
  anti-influenza_Chain
QVQLQESGPGLVKPSETLSLTCTVSGGSINSYYWNWIRQPPGKGLEWIGYIYHSGSTNYNPSLKSRVTISVDTSKNQFSLQLSSVTAADTAVYYCARLRTDYGDPDSVYYYGMDVWGQGTTVTVSS

SEQ ID NO: 5030 - protein, 126 aa, Artificial Sequence
  anti-influenza_Chain
QVHLVQSGAEVRKPGDSVKVSCKTSGYTFSTYPVAWVRQVPGQGLEWMGWISTYNGNTNFAQNFQGRVTLTTDTTTNTAYMEVRSLKFDDTAVYYCARVEGSYRDFWNNQNRFDPWGQGTLVTVSS

SEQ ID NO: 5031 - protein, 126 aa, Artificial Sequence
  anti-influenza_Chain
EVQLVESGAEVKKPGASVKVSCKASGYTFTSFDINWVRQAPGQGLEWMGWMTPTSGKTGYAQKFQGRITMTRNTSINTAYMELSSLRSEDTAVYFCARGPERRTTIFDVILDWFDPWGQGTLVTVS

SEQ ID NO: 5032 - protein, 126 aa, Artificial Sequence
  anti-influenza_Chain
QVQLVQSGAEVKKPGSSVKVSCKASGGFFSSYAISWVRQAPGQGLEWMGGVIPIFRTANYAQNFQGRVTITADEFTSYMELSSLRSDDTAVYYCARLNYHDSGTYYNAPRGWFDPWGQGTLVTVSS

SEQ ID NO: 5033 - protein, 126 aa, Artificial Sequence
  anti-influenza_Chain
QVQLVQSGAEVKKPGSSVKVSCKASGGAFSNYAISWVRQAPGQGLEWMGGIIPIFGTTNYAQKFQGRVTITADKFTTIAYMELRSLRSEDTAVYYCARHGGVYYYGSASSGWFDPWGQGTLVTVSS

SEQ ID NO: 5034 - protein, 126 aa, Artificial Sequence
  anti-influenza_Chain
QVQLLESGGGVVRPGRSLRLACAGSGFTFSAYAMHWVRQAPGKGLEWVAHTSYDGRDSYYVDSVKGRFTISRDDSKNTLYLQMNSLRPEDTAVYYCAKVGPYTGYDDYNYYGMDVWGHGTTVTVSS

SEQ ID NO: 5035 - protein, 126 aa, Artificial Sequence
  anti-influenza_Chain
QVQLVESGGGVVQPGGSLRLSCAASGFNFDEYVMYWVRQSPGKGLEWVSLIGADGRGTYNSDSVKGRFTISRDNRKNSLYLQMNSLRSDDTALYYCAKVERSFYDGSGYGDALEIWGQGTMVTVSS

SEQ ID NO: 5036 - protein, 127 aa, Artificial Sequence
  anti-influenza_Chain
EVQLLESGGGLVHPGGSLRLSCAASGFTFSNYAMSWVRQAPGKGLEWVSSINSGGGATYYADSVKGRFTISRDNSKNTLSLQMNSLRAEDTAVYYCAKEGGNTIFGLVTMAYYFDSWGQGTLVTVSS

SEQ ID NO: 5037 - protein, 127 aa, Artificial Sequence
  anti-influenza_Chain
QPQLQESGPGLVRPSETLSLTCTVSGDSVTRGGFYWGWIRQPPGKGLEWIGSIYYNYNIYHSPSLKSRVSLSVDTSKNQVSLKLASVTAADTAVYYCARHYPYYDLPTGFYSQFDFWGQGTPVTVSS

SEQ ID NO: 5038 - protein, 127 aa, Artificial Sequence
  anti-influenza_Chain
WWQLVQSGAEVKKPGSSVKVSCKASGGTFSSYDISWVRQAPGQGLEWMGGIIPIYGTANYAQKFQGRVTITADESTSTAYMELSSLRSEDTAVYYCARAGGDSSGYYGALGRFFQHWGQGTLVTVSS

SEQ ID NO: 5039 - protein, 127 aa, Artificial Sequence
  anti-influenza_Chain
EVQLVQSGGAVVQPGRSLRLSCAASGFTFSIYAMHWVRQTPGKGLEWVALISYDGNNKYYADSVKGRFTISRDNYKNTLYLQMKGLRAEDTALYYCARRITEKGYYNDSGRPNWFDPWGQGTLVTVS

SEQ ID NO: 5040 - protein, 127 aa, Artificial Sequence
  anti-influenza_Chain
QVQLQQSGPRLVKPSQTLSLTCAISGDSVSGDSGTWNWIRQSPSRGLEWLGRTYYRSKWYNDYAESVKSRIVIKADTSKNEFSLQLNSVTPEDTAIYYCARAGVKIFGLIVGALDNWGRGTLVTVSS

SEQ ID NO: 5041 - protein, 127 aa, Artificial Sequence
  anti-influenza_Chain
QVQLQQWGAGLLKPSETLSLTCTVSGGSLTDYSWNWIRQPPGKGLEWIGDTLHNGYTNYNPSLRGRVSISIDTSKNQVSLRLTSVTAADTALYYCARGSGGYGGFDYFGKLRTWDFWGQGTLVTVSS

SEQ ID NO: 5042 - protein, 127 aa, Artificial Sequence
  anti-influenza_Chain
QVQLVQSGAEVRKPGESLRISCRGSGYNFPKYWIGWVRQMPGKGLEWMGMIYPGDSDVRYNPSFQGQVTISADESINTAYLQWSSLRTSDTARYYCARHLGQQLVSNTYYYYGMDVWGQGTTVTVSS

SEQ ID NO: 5043 - protein, 128 aa, Artificial Sequence
  anti-influenza_Chain
QIQLQESGPGLVKPSQTLSLTCAISGDSVSSNNAVWNWIRQSPSRGLEWLGRTYYRSKWYNDYAESVKSRITVNPDTSKNQFSLHLKSVTPEDTAVFYCVRSGHITVFGVNVDAFDMWGQGTMVTVSS

SEQ ID NO: 5044 - protein, 128 aa, Artificial Sequence
  anti-influenza_Chain
QVQLQESGPGLVKPSQTLSLTCAISGDSVSSNNAVWNWIRQSPSRGLEWLGRTYYRSKWYNDYAESVKSRITVNPDTSKNQFSLHLKSVTPEDTAVFYCVRSGHITVFGVNVDAFDMWGQGTMVTVSS

SEQ ID NO: 5045 - protein, 128 aa, Artificial Sequence
  anti-influenza_Chain
QVQLQQSGPGLVKPSQTLSLTCAISGDRVSSNSAVWNWIRQSPSRGLEWLGRTYYRSKWYYDYAESVKSRIVIDPDTSKNQVSLQLNSVTPEDSAIYYCARGGHITVFGLNIDAYDIWGQGAKVTVSS

SEQ ID NO: 5046 - protein, 128 aa, Artificial Sequence
  anti-influenza_Chain
QVQLQQSGPGLVKPSQTLSLTCAISGDRVSSNSAVWNWIRQSPSRGLEWLGRTYYRSKWYYDYAESVKSRIVIDPDTSKNQVSLQLNSVTPEDSAIYYCARGGHITVFGLNIDAYDIWGQGAMVTVSS

SEQ ID NO: 5047 - protein, 128 aa, Artificial Sequence
  anti-influenza_Chain
QVQLQQSGPGLVKPSQTLSLTCAISGDRVSSNSAVWNWIRQSPSRGLEWLGRTYYRSKWYYDYAESVKSRIVIDPDTSKNQVSLQLNSVTPEDSAIYYCARGGHITEFGLNIDAYDIWGQGAMVTVSS

SEQ ID NO: 5048 - protein, 128 aa, Artificial Sequence
  anti-influenza_Chain
QVQLQQSGPGLVKPSQTLSLTCVISGDTVSSNRATWNWMRQSPLRGLEWLGRTYYRSKWYNDYAVSVKSRVVINPDTSKNQVSLQLNTVTPDDSGVYFCARGGHITVFGVNIDAFDIWGLGTKVTVSS

SEQ ID NO: 5049 - protein, 128 aa, Artificial Sequence
  anti-influenza_Chain
QVELQQSGPGLVKPSQTLSLTCAISGDSVSSNSATWNWIRQSPSRGLEWLGRTYYRSKWYNDYADFLKRRITINPDTSNNEVSLRLTSVTPDDTALYYCARGGHITVFGVNIDAFDVWGQGTMATVSS

SEQ ID NO: 5050 - protein, 128 aa, Artificial Sequence
  anti-influenza_Chain
QVQLQQSGPGLVKPSQTLSLTCAISGDSVSSNSATWNWIRQSPSRGLEWLGRTYYRSKWYNDYADFLKRRITINPDTSNNEVSLRLTSVTPDDTALYYCARGGHITVFGVNIDAFDVWGQGTMVTVSS

SEQ ID NO: 5051 - protein, 128 aa, Artificial Sequence
  anti-influenza_Chain
QVQLQQSGPGLVKPSQTLSLTCAISGDSVSSYNAVWNWIRQSPSRGLEWLGRTYYRSGWYNDYAESVKSRITINPDTSKNQFSLQLNSVTPEDTAVYYCARSGHITVFGVNVDAFDMWGQGTMVTVSS

SEQ ID NO: 5052 - protein, 128 aa, Artificial Sequence
  anti-influenza_Chain
QVQLQQSGPGLVKPSQTLSLTCAISGDSVSSNNAVWNWIRQSPSRGLEWLGRTYYRSKWYNDYAESVKSRITINPDTSKNQFSLQLNSVTPEDTAVYYCARSGHITVFGVNVDAFDMWGQGTTVTVSS

SEQ ID NO: 5053 - protein, 128 aa, Artificial Sequence
  anti-influenza_Chain
RGQLVQSGGGVVQPGRSLRLSCAASGFVFNVFGIHWVRQAPGKGLEWLATISYDGLNKYYADSVKGRITISRDNSKNTLYLQMNSLRAEDTAVYYCVRDSEESTYYGDYMWVYNWFDLWGQGTLVTVS

SEQ ID NO: 5054 - protein, 128 aa, Artificial Sequence
  anti-influenza_Chain
QVQLQQWGSGLLKPSETLSLTCAVYGGSFRDDYWTWIRQPPGKGLEWIGEINHSGRTNYNPSLKSRVTISVDTSLKQFSLKVISVTAADTAVYYCARGTSHVSRYFDWLPPTNWFDPWGQGTQVTVSS

SEQ ID NO: 5055 - protein, 128 aa, Artificial Sequence
  anti-influenza_Chain
QVQLQQWGAGLLKPSETLSLSCAVFGGSFSDYYWTWIRQPPGKGLEWIGEIKHSGRTNYNPSLESRVTISVDTSKNQFSLKLSSVTAADTAIYYCARGTDPDTEGYCRSGSCSAFDFWGQGTLVTVSS

SEQ ID NO: 5056 - protein, 128 aa, Artificial Sequence
  anti-influenza_Chain
QVQLQQWGAGLLKPSETLSLTCGVYGGSLSDYYWSWIRQPPGKGLEWIGEINHSGGTNYNPSLKRRVTISVDTSKKQFSLKMNSVTAADTAVYYCARGTDPDTEVYCRAGNCAAFDFWGQGTLVTVSS

SEQ ID NO: 5057 - protein, 128 aa, Artificial Sequence
  anti-influenza_Chain
QVQLQESGPGLVKPSQTLSLTCTVSGDSISSVDHYWSWIRQHPVKGLEWIGFMYYSASTYYNPSLKSRVTISTDTSKNQFSLRLSSVTAADTAVYYCARGTCAGDCSLHYYYYGLDVWGQGRTVTVSS

SEQ ID NO: 5058 - protein, 128 aa, Artificial Sequence
  anti-influenza_Chain
EVALVESGAEVKKPGSSVKVSCKASGHIFSGYAISWVRQAPGQGLEWMGGIIPIFGTTNYAQKFQGRVTITADQSTSTAYMDLSNLRSEDTAVYYCARVKDGYCTLTSCPVGWYFDLWGRGTLVTVSS

SEQ ID NO: 5059 - protein, 128 aa, Artificial Sequence
  anti-influenza_Chain
EVQLVESGAEVKKPGSSVKVSCKASGHIFSGYAISWVRQAPGQGLEWMGGIIPIFGTTNYAQKFQGRVTITADQSTSTAYMDLSNLRSEDTAVYYCARVKDGYCTLTSCPVGWYFDLWGRGTLVTVSS

SEQ ID NO: 5060 - protein, 128 aa, Artificial Sequence
  anti-influenza_Chain
QVQLVQSGAEVRKPGASVKVSCKASGYTFTRHGISWVRQAPGQGLEWMGWISAYTGDTDYAQKFQGRVTMTTDTSTNTAYMELRSLRSDDAAVYYCARLRLQGEVVVPPSQSNWFDPWGQGTLVTVSS

SEQ ID NO: 5061 - protein, 128 aa, Artificial Sequence
  anti-influenza_Chain
QVQLVESGPGLMKPSETLSLTCTVSGGSVSNYYWSWIRQPPGKGLEWIGYVFYSGSSNYNPSLNNPSLKSRVTISIDTSNNQFSLKLSSVTAADTAVYYCARGRVNSGYDWGPNFDSWGQGALVTVSS

SEQ ID NO: 5062 - protein, 128 aa, Artificial Sequence
  anti-influenza_Chain
QVQLVQSGAEVKKPGSSVKVSCKASGGTFSYYAISWVRQAPGQGLEWMGGIIPIVGTAHYTQKFQGRVTITADESTSTAYMELSSLRSEDTAVYFCARAADESVESLTIKAFRTNYHWGQGTLVTVSS

SEQ ID NO: 5063 - protein, 129 aa, Artificial Sequence
  anti-influenza_Chain
EVQLVESGGGAVQPGESLKLPCAASGFTFSNYGMHWVRQAPGKGLEWVAVISYDGSNKYYADSVKGRFTISRDNSKDTLYLQMNSLRAEDTALFYCAKERPLRLLRYFDWLSGGANDYWGQGTLVTVSS

SEQ ID NO: 5064 - protein, 129 aa, Artificial Sequence
  anti-influenza_Chain
EVQLVESGGGAVQPGESLKLSCAASGFTFSNYGMHWVRQAPGKGLEWVAVISYDGSNKYYADSVKGRFTISRDNSKDTLYLQMNSLRAEDTALFYCAKERPLRLLRYFDWLSGGANDYWGQGTLVTVSS

SEQ ID NO: 5065 - protein, 129 aa, Artificial Sequence
  anti-influenza_Chain
QVQLVESGGGVVQPGRSLRLSCAVSGFTFSSYAMHWVRQAPGKGLEWVAVISYDGSNQYYADSVKGRFTISRDNSKNTLYLQMNSLRAEDTALYYCAKDPRLRHLLYFPFTSMIYFDYWGQGTLVTVSS

SEQ ID NO: 5066 - protein, 129 aa, Artificial Sequence
  anti-influenza_Chain
QVQLVQSGGGVVQPGRSLRLSCVASGFTFSTYAMHWVRQAPGRGLEWVAVISYDANYKYYADSVKGRFSISRDNSQNTLHLEMNTLRTEDTALYYCAKDSQLRSLLYFEWLSQGYFEPWGQGTLVTVTS

SEQ ID NO: 5067 - protein, 129 aa, Artificial Sequence
  anti-influenza_Chain
QVQLVQSGGGVVQPGRSLRLSCVASGFTFSTYAMHWVRQAPGRGLEWVAVISYDGNYKYYADSVKGRFSISRDNSNSTLHLEMNTLRTEDTALYYCAKDSQLRSLLYFEWLSQGYFDPWGQGTLVTVTS

SEQ ID NO: 5068 - protein, 129 aa, Artificial Sequence
  anti-influenza_Chain
QVQLVQSGAEVKKPGSSVTVSCKASGGTFSNYGISWVRQAPGQGLDWMGGIIPLFGTANYAQKFQGRVTITADESTSSSNMELSSLRSEDTAVYYCARDVHNYDFLTGYPLHLYGMDVWGQGTTVTVSS

SEQ ID NO: 5069 - protein, 129 aa, Artificial Sequence
  anti-influenza_Chain
QVQLQESGPGLVKPSETLSLICAVSGASISSSYWSWIRQPPGKGLEWIGYIYYSGVTKYNPSLKSRVTLSVDTSKNHFSLKLSYVTAADTAVYYCARNLPDIAVVTAVQDATPVWFDPWGPGTLVSVSS

SEQ ID NO: 5070 - protein, 129 aa, Artificial Sequence
  anti-influenza_Chain
EVQLVESGGGLVQPGRSLRLSCAASGFTFSDFWMSWVRQAPGKGLEWVANIDQDGNERFYADSVKGRFTISRDNAKNSLYLQMTSLRADDTAVYYCARDGREGYFYGSGSFYNLKGLNWGQGTLLTVSS

SEQ ID NO: 5071 - protein, 129 aa, Artificial Sequence
  anti-influenza_Chain
EVLMVESGGGLVQPGGSVRLSCVASGFSFSSHWMTWVRQAPGKGLEWVANIEDDGGDKYYVDSVKGRFIISRDNAKNSVYLQMNSLRAEDTAVYFCARGSGSSDRSDYDPHYYYYLDVWGKGATVTVSS

SEQ ID NO: 5072 - protein, 129 aa, Artificial Sequence
  anti-influenza_Chain
EVQLVESGGDLVQPGRSLKLSCTGSGFTFGDYGVTWVRQAPGKGLEWVGFIRTRPWGGTADTAASVKGRFTISRDDSKSLAYLQMNSLKTEDTAVYYCCRDAPPNVEVASMTNWYFDLWGRGTLVTVSS

SEQ ID NO: 5073 - protein, 129 aa, Artificial Sequence
  anti-influenza_Chain
EVQLVQSGSEVKKPGESLKISCKGSGYSFSNYWIGWVRHMPGKGLEWMGIIYPGDSDTRYSPSFQGQVTMSADKSSSTVYLQWSSLKASDTAIYYCARRGGHSFGYGSGGDTHSEFDSWGQGTLVTVSS

SEQ ID NO: 5074 - protein, 129 aa, Artificial Sequence
  anti-influenza_Chain
QVQLLETGGGLVKPGQSLKLSCAASGFTFTSYAMHWVRQPPGKGLEWVAVVSYDGNYKYYADSVQGRFTISRDNSKNTLYLQMNSLRAEDTAVYYCAKDSRLRSLLYFEWLSQGYFNPWGQGTTLTVSS

SEQ ID NO: 5075 - protein, 129 aa, Artificial Sequence
  anti-influenza_Chain
QVQLVESGAEVKKPGASVKLSCTASGYNFAAYYIHWVRQAPGQGLEWMGWSNPNTGGANYAQDFQGRVTMTAVTSTSTAYMELSRLTSDDTALYFCARVPRDRLLTLYYESSTYGFDYWGQGTLVTVSS

SEQ ID NO: 5076 - protein, 129 aa, Artificial Sequence
  anti-influenza_Chain
QVQLVESGGGLVQPGGSLRLSCTVSGFTFNSYAMNWVRQAPGKGLEWVSGIRGSGENTYYAETVKGRFTISRDNSKNTLYLEMNSLRAEDTAVYYCARKWGRMTVFGVATDQLYYFDYWGQGTLVTVSS

SEQ ID NO: 5077 - protein, 129 aa, Artificial Sequence
  anti-influenza_Chain
QVQLVESGPGLVKPSQTLSLTCTVSGGSISNGGYHWSWIRQHPGKGLEWIGNIYYRGSTFYDPSLKSRVTISVDTSKSQFSLKLTSVTAADTAVYYCARMPLANYDLLTGLYIGAFDLWGQGTMVTVSS

SEQ ID NO: 5078 - protein, 129 aa, Artificial Sequence
  anti-influenza_Chain
QVQLVESGAEVKKPGASVRVSCKGSGYTFTAYHMHWVRQAPGQGFEWVGWINPNSGATYYTSTFEGRVTMTRDTSITTAYMELSSLRSDDTAVYYCATDIVVERDASLGGFNSYGMDVWGQGTTVTVSS

SEQ ID NO: 5079 - protein, 130 aa, Artificial Sequence
  anti-influenza_Chain
QVQLQQWGAGLLKPSETLSLTCAVYGGSFSVSGYYWSWIRQPPGRGLEWIGEISHGGSTNYNPSLKSRVTISVDTTKNQFSLRLSSVTAADTAVYYCARGTDPDTEVYCRVGNCAAFDYWGQGSLVTVSS

SEQ ID NO: 5080 - protein, 130 aa, Artificial Sequence
  anti-influenza_Chain
QVQLLESGPGLVKPSQTLLLTCTVSGASISTGGNYWSWIRQHPGKDLEWIGYIFYSGTTKYNPSVDNPSLKSRVTMSVDTSENQFSLKLSSVTAADTAVYFCARGSPNSGYDWGPHFDYWGQGTLVTVSS

SEQ ID NO: 5081 - protein, 130 aa, Artificial Sequence
  anti-influenza_Chain
EVQLVESGGHLVQPGRSLRLSCAASGFTFEDYAMNWVRQAPGKGLEWVSVISWDSGRIGYADSVKGRFTISRDNAKNSSYLQMNSLRPEDTALYYCVRDMLAYYSDNSGKKYNVYGMDVWGQGTTVTVSS

SEQ ID NO: 5082 - protein, 130 aa, Artificial Sequence
  anti-influenza_Chain
EVQLVESGGGLVQPGRSLRLSCAVSGFIFEDYAINWVRQAPGKGLEWVSIISWDSGRIGYADSVRGRFTISRDNAKNSSFLQMNSLRPEDTAVYYCVKDMLAYYYDGSGIRYNLYGMDVWGQGTTVTVSS

SEQ ID NO: 5083 - protein, 130 aa, Artificial Sequence
  anti-influenza_Chain
EVQLVESGGGLVQPGRSLRLSCAVSGFIFEDYAINWVRQAPGKCLEWVSIISWDSGRIGYADSVRGRFTISRDNAKNSSFLQMNSLRPEDTAVYYCVKDMLAYYYDGSGIRYNLYGMDVWGQGTTVTVSS

SEQ ID NO: 5084 - protein, 132 aa, Artificial Sequence
  anti-influenza_Chain
QITLKESGPTLVKPTQTLTLTCVFSGFSLSITGVRVGWIRQPPGKALEWLALISWDDEKHYSPSLQSRLTITKDTSKNQVVLTMTNLDPVDTATYYCARSTDRGHVLRYFGWMLPGDAFDVWGQGTMVTVSS

SEQ ID NO: 5085 - protein, 132 aa, Artificial Sequence
  anti-influenza_Chain
QVQLQESGPGLVKPSETLSLTCTVSSGPMSDYYWSWIRQPPGKGLEWIGHVSVSHGGRTKSNPSVMSRVTISVETSKNQFSLKLTSVTAADTAVYYCARLNYYDRSGYHSPDGPSNNWFDPWGQGTLVTVSS

SEQ ID NO: 5086 - protein, 132 aa, Artificial Sequence
  anti-influenza_Chain
QVQLVQSGAEVKKPGASVKVSCKTSGYTFTAYTIHWVRQAPGQRLEWMGWINAGNGHTKYSQRFKGRVTITRDTSARTTYMELRSLTSEDTALYFCARGPETYYYDKTNWLNSHPDEYFQHWGHGTQVTVSS

SEQ ID NO: 5087 - protein, 133 aa, Artificial Sequence
  anti-influenza_Chain
QVQLVQSGSEVKKPGASVKVSCKASGYTFTNYDINWIRQAPGQGLEWMGWINPNSGTTGSAQRFQGRVTITVDTSITTVYMELSSLRSDDTAIYYCARGRELLRLQHFLTDSQSERRDCFDPWGQGTLVTVSS

SEQ ID NO: 5088 - protein, 134 aa, Artificial Sequence
  anti-influenza_Chain
EVQLVESGGGLVKPGGSLRLSCAASGLSFLNAWMSWVRQAPGKGLEWVGRIKSNTDGGTTDYAAPVKGRFTISRDDSKNTLYLQMSSLKTEDTAVYYCTTDGPYSDDFRSGYAARYRYFGMDVWGQGTTVTVSS

SEQ ID NO: 5089 - protein, 134 aa, Artificial Sequence
  anti-influenza_Chain
EVQLVESGGGLVKPGGSLRLSCAASGFSFLNAWMSWVRQAPGKGLEWVGRIKSNTDGGTTDYAAPVKGRFTISRDDSKNTLYLQMSSLKTEDTAVYYCTTDGPYSDDFRSGYAARYRYFGMDVWGQGTTVTVSS

SEQ ID NO: 5090 - protein, 134 aa, Artificial Sequence
  anti-influenza_Chain
EVQLVESGGGLVKPGGSLRLSCAASGLTFLNAWMSWVRQAPGKGLEWVGRIKSNTDGGTTDYAAPVKGRFTISRDDSKNTLYLQMSSLKTEDTAVYYCTTDGPYSDDFRSGYAARYRYFGMDVWGQGTTVTVSS

SEQ ID NO: 5091 - protein, 134 aa, Artificial Sequence
  anti-influenza_Chain
EVQLVESGGGLVKPGGSLRLSCAASGFSFSNAWMSWVRQAPGKGLEWVGRIKSNTDGGTTDYAAPVKGRFTISRDDSKNTLYLQMSSLKTEDTAVYYCTTDGPYSDDFRSGYAARYRYFGMDVWGQGTTVTVSS

SEQ ID NO: 5092 - protein, 134 aa, Artificial Sequence
  anti-influenza_Chain
EVQLVESGGGLVKPGGSLRLSCAASGLTFSNAWMSWVRQAPGKGLEWVGRIKSNTDGGTTDYAAPVKGRFTISRDDSKNTLYLQMSSLKTEDTAVYYCTTDGPYSDDFRSGYAARYRYFGMDVWGQGTTVTVSS

SEQ ID NO: 5093 - protein, 134 aa, Artificial Sequence
  anti-influenza_Chain
EVQLVESGGGLVKPGGSLRLSCAASGFTFSNAWMSWVRQAPGKGLEWVGRIKSNTDGGTTDYAAPVKGRFTISRDDSKNTLYLQMSSLKTEDTAVYYCTTDGPYSDDFRSGYAARYRYFGMDVWGQGTTVTVSS

SEQ ID NO: 5094 - protein, 134 aa, Artificial Sequence
  anti-influenza_Chain
EVQLVVSGGGLVKPGGSLRLSCAASGLSFLNAWMSWVRQAPGKGLEWVGRIKSNTDGGTTDYAAPVKGRFSISRDDSKNMLFLHMSSLRTEDTAVYYCATDGPYSDDFRSGYAARYRYFGMDVWGQGTTVTVSS

SEQ ID NO: 5095 - protein, 134 aa, Artificial Sequence
  anti-influenza_Chain
EVQLVVSGGGLVKPGGSLRLSCAASGLSFLNAWMSWVRQAPGKCLEWVGRIKSNTDGGTTDYAAPVKGRFSISRDDSKNMLFLHMSSLRTEDTAVYYCATDGPYSDDFRSGYAARYRYFGMDVWGQGTTVTVSS

SEQ ID NO: 5096 - protein, 134 aa, Artificial Sequence
  anti-influenza_Chain
EVQLVVSGGGLVKPGGSLRLSCAASGLSFLNAWMSWVRQAPGKGLEWVGRIKSNTDGGTTDYAAPVKGRFSISRDDSKNMLFLHMSSLRTEDTAVYYCATDGPYSDDFRSGYAARYRYFGMDVWGCGTTVTVSS

SEQ ID NO: 5097 - protein, 134 aa, Artificial Sequence
  anti-influenza_Chain
EVQLVESGGGLVKPGGSLRLSCAASGFTFLNAWMSWVRQAPGKGLEWVGRIKSNTDGGTTDYAAPVKGRFTISRDDSKNTLYLQMSSLKTEDTAVYYCTTDGPYSDDFRSGYAARYRYFGMDVWGQGTTVTVSS

SEQ ID NO: 5098 - protein, 134 aa, Artificial Sequence
  anti-influenza_Chain
EVQLVESGGGLVKPGGSLRLSCAASGFTFLNAWMSWVRQAPGKCLEWVGRIKSNTDGGTTDYAAPVKGRFTISRDDSKNTLYLQMSSLKTEDTAVYYCTTDGPYSDDFRSGYAARYRYFGMDVWGQGTTVTVSS

SEQ ID NO: 5099 - protein, 134 aa, Artificial Sequence
  anti-influenza_Chain
EVQLVESGGGLVKPGGSLRLSCAASGFTFLNAWMSWVRQAPGKGLEWVGRIKSNTDGGTTDYAAPVKGRFTISRDDSKNTLYLQMSSLKTEDTAVYYCTTDGPYSDDFRSGYAARYRYFGMDVWGCGTTVTVSS

SEQ ID NO: 5100 - protein, 138 aa, Artificial Sequence
  anti-influenza_Chain
QVQLQESGGGLVQPGESLRLSCVGSGSSFGESTLSYYAVSWVRQAPGKGLEWLSIINAGGGDIDYADSVEGRFTISRDNSKETLYLQMTNLRVEDTGVYYCAKHMSMQQVVSAGWERADLVGDAFDVWGQGTMVTVSS

SEQ ID NO: 5101 - protein, 155 aa, Artificial Sequence
  anti-influenza_Chain
LSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKK

SEQ ID NO: 5102 - protein, 188 aa, Artificial Sequence
  anti-influenza_Chain
NVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKK

SEQ ID NO: 5103 - protein, 203 aa, Artificial Sequence
  anti-influenza_Chain
MLRSLVLNEKLRARVLERAEEFLLNNKADEEVWFRELVLCILTSNSSFISAYKSMNYILDKILYMDEKEISILLQESGYRFYNLKAKYLYRAKNLYGKVKKTIKEIADKDQMQAREFIATHIYGIGYKEASHFLRNVGYLDLAIIDRHILRFINNLGIPIKLKSKREYLLAESLLRSIANNLNVQVGLLDLFIFFKQTNTIVK

SEQ ID NO: 5104 - protein, 205 aa, Artificial Sequence
  anti-influenza_Chain
GLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGA

SEQ ID NO: 5105 - protein, 213 aa, Artificial Sequence
  anti-influenza_Chain
EIVLTQSPGTLSLSPGERATLSCRASQRVSSYLAWYQQKPGQAPRLLIYGASTRAAGIPDRFSGSGSGTDFTLTISRLEPEDSAVYYCQQYGRTPLTFGGGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5106 - protein, 213 aa, Artificial Sequence
  anti-influenza_Chain
DIQMTQSPSSLSASLGGNVTITCKASQDINKYIAWYQHKPGKGPRLVIHYTSTLQPGIPSRFSGSGSGTDYSFSISNLEPEDIATYYCLQYDILYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 5107 - protein, 214 aa, Artificial Sequence
  anti-influenza_Chain
DIQMTQSPSSLSASVGDRVTITCRASQGISSYLAWYQQKPGKVPTLLIYDASTLRSGVPSRFSGSGSATDFTLTISSLQPEDVATYYCQRYNSAPPITFGQGTRLEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5108 - protein, 214 aa, Artificial Sequence
  anti-influenza_Chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGGGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5109 - protein, 214 aa, Artificial Sequence
  anti-influenza_Chain
SYVLTQPPSVSVAPGETATVTCGGNNIGSKSVHWYQQKPGQAPVVVIYYDGDRPSGIPERFSGSNSGDTATLTISRVEAGDEADYYCLVWDYTSVHYVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 5110 - protein, 214 aa, Artificial Sequence
  anti-influenza_Chain
DIQMTQTSSSLSASLGDRVTISCRASQDIRNYLNWYQQKPDGTVKLLIYYTSRLHSGVPSRFSDSGSGTDYSLTISNLEQEDLATYFCQQTYTLPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 5111 - protein, 215 aa, Artificial Sequence
  anti-influenza_Chain
DGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKK

SEQ ID NO: 5112 - protein, 215 aa, Artificial Sequence
  anti-influenza_Chain
DIQMTQSPSTLSASVGDRVTITCRASQTINNYLAWYQQKPGKAPKLLIYKASSLESGVPSRFSGSGSGTEFTLTISSLQPDDFATYYCQEYNNDSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5113 - protein, 215 aa, Artificial Sequence
  anti-influenza_Chain
SVLTQPPSASGSRGQSITISCTGSTSDIGSYNYVSWYQQHPGTAPKVILYEVSQRPSGVPDRFSGSKSGNTAFLTVSGLQAEDEADYYCASYAGNNIYVFGSGTKVTVLGQPKANPTVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 5114 - protein, 215 aa, Artificial Sequence
  anti-influenza_Chain
SALTQPPSASGSRGQSITISCTGSTSDIGSYNYVSWYQQHPGTAPKVILYEVSQRPSGVPDRFSGSKSGNTAFLTVSGLQAEDEADYYCASYAGNNIYVFGSGTKVTVLGQPKANPTVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 5115 - protein, 216 aa, Artificial Sequence
  anti-influenza_Chain
QSVLTQPPSESVSPGQTASVTCSGHKLGDKYVSWYQQKPGQSPVLLIYQDNRRPSGIPERFIGSNSGNTATLTISGTQALDEADYYCQAWDSSTAVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5116 - protein, 216 aa, Artificial Sequence
  anti-influenza_Chain
QSALTQPASVSGSPGQSITISCTGTSSDVGSYNLVSWYQQHPGKAPKLMIYEVSKRPSGVSNRFSGSKSGNTASLTISGLQAEDEADYYCHLYVGSSNWVFGGGTKLAVLGQPKAAPSVTLFPPSSKELQANKATLVCPISDFYPGAVTVAWKADSSPVKAGVETTTPSKQSNNKYAASSYLSLTPEQWKSHKSYSCQVTHEGSTVEKTVAPTECS

SEQ ID NO: 5117 - protein, 216 aa, Artificial Sequence
  anti-influenza_Chain
EIVLTQSPATLSVSPGERATLSCRASQSVDSNLAWYQQKPGQAPRLLVYSASTRATGIPARFSGSGSGTEFTLAISSLQSEDFAVYYCQHYTNWPPRLTFGGGSKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5118 - protein, 216 aa, Artificial Sequence
  anti-influenza_Chain
EIVLTQSPATLSVSPGERATLSCRASQSVSHNLAWYQQKPGQAPRLLVYSASTRATGIPARFSGSGSGTEFTLAISSLQSEDFAVYYCQHYTNYPPRLTFGGGSKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5119 - protein, 216 aa, Artificial Sequence
  anti-influenza_Chain
EIVMTQSPATLSVSPGERATLSCRASQSVDSNLAWYQQKPGQAPRLLVYSASTRATGIPARFSGSGSGTEFTLAISSLQSEDFAVYYCQHYTNWPPRLTFGGGSKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5120 - protein, 216 aa, Artificial Sequence
  anti-influenza_Chain
EIVLTQSPATLSVSPGERATLSCRASQSVSSNLAWYQQKPGQAPRLLVYSASTRATGIPARFSGSGSGTEFTLAISSLQSEDFAVYYCQHYTNWPPRLTFGGGSKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5121 - protein, 216 aa, Artificial Sequence
  anti-influenza_Chain
EIVLTQSPATLSVSPGERATLSCRASQSVDHNLAWYQQKPGQAPRLLVYSASTRATGIPARFSGSGSGTEFTLAISSLQSEDFAVYYCQHYTNWPPRLTFGGGSKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5122 - protein, 216 aa, Artificial Sequence
  anti-influenza_Chain
EIVLTQSPATLSVSPGERATLSCRASQSVSHNLAWYQQKPGQAPRLLVYSASTRATGIPARFSGSGSGTEFTLAISSLQSEDFAVYYCQHYTNWPPRLTFGGGSKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5123 - protein, 216 aa, Artificial Sequence
  anti-influenza_Chain
EIVLTQSPATLSVSPGERATLSCRASQSVSHNLAWYQQKPGQAPRLLVYSASTRATGIPARFSGSGSGTEFTLAISSLQSEDFAVYYCQHYTNFPPRLTFGGGSKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5124 - protein, 216 aa, Artificial Sequence
  anti-influenza_Chain
EIVLTQSPATLSVSPGERATLSCRASQSVDSNLAWYQQKPGQAPRLLVYSASTRATGIPARFSGSGSGTEFTLAISSLQSEDFAVYYCQHYTNFPPRLTFGGGSKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5125 - protein, 216 aa, Artificial Sequence
  anti-influenza_Chain
EIVLTQSPATLSVSPGERATLSCRASQSVDSNLAWYQQKPGQAPRLLVYSASTRATGIPARFSGSGSGTEFTLAISSLQSEDFAVYYCQHYTNYPPRLTFGGGSKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5126 - protein, 216 aa, Artificial Sequence
  anti-influenza_Chain
ETTLTQSPATLSVSPGERATLSCRASQVISHNLAWYQQKPGQAPRLLIYGASTRASGIPARFSGSGSGTDYTLTITSLQSEDFAVYYCQHYSNWPPRLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5127 - protein, 216 aa, Artificial Sequence; identical to SEQ ID NO: 1008
  anti-influenza_Chain

SEQ ID NO: 5128 - protein, 216 aa, Artificial Sequence
  anti-influenza_Chain
EIVLTQSPATLSVSPGERATLSCRASQVISHNLAWYQQKPGQAPRLLIYGASTRASGIPARFSGSGSGTDYTLTITSLQPEDFAVYYCQHYSNWPPRLTFGGGTKVEIKRTVAAPSVSIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5129 - protein, 216 aa, Artificial Sequence
  anti-influenza_Chain
EIVMTQSPATLSVSPGERATLSCRASQVISHNLAWYQQKPGQAPRLLIYGASTRASGIPARFSGSGSGTDYTLTITSLQSEDFAVYYCQHYSNWPPRLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5130 - protein, 216 aa, Artificial Sequence
  anti-influenza_Chain
EIVLTQSPATLSVSPGERATLSCRASQVISHNLAWYQQKPGQAPRLLIYGASTRASGIPARFSGSGSGTDYTLTITSLQSEDFAVYYCQHYSNFPPRLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5131 - protein, 216 aa, Artificial Sequence
  anti-influenza_Chain
EIVLTQSPATLSVSPGERATLSCRASQVISHNLAWYQQKPGQAPRLLIYGASTRASGIPARFSGSGSGTDYTLTITSLQSEDFAVYYCQHYSNYPPRLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5132 - protein, 216 aa, Artificial Sequence
  anti-influenza_Chain
EIVLTQSPATLSVSPGERVTLSCRASQSVANNLAWYQQKPGQSPRLLIYGASTRDTGIPARFSGSGSGTEFTLTISSLQSEDFAVYYCQQYNNWPPMYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5133 - protein, 216 aa, Artificial Sequence
  anti-influenza_Chain
DIVMTQSPSTLSASVGDRVTITCRASQSIGNWLAWYQQKPGKAPKLLIYKVSTLESGVPSRFSGSGSGTEFTLTINSLQPDDFATYYCQRYTSNSQGFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5134 - protein, 216 aa, Artificial Sequence
  anti-influenza_Chain
DIQLTQSPLSPPVTLGQPASISCRSSQSLLYTDGFTYLSWYHQRPGQSPRRLIYKISNRDSGVPDRFSGSGSGTDFTLKISRVEAEDVGVYYCMQATHWPLTFGEGTKVEIKPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 5135 - protein, 216 aa, Artificial Sequence
  anti-influenza_Chain
EIVLTQSPGTLSLSPGERATLSCRASQSVRSNNLAWYQHKPGQAPRLLIFGASSRATGIPDRFSGSGSGTDFTLTISRLEPEDFAVYYCQQYGSSPALTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5136 - protein, 216 aa, Artificial Sequence
  anti-influenza_Chain
QSVLTQPPSASGSRGQSITISCTGSTSDIGSYNYVSWYQQHPGTAPKVILYEVSQRPSGVPDRFSGSKSGNTAFLTVSGLQTDDEADYYCASYAGNNIYVFGSGTKVTVLGQPKANPTVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 5137 - protein, 217 aa, Artificial Sequence
  anti-influenza_Chain
QPVLTQPPSASGSPGQRVTISCSGSSSNIGSYTVNWYQQLPGTAPKLLIYSLNQRPSGVPDRFSGSKSGTSASLAISGLQSEDEAVYYCAAWDDSLSAHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5138 - protein, 217 aa, Artificial Sequence
  anti-influenza_Chain
QPVLTQPPSASGTPGQRVTISCSGSSSNIGSNTVSWYQQVPGTAPKLLIYGNNERPSGVPDRFSGSKSATSASLAISGLQSEDEADYYCAAWDDSLNGFWVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 5139 - protein, 217 aa, Artificial Sequence
  anti-influenza_Chain
SYVLTQPPSVSGTPGQRVIISCSGYSSNIGSNTVNWYQQFPGTAPRLLIYANNQRPPGVPDRFSGSKSGTSASLAISGLQSDDESDYYCAAWDDSLNGHWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5140 - protein, 218 aa, Artificial Sequence
  anti-influenza_Chain
SYVLTQPPSVSVAPGQTARITCGGNNIGSKSVHWYQQKPGQAPVLVVYDDSDRPSGIPERFSGSNSGNTATLTISRVEAGDEADYYCQVWDSSSDHAVFGGGTQLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5141 - protein, 218 aa, Artificial Sequence
  anti-influenza_Chain
QSVVTQPPSVSVAPGQTARITCGGNNIGSKSVHWYQQKPGQAPVLVVYDDSDRPSGIPERFSGSNSGNTATLTISRVEAGDEADYYCQVWDSSSDHYVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5142 - protein, 218 aa, Artificial Sequence
  anti-influenza_Chain
LSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKKGDSAIVKSEVEYGNCNTKCQTPIGAINSSMPFHNIHPLTIGECPKYVKSNKLVLATGLRNSPL

SEQ ID NO: 5143 - protein, 219 aa, Artificial Sequence
  anti-influenza_Chain
SSELTQPPSASGTPGQRVTISCSGSTSNIGYNPVSWYQQVPGTAPKLLIYSNTERPSGVPDRFSGSKSGTSASLAISGLQSEDEADYYCAAWDDTLNGPVFGGGTKVTVLGQRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5144 - protein, 219 aa, Artificial Sequence; identical to SEQ ID NO: 1024
  anti-influenza_Chain

SEQ ID NO: 5145 - protein, 220 aa, Artificial Sequence
  anti-influenza_Chain
SYVLTQPPSASGTPGQRVTISCSGSTFNIGSNAVDWYRQLPGTAPKLLIYSNNQRPSGVPDRFSGSRSGTSASLAISGLQSEDEADYYCAAWDDILNVPVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5146 - protein, 220 aa, Artificial Sequence
  anti-influenza_Chain
QSALTQPAAVSGSPGQSITISCTGTSSDVGGYNYVSWYQQHPGKAPKLMIYEVSNRPSGVSNRFSGSKSGNTASLTISGLQAEDEADYYCSSYTSSSTYVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5147 - protein, 220 aa, Artificial Sequence
  anti-influenza_Chain
SYVLTQPPSVSGTPGQRVTISCSGSRSNVGDNSVYWYQHVPEMAPKLLVYKNTQRPSGVPARFSGSKSGTSASLAIIGLQSGDEADYYCVAWDDSVDGYVFGSGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5148 - protein, 220 aa, Artificial Sequence
  anti-influenza_Chain
SYVLTQPPSASGTPGQRVTISCSGSSSNIGSNYVYWYQQLPGTAPKLLIYRDGQRPSGVPDRFSGSKSGTSASLAISGLRSDDEADYYCATWDDNLSGPVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5149 - protein, 220 aa, Artificial Sequence
  anti-influenza_Chain
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5150 - protein, 220 aa, Artificial Sequence
  anti-influenza_Chain
TVLTQPPSVSGAPGQRVTISCTGSSSNIGAGYDVHWYQQLPGTAPKLLIYGNSNRPSGVPDRFSGSKSGTSATLGITGLQTGDEADYYCGTWDSSLSAYVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5151 - protein, 221 aa, Artificial Sequence
  anti-influenza_Chain
QSVLTQPPSVSAAPGQKVTISCSGSSSNIGNDYVSWYQQLPGTAPKLLIYDNNKRPSGIPDRFSGSKSGTSATLGITGLQTGDEANYYCATWDRRPTAYVVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5152 - protein, 225 aa, Artificial Sequence
  anti-influenza_Chain
MVGFTPVALAALAATGALAFPAGNATELEKRQTTPNSEGWHDGYYYSWWSDGGAQATYTNLEGGTYEISWGDGGNLVGGKGWNPGLNARAIHFEGVYQPNGNSYLAVYGWTRNPLVEYYIVENFGTYDPSSGATDLGTVECDGSIYRLGKTTRVNAPSIDGTQTFDQYWSVRQDKRTSGTVQTGCHFDAWARAGLNVNGDHYYQIVATEGYFSSGYARITVADVG

SEQ ID NO: 5153 - protein, 229 aa, Artificial Sequence
  anti-influenza_Chain
RSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5154 - protein, 232 aa, Artificial Sequence
  anti-influenza_Chain
HAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKK

SEQ ID NO: 5155 - protein, 233 aa, Artificial Sequence
  anti-influenza_Chain
MRPSIQFLGLLLFWLHGGQCDIQMTQSPSSLSASLGGNVTITCKASQDINKYIAWYQHKPGKGPRLVIHYTSTLQPGIPSRFSGSGSGTDYSFSISNLEPEDIATYYCLQYDILYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 5156 - protein, 234 aa, Artificial Sequence
  anti-influenza_Chain
MMSSAQFLGLLLLCFQGTRCDIQMTQTSSSLSASLGDRVTISCRASQDIRNYLNWYQQKPDGTVKLLIYYTSRLHSGVPSRFSDSGSGTDYSLTISNLEQEDLATYFCQQTYTLPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 5157 - protein, 234 aa, Artificial Sequence
  anti-influenza_Chain
MEAPAQLLFLLLLWLPDTTGEIVLTQSPATLSLSPGERATLSCRASENIWNNLAWYQQKPGQAPRLLISGASTGATGVPSRFRGSGSRTEFTLTISSLQSEDFAIYFCQQYNSWPRTFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5158 - protein, 235 aa, Artificial Sequence
  anti-influenza_Chain
METPAQLLFLLLLWLPDTTGEIVLTQSPGTLSLSPGERATLSCRASQSLSSSSLVWYQQKPGQAPRLLIYGASSRATGIPDRFSGSGSGTDFTLTISRLEPEDFAVYYCQQYGNSPYTFGQGTQVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5159 - protein, 235 aa, Artificial Sequence
  anti-influenza_Chain
METPAQLLFLLLLWLPDTTGETVLTQSPGTLSLSPGERATLSCRASQSVSISYLAWYQRKPGQAPRLLIYGASRRATGIPDRFSGSGSGTDFTLTISRLEPEDFAVYYCQQYGSSPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5160 - protein, 235 aa, Artificial Sequence
  anti-influenza_Chain
MAWMMLLLTLLIHCTGSWAQSVLTQPPSVSAAPGQKVTISCSGSSSNIGKNYVSWYQQLPGTAPKLLIYDNDKRPSGIPDRFSGSKSGTSATLGITGLQTGDEADYHCGAWDSSLNGGVFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5161 - protein, 238 aa, Artificial Sequence
  anti-influenza_Chain
MMKKKSWFTLMITGVISLFFSVSAFAGNVFWEPLSYFNSSTWQKADGYSNGQMFNCTWRANNVNFTNDGKLKLSLTSPANNKFDCGEYRSTNNYGYGLYEVSMKPAKNTGIVSSFFTYTGPSHGTQWDEIDIEFLGKDTTKVQFNYYTNGVGGHEKIINLGFDASTSFHTYAFDWQPGYIKWYVDGVLKHTATTNIPSTPGKIMMNLWNGTGVDSWLGSYNGANPLYAEYDWVKYTSN

SEQ ID NO: 5162 - protein, 243 aa, Artificial Sequence
  anti-influenza_Chain
QVQLVQSGAEVKKPGSSVKVSCKASGGTFSSYAISWVRQAPGQGLEWMGGIMGMFGTTNYAQKFQGRVTITADEFTSAAYMELRSLRSEDTAVYYCARSSGYYPEYFQDWGQGTLVTVSSGTGGSGGTGSGTGGSTQSVLTQPPSESVSPGQTASVTCSGHKLGDKYVSWYQQKPGQSPVLLIYQDNRRPSGIPERFIGSNSGNTATLTISGTQALDEADYYCQAWDSSTAVFGGGTKLTVLG

SEQ ID NO: 5163 - protein, 243 aa, Artificial Sequence
  anti-influenza_Chain
QVQLVQSGAEVKKPGSSVKVSCKASGGPFRNFAINWVRQAPGQGLEWMGGIIAVFGTTKYAHKFQGRVTITADDSTNTAYMELGSLKSEDTAVYYCARGPHYYSSYMDVWGEGTTVTVSSGTGGSGGTGSGTGGSTDIQLTQSPSSLSASVGDRVTITCRASQGISTYLAWYQQKPGKVPKLLIYAASTLQSGVPSRFSGSGSGTDFTLTISSLQPEDVATYYCQKYNSAPSFGPGTKVDIKR

SEQ ID NO: 5164 - protein, 243 aa, Artificial Sequence
  anti-influenza_Chain
MSYRVKRMLMLLVTGLFLSLSTFAASASAQTGGSFYEPFNNYNTGLWQKADGYSNGNMFNCTWRANNVSMTSLGEMRLSLTSPSYNKFDCGENRSVQTYGYGLYEVNMKPAKNVGIVSSFFTYTGPTDGTPWDEIDIEFLGKDTTKVQFNYYTNGVGNHEKIVNLGFDAANSYHTYAFDWQPNSIKWYVDGQLKHTATTQIPQTPGKIMMNLWNGAGVDEWLGSYNGVTPLSRSLHWVRYTKR

SEQ ID NO: 5165 - protein, 245 aa, Artificial Sequence
  anti-influenza_Chain
QVQLQQSGAEVKKPGSSVKVSCKVSGVIFSGSAISWVRQAPGQGLEWMGGISPLFGTTNYAQKFQGRVTITADQSTNTTYMEVNSLRYEDTAVYFCARGPKYYSEYMDVWGKGTTVTVSSGTGGSGGTGSGTGGSTDIQMTQSPSSLSASVGDRVTITCRASQGISSYLAWYQQKPGKVPTLLIYDASTLRSGVPSRFSGSGSATDFTLTISSLQPEDVATYYCQRYNSAPPITFGQGTRLEIKR

SEQ ID NO: 5166 - protein, 245 aa, Artificial Sequence
  anti-influenza_Chain
EVQLVESGAEVKKPGSSVKVSCKASGGTFSSYGISWVRQAPGQGLEWMGDIIGMFGSTNYAQNFQGRLTITADESTSTAYMELSSLRSEDTAVYYCARSSGYYPAYLPHWGQGTLVTVSSGTGGSGGTGSGTGGSTEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGGGTKVEIKR

SEQ ID NO: 5167 - protein, 245 aa, Artificial Sequence
  anti-influenza_Chain
EVQLVESGAEVKKPGSSVKVSCKASGGTFSSYAISWVRQAPGQGLEWMGGIIGMFGTANYAQKFQGRVTITADEFTSTAYMELSSLRSEDTAVYYCARGNYYYESSLDYWGQGTLVTVSSGTGGSGGTGSGTGGSTQSVVTQPPSVSVAPGQTARITCGGNNIGSKSVHWYQQKPGQAPVLVVYDDSDRPSGIPERFSGSNSGNTATLTISRVEAGDEADYYCQVWDSSSDHYVFGTGTKVTVLG

SEQ ID NO: 5168 - protein, 245 aa, Artificial Sequence
  anti-influenza_Chain
EVQLVQSGAEVKKPGASVKVSCKASGYTFTGYYVYWVRQAPGQGLEWMGWISAYNGNTNYAQKFQGRVTITADKSTSTAYMELSSLRSEDTAVYYCARSRSLDVWGQGTTVTVSSGTGGSGGTGSGTGGSTDVVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVDIKR

SEQ ID NO: 5169 - protein, 245 aa, Artificial Sequence
  anti-influenza_Chain
EVQLVETGAEVKKPGSSVKVPCKSSGSPFRSNAVSWVRQAPGQGLEWVGGILGVFGSPSYAQKFQGRVTITADESTNTVHMELRGLRSEDTAVYYCARGPTYYYSYMDVWGKGTTVTVSSGTGGSGGTGSGTGGSTSYVLTQPPSESVAPGQTARITCGGNNIGRNSVHWYQQKPGQAPVLVVYDDSDRPSGIPERFSGSKSGNTATLIISRVEVGDEADYYCQVWHSSSDHYVFGTGTKVTVLG

SEQ ID NO: 5170 - protein, 245 aa, Artificial Sequence
  anti-influenza_Chain
QMQLVQSGAEVKKPGSSVKVSCKASGGTFSSYAISWVRQAPGQGLEWMGGIFGMFGTANYAQKFQGRVTITADEFTSAAYMELSSLGSEDTAMYYCARSSGYYPQYFQDWGQGTLVTVSSGTGGSGGTGSGTGGSTEIVMTQSPGTLSLSPGQRATLSCRASQSVSSSYLAWYQQKPGQAPRLLMYGASSRATGIPDRFSGSGSGTDFTLTISRLEPEDFAVYYCQQYGSSSLTFGGGTKLEIKR

SEQ ID NO: 5171 - protein, 245 aa, Artificial Sequence
  anti-influenza_Chain
QVQLVQSGAEVKKPGSSVKVSCKASGVTFSYYAMSWVRQAPGQGLEWMGGISPMFGTTTYAQKFQGRVTITADDSTSTAYMEVRSLRSEDTAVYYCARSSNYYDSVYDYWGQGTLVTVSSGTGGSGGTGSGTGGSTQSVVTQPPSESVAPGQTARITCGGHNIGSNSVHWYQQKPGQAPVLVVYDNSDRPSGIPERFSGSNSGNTATLTISRVEAGDEADYYCQVWGSSSDHYVFGTGTKVTVLG

SEQ ID NO: 5172 - protein, 246 aa, Artificial Sequence
  anti-influenza_Chain
QVQLVQSGGGLVKPGGSLRLSCAASGFTFSSYSMNWVRQAPGKGLEWVSSISSSSSYIYYVDSVKGRFTISRDNAKNSLYLQMNSLRAEDTAVYYCARGGGSYGAYEGFDYWGQGTLVTVSSGTGGSGGTGSGTGGSTEIVLTQSPGTLSLSPGERATLSCRASQRVSSYLAWYQQKPGQAPRLLIYGASTRAAGIPDRFSGSGSGTDFTLTISRLEPEDSAVYYCQQYGRTPLTFGGGTKVEIKR

SEQ ID NO: 5173 - protein, 246 aa, Artificial Sequence
  anti-influenza_Chain
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSGTGGSGGTGSGTGGSTSYVLTQPPSVSVAPGQTARITCGGNNIGSKSVHWYQQKPGQAPVLVVYDDSDRPSGIPERFSGSNSGNTATLTISRVEAGDEADYYCQVWDSSSDHAVFGGGTQLTVLG

SEQ ID NO: 5174 - protein, 246 aa, Artificial Sequence
  anti-influenza_Chain
EVQLVETGAEVKKPGASVKVSCKASGYTFTSYYMHWVRQAPGQGLEWMGWINPNSGGTNYAQKFQGRVTMTRDTSISTAYMELSRLRSDDTAVYYCAREGKWGPQAAFDIWGQGTMVTVSSGTGGSGGTGSGTGGSTEIVMTQSPGTLSLSPGERATLSCRASQSVSSSYLAWYQQKPGQAPRLLIYDASSRATDIPDRFSGSGSGTDFTLTISRLEPEDFAVYYCQQYGSSLWTFGQGTKVEIKR

SEQ ID NO: 5175 - protein, 246 aa, Artificial Sequence
  anti-influenza_Chain
EVQLVESGGGLVQPGGSLRLSCAASGFTFSIYAMSWVRQAPGKGLEWVSAISSSGDSTYYADSVKGRFTISRDNARNTLYLQMNSLRAEDTAVYYCARAYGYTFDPWGQGTLVTVSSGTGGSGGTGSGTGGSTEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVEIKR

SEQ ID NO: 5176 - protein, 246 aa, Artificial Sequence
  anti-influenza_Chain
EVQLVETGAEVKKPGSSVKVSCKASGGTFRTHAISWVRQAPGQGLEWMGGIIAIFGTANYAQKFQGRITITADESTSTAYMELSSLRSEDTAVYFCARGSGYHISTPFDNWGQGTLVTVSSGTGGSGGTGSGTGGSTSYVLTQPPSVSVAPGQTARITCGGNNIGSKGVHWYQQKPGQAPVLVVYDDSDRPSGIPERFSGSNSGNTATLTISRVEAGDEADYYCQVWDSSSDHVVFGGGTKLTVLG

SEQ ID NO: 5177 - protein, 246 aa, Artificial Sequence
  anti-influenza_Chain
EVQLVQSGAEVKKPGSSVKVSCKASGGIFRSNSISWVRQAPGQGLEWMGGIFALFGTTDYAQKFQGRVTITADESSTTVYLELSSLTSEDTAVYYCARGSGYTTRNYFDYWGQGTLVTVSSGTGGSGGTGSGTGGSTEIVLTQSPGTLSLSPGERATLSCRASQSVSSNYLGWYQQKPGQAPRLLIYGASSRASGIPDRFSGGGSGTDFTLTISRLEPEDFAVYYCQQYGSSPLTFGGGTKVEIKR

SEQ ID NO: 5178 - protein, 246 aa, Artificial Sequence
  anti-influenza_Chain
EVQLVESGAEVKKPGSSVKVSCKASGGIFNSYAISWVRQAPGQGLEWMGGIIAIFHTPKYAQKFQGRVTITADESTNTAYMELRSLKSEDTALYYCARGSTYDFSSGLDYWGQGTLVTVSSGTGGSGGTGSGTGGSTQAGLTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVLG

SEQ ID NO: 5179 - protein, 247 aa, Artificial Sequence
  anti-influenza_Chain
QMQLVQSGAEVKKPGSSVKVSCKASGGTFSSYAITWVRQAPGQGLEWMGGIIGMFGSTNYAQNFQGRVTITADESTSTAYMELSSLRSEDTAVYYCARSTGYYPAYLHHWGQGTLVTVSSGTGGSGGTGSGTGGSTQSALTQPRSVSGSPGQSVTISCTGTSSDVGGYNYVSWYQQHPGKAPKLMIYDVSKRPSGVPDRFSGSKSGNTASLTISGLQAEDEADYYCSSYTSSSTHVFGTGTKVTVLG

SEQ ID NO: 5180 - protein, 248 aa, Artificial Sequence
  anti-influenza_Chain
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSGTGGSGGTGSGTGGSTSYVLTQPPSASGTPGQRVTISCSGSTFNIGSNAVDWYRQLPGTAPKLLIYSNNQRPSGVPDRFSGSRSGTSASLAISGLQSEDEADYYCAAWDDILNVPVFGGGTKLTVLG

SEQ ID NO: 5181 - protein, 248 aa, Artificial Sequence
  anti-influenza_Chain
QVQLVQSGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSGTGGSGGTGSGTGGSTQSALTQPAAVSGSPGQSITISCTGTSSDVGGYNYVSWYQQHPGKAPKLMIYEVSNRPSGVSNRFSGSKSGNTASLTISGLQAEDEADYYCSSYTSSSTYVFGTGTKVTVLG

SEQ ID NO: 5182 - protein, 248 aa, Artificial Sequence
  anti-influenza_Chain
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSGTGGSGGTGSGTGGSTSYVLTQPPSVSGTPGQRVTISCSGSRSNVGDNSVYWYQHVPEMAPKLLVYKNTQRPSGVPARFSGSKSGTSASLAIIGLQSGDEADYYCVAWDDSVDGYVFGSGTKVTVLG

SEQ ID NO: 5183 - protein, 248 aa, Artificial Sequence
  anti-influenza_Chain
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSGTGGSGGTGSGTGGSTSYVLTQPPSASGTPGQRVTISCSGSSSNIGSNYVYWYQQLPGTAPKLLIYRDGQRPSGVPDRFSGSKSGTSASLAISGLRSDDEADYYCATWDDNLSGPVFGGGTKLTVLG

SEQ ID NO: 5184 - protein, 248 aa, Artificial Sequence
  anti-influenza_Chain
EVQLVESGAEVKKPGSSVKVSCKASGGTFSFYSMSWVRQAPGQGLEWMGGIIPMFGTTNYAQKFQGRVTITAVESTSTAYMEVSSLRSEDTAVYYCARGDKGIYYYYMDVWGKGTTVTVSSGTGGSGGTGSGTGGSTQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTKVTVLG

SEQ ID NO: 5185 - protein, 248 aa, Artificial Sequence
  anti-influenza_Chain
MSLFGDTIAYLLSLIEDGEGKAELAEKLHCWFGGKEFDLDSALEWIKNKRCLTDIQKALIGASICFLKPKDQERKRRFITEPLSGMGTTATKKKGLILAERKMRRCVSFHEAFEIAEGHESSALLYCLMVMYLNPENYSMQVKLGTLCALCEKQASHSHRAHSRAARSSVPGVRREMQMVSAMNTAKTMNGMGKGEDVQKLAEELQNNIGVLRSLGASQKNGEGIAKDVMEVLKQSSMGNSALVRKYL

SEQ ID NO: 5186 - protein, 249 aa, Artificial Sequence
  anti-influenza_Chain
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSGTGGSGGTGSGTGGSTQSVLTQPPSVSAAPGQKVTISCSGSSSNIGNDYVSWYQQLPGTAPKLLIYDNNKRPSGIPDRFSGSKSGTSATLGITGLQTGDEANYYCATWDRRPTAYVVFGGGTKLTVLG

SEQ ID NO: 5187 - protein, 250 aa, Artificial Sequence
  anti-influenza_Chain
QVQLVQSGAEVKKPGSSVRVSCKASGSIFRNYAMSWVRQAPGQGLEWMGGIIAIFGTPKYAQKFQGRVTITADESTSTVYMELSGLRSEDTAMYYCARIPHYNFGSGSYFDYWGQGTLVTVSSGTGGSGGTGSGTGGSTTVLTQPPSVSGAPGQRVTISCTGSSSNIGAGYDVHWYQQLPGTAPKLLIYGNSNRPSGVPDRFSGSKSGTSATLGITGLQTGDEADYYCGTWDSSLSAYVFGTGTKVTVLG

SEQ ID NO: 5188 - protein, 252 aa, Artificial Sequence
  anti-influenza_Chain
EVQLVESGAEVKKPGSSVKVSCKASGHIFSGYAISWVRQAPGQGLEWMGGIIPIFGTTNYAQKFQGRVTITADQSTSTAYMDLSNLRSEDTAVYYCARVKDGYCTLTSCPVGWYFDLWGRGTLVTVSSGTGGSGGTGSGTGGSTEIVMTQSPGTLSLSPGERATLSCRASQSVSSSYLAWYQQKPGQAPRLLIFGASSRATGIPDRFSGSGSGTDFTLTISRLEPEDFAVYYCQQYGSSLTFGGGTKLEIKR

SEQ ID NO: 5189 - protein, 256 aa, Artificial Sequence
  anti-influenza_Chain
QVQLVQSGAEVKKPGSSVKVSCKASGGFFSSYAISWVRQAPGQGLEWMGGVIPIFRTANYAQNFQGRVTITADEFTSYMELSSLRSDDTAVYYCARLNYHDSGTYYNAPRGWFDPWGQGTLVTVSSGTGGSGGTGSGTGGSTDIQMTQSPDSLAVSLGEKATINCKSSQSILNSSNNKNYLAWYQQKPGQPPKLLIYWASTRESGVPDRFSGSGSGTDFTLTISSLQAEDVAVYYCQQYYSSPPTFGQGTKVEIKR

SEQ ID NO: 5190 - protein, 256 aa, Artificial Sequence; identical to SEQ ID NO: 5189
  anti-influenza_Chain

SEQ ID NO: 5191 - protein, 257 aa, Artificial Sequence
  anti-influenza_Chain
ICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKK

SEQ ID NO: 5192 - protein, 257 aa, Artificial Sequence; identical to SEQ ID NO: 5191
  anti-influenza_Chain

SEQ ID NO: 5193 - protein, 259 aa, Artificial Sequence
  anti-influenza_Chain
MVKSKYLVFISVFSLLFGVFVVGFSHQGVKAEEERPMGTAFYESFDAFDDERWSKAGVWTNGQMFNATWYPEQVTADGLMRLTIAKKTTSARNYKAGELRTNDFYHYGLFEVSMKPAKVEGTVSSFFTYTGEWDWDGDPWDEIDIEFLGKDTTRIQFNYFTNGVGGNEFYYDLGFDASESFNTYAFEWREDSITWYVNGEAVHTATENIPQTPQKIMMNLWPGVGVDGWTGVFDGDNTPVYSYYDWVRYTPLQNYQIHQ

SEQ ID NO: 5194 - protein, 259 aa, Artificial Sequence; identical to SEQ ID NO: 5193
  anti-influenza_Chain

SEQ ID NO: 5195 - protein, 261 aa, Artificial Sequence
  anti-influenza_Chain
DIQMTQSPSSVSASVGDRVTITCRASQDISTWLAWYQQKPGKAPKLLIYAASSLQSGVPSRFSGSGSGTDFTLTISSLQPEDFATYFCQQANSFPPTFGCGTKLEIKGGGGSGGGGSGGGGSGGGGSEVQLVVSGGGLVKPGGSLRLSCAASGLSFLNAWMSWVRQAPGKCLEWVGRIKSNTDGGTTDYAAPVKGRFSISRDDSKNMLFLHMSSLRTEDTAVYYCATDGPYSDDFRSGYAARYRYFGMDVWGQGTTVTVSS

SEQ ID NO: 5196 - protein, 261 aa, Artificial Sequence; identical to SEQ ID NO: 5195
  anti-influenza_Chain

SEQ ID NO: 5197 - protein, 263 aa, Artificial Sequence
  anti-influenza_Chain
MGFVLFSQLPSFLLVSTLLLFLVISHSCRAQNGGSYPYKSGEYRTKSFFGYGYYEVRMKAAKNVGIVSSFFTYTGPSDNNPWDEIDIEFLGKDTTKVQFNWYKNGVGGNEYLHNLGFDASQDFHTYGFEWRPDYIDFYVDGKKVYRGTRNIPVTPGKIMMNLWPGIGVDEWLGRYDGRTPLQAEYEYVKYYPNGRSKLVVNTPFVAVFSNFDSSQWEKADWANGSVFNCVWKPSQVTFSNGKMILTLDREYVDHHHHHHKDEL

SEQ ID NO: 5198 - protein, 263 aa, Artificial Sequence; identical to SEQ ID NO: 5197
  anti-influenza_Chain

SEQ ID NO: 5199 - protein, 280 aa, Artificial Sequence
  anti-influenza_Chain
MAQVGRGASPLSRARVPPLPHPLDGEHLPHDPAGGGHGKASSQDAPVGQLPGHLARPAFFHYLKNSFLVCSLTTVFALAVATFAGYALARFRFPGAELFGGSVLVTQVIPGILFLIPIYIMYIYVQNWVRSALGLEVRLVGSYGGLVFTYTAFFVPLSIWILRGFFASIPKELEEAAMVDGATPFQAFHRVILPLALPGLAATAVYIFLTAWDELLFAQVLTTEATATVPVGIRNFVGNYQNRYDLVMAAATVATLPVLVLFFFVQRQLIQGLTAGAVKG

SEQ ID NO: 5200 - protein, 280 aa, Artificial Sequence; identical to SEQ ID NO: 5199
  anti-influenza_Chain

SEQ ID NO: 5201 - protein, 281 aa, Artificial Sequence
  anti-influenza_Chain
MADNMTTTQIEVGPGATNATINFEAGILECYERFSWQRALDYPGQDRLHRLKRKLESRIKTHNKSEPENKRMSLEERKAIGVKMMKVLLFMDPSAGIEGFEPYCVKNPSTSKCPNYDWTDYPPTPGKYLDDIEEEPENVDHPIEVVLRDMNNKDARQKIKDEVNTQKEGKFRLTIKRDIRNVLSLRVLVNGTFLKHPNGDKSLSTLHRLNAYDQNGGLVAKLVATDDRTVEDEKDGHRILNSLFERFDEGHSKPIRAAETAVGVLSQFGQEHRLSPEEGDN

SEQ ID NO: 5202 - protein, 281 aa, Artificial Sequence; identical to SEQ ID NO: 5201
  anti-influenza_Chain

SEQ ID NO: 5203 - protein, 286 aa, Artificial Sequence
  anti-influenza_Chain
MCTMPLMKLKKMMRRTAFLLSVLIGCSMLGSDRSDKAPHWELVWSDEFDYSGLPDPEKWDYDVGGHGWGNQELQYYTRARIENARVGGGVLIIEARHEPYEGREYTSARLVTRGKASWTYGRFEIRARLPSGRGTWPAIWMLPDRQTYGSAYWPDNGEIDIMEHVGFNPDVVHGTVHTKAYNHLLGTQRGGSIRVPTARTDFHVYAIEWTPEEIRWFVDDSLYYRFPNERLTDPEADWRHWPFDQPFHLIMNIAVGGAWGGQQGVDPEAFPAQLVVDYVRVYRWVE

SEQ ID NO: 5204 - protein, 286 aa, Artificial Sequence; identical to SEQ ID NO: 5203
  anti-influenza_Chain

SEQ ID NO: 5205 - protein, 300 aa, Artificial Sequence
  anti-influenza_Chain
NVPEWSYIVEKANPANDLCYPGNFNDYEELKHLLSRINHFEKIQGYIPEAPRDGQAYVRKDGEWVLLSTFLRSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5206 - protein, 300 aa, Artificial Sequence; identical to SEQ ID NO: 5205
  anti-influenza_Chain

SEQ ID NO: 5207 - protein, 309 aa, Artificial Sequence
  anti-influenza_Chain
MVNRRDLIKWSAVALGAGAGLAGPAPAAHAADLEWEQYPVPAAPGGNRSWQLLPSHSDDFNYTGKPQTFRGRWLDQHKDGWSGPANSLYSARHSWVADGNLIVEGRRAPDGRVYCGYVTSRTPVEYPLYTEVLMRVSGLKLSSNFWLLSRDDVNEIDVIECYGNESLHGKHMNTAYHIFQRNPFTELARSQKGYFADGSYGYNGETGQVFGDGAGQPLLRNGFHRYGVHWISATEFDFYFNGRLVRRLNRSNDLRDPRSRFFDQPMHLILNTESHQWRVDRGIEPTDAELADPSINNIYYRWVRTYQAV

SEQ ID NO: 5208 - protein, 309 aa, Artificial Sequence; identical to SEQ ID NO: 5207
  anti-influenza_Chain

SEQ ID NO: 5209 - protein, 320 aa, Artificial Sequence
  anti-influenza_Chain
ICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKKGDSAIVKSEVEYGNCNTKCQTPIGAINSSMPFHNIHPLTIGECPKYVKSNKLVLATGLRNSPL

SEQ ID NO: 5210 - protein, 320 aa, Artificial Sequence; identical to SEQ ID NO: 5209
  anti-influenza_Chain

SEQ ID NO: 5211 - protein, 320 aa, Artificial Sequence; identical to SEQ ID NO: 5209
  anti-influenza_Chain

SEQ ID NO: 5212 - protein, 326 aa, Artificial Sequence
  anti-influenza_Chain
TLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSR

SEQ ID NO: 5213 - protein, 326 aa, Artificial Sequence; identical to SEQ ID NO: 5212
  anti-influenza_Chain

SEQ ID NO: 5214 - protein, 320 aa, Artificial Sequence; identical to SEQ ID NO: 5209
  anti-influenza_Chain

SEQ ID NO: 5215 - protein, 330 aa, Artificial Sequence
  anti-influenza_Chain
MCSSIPSLREVFANDFRIGAAVNPVTLEAQQSLLIRHVNSLTAENHMKFEHLQPEEGRFTFDIAIKSSTSPFSSHGVRGHTLVWHNQTPSWVFQDSQGHFVGRDVLLERMKSHISTVVQRYKGKVYCWDVINEAVADEGSEWLRSSTWRQIIGDDFIQQAFLYAHEADPEALLFYNDYNECFPEKREKIYTLVKSLRDKGIPIHGIGMQAHWSLNRPTLDEIRAAIERYASLGVILHITELDISMFEFDDHRKDLAAPTNEMVERQAERYEQIFSLFKEYRDVIQNVTFWGIADDHTWLDHFPVQGRKNWPLLFDEQHNPKPAFWRVVNI

SEQ ID NO: 5216 - protein, 330 aa, Artificial Sequence; identical to SEQ ID NO: 5215
  anti-influenza_Chain

SEQ ID NO: 5217 - protein, 334 aa, Artificial Sequence
  anti-influenza_Chain
MKNRVISLLMASLLLVLSVIVAPFYKAEAATVVNTPFVAVFSNFDSSQWEKADWANGSVFNCVWKPSQVTFSNGKMILTLDREYGGSYPYKSGEYRTKSFFGYGYYEVRMKAAKNVGIVSSFFTYTGPSDNNPWDEIDIEFLGKDTTKVQFNWYKNGVGGNEYLHNLGFDASQDFHTYGFEWRPDYIDFYVDGKKVYRGTRNIPVTPGKIMMNLWPGIGVDEWLGRYDGRTPLQAEYEYVKYYPNGVPQDNPTPTPTIAPSTPTNPNLPLKGDVNGDGHVNSSDYSLFKRYLLRVIDRFPVGDQSVADVNRDGRIDSTDLTMLKRYLIRAIPSL

SEQ ID NO: 5218 - protein, 334 aa, Artificial Sequence; identical to SEQ ID NO: 5217
  anti-influenza_Chain

SEQ ID NO: 5219 - protein, 347 aa, Artificial Sequence
  anti-influenza_Chain
ICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKKGDSAIVKSEVEYGNCNTKCQTPIGAINSSMPFHNIHPLTIGECPKYVKSNKLVLATGLRNSPLGYIPEAPRDGQAYVRKDGEWVLLSTFL

SEQ ID NO: 5220 - protein, 347 aa, Artificial Sequence; identical to SEQ ID NO: 5219
  anti-influenza_Chain

SEQ ID NO: 5221 - protein, 349 aa, Artificial Sequence
  anti-influenza_Chain
MNIKKTAVKSALAVAAAAAALTTNVSAKDFSGAELYTLEEVQYGKFEARMKMAAASGTVSSMFLYQNGSEIADGRPWVEVDIEVLGKNPGSFQSNIITGKAGAQKTSEKHHAVSPAADQAFHTYGLEWTPNYVRWTVDGQEVRKTEGGQVSNLTGTQGLRFNLWSSESAAWVGQFDESKLPLFQFINWVKVYKYTPGQGEGGSDFTLDWTDNFDTFDGSRWGKGDWTFDGNRVDLTDKNIYSRDGMLILALTRKGQESFNGQVPRDDEPAPQSSSSAPASSSSVPASSSSVPASSSSAFVPPSSSSATNAIHGMRTTPAVAKEHRNLVNAKGAKVNPNGHKRYRVNFEH

SEQ ID NO: 5222 - protein, 349 aa, Artificial Sequence
  anti-influenza_Chain
EVQLVESGGGVVQPGRSLRLSCAASGFAFHNRAMHWVRQAPGKGLEWVALIYFDGSKQYYADSVKGRFTISRDNSKNTVFLQMNSLRPEDTAVYYCAVPGPIFGIFPPWSYFDHWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKG

SEQ ID NO: 5223 - protein, 349 aa, Artificial Sequence; identical to SEQ ID NO: 5222
  anti-influenza_Chain

SEQ ID NO: 5224 - protein, 349 aa, Artificial Sequence; identical to SEQ ID NO: 5221
  anti-influenza_Chain

SEQ ID NO: 5225 - protein, 387 aa, Artificial Sequence
  anti-influenza_Chain
MNKFLNKKWSLILTMGGIFLMATLSLIFATGKKAFNDQTSAEDIPSLAEAFRDYFPIGAAIEPGYTTGQIAELYKKHVNMLVAENAMKPASLQPTEGNFQWADADRIVQFAKENGMELRFHTLVWHNQTPTGFSLDKEGKPMVEETDPQKREENRKLLLQRLENYIRAVVLRYKDDIKSWDVVNEVIEPNDPGGMRNSPWYQITGTEYIEVAFRATREAGGSDIKLYINDYNTDDPVKRDILYELVKNLLEKGVPIDGVGHQTHIDIYNPPVERIIESIKKFAGLGLDNIITELDMSIYSWNDRSDYGDSIPDYILTLQAKRYQELFDALKENKDIVSAVVFWGISDKYSWLNGFPVKRTNAPLLFDRNFMPKPAFWAIVDPSRLRE

SEQ ID NO: 5226 - protein, 387 aa, Artificial Sequence; identical to SEQ ID NO: 5225
  anti-influenza_Chain

SEQ ID NO: 5227 - protein, 407 aa, Artificial Sequence
  anti-influenza_Chain
MRNVVRKPLTIGLALTLLLPMGMTATSAKNADSYAKKPHISALNAPQLDQRYKNEFTIGAAVEPYQLQNEKDVQMLKRHFNSIVAENVMKPISIQPEEGKFNFEQADRIVKFAKANGMDIRFHTLVWHSQVPQWFFLDKEGKPMVNETDPVKREQNKQLLLKRLETHIKTIVERYKDDIKYWDVVNEVVGDDGKLRNSPWYQIAGIDYIKVAFQAARKYGGDNIKLYMNDYNTEVEPKRTALYNLVKQLKEEGVPIDGIGHQSHIQIGWPSEAEIEKTINMFAALGLDNQITELDVSMYGWPPRAYPTYDAIPKQKFLDQAARYDRLFKLYEKLSDKISNVTFWGIADNHTWLDSRADVYYDANGNVVVDPNAPYAKVEKGKGKDAPFVFGPDYKVKPAYWAIIDHK

SEQ ID NO: 5228 - protein, 407 aa, Artificial Sequence; identical to SEQ ID NO: 5227
  anti-influenza_Chain

SEQ ID NO: 5229 - protein, 411 aa, Artificial Sequence
  anti-influenza_Chain
LSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKKGYIPEAPRDGQAYVRKDGEWVLLSTFLRSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5230 - protein, 411 aa, Artificial Sequence; identical to SEQ ID NO: 5229
  anti-influenza_Chain

SEQ ID NO: 5231 - protein, 431 aa, Artificial Sequence
  anti-influenza_Chain
MDDHAEKFLWGVATSAYQIEGATQEDGRGPSIWDAFARRPGAIRDGSTGEPACDHYRRYEEDIALMQSLGVRAYRFSVAWPRILPEGRGRINPKGLAFYDRLVDRLLASGITPFLTLYHWDLPLALEERGGWRSRETAFAFAEYAEAVARALADRVPFFATLNEPWCSAFLGHWTGEHAPGLRNLEAALRAAHHLLLGHGLAVEALRAAGARRVGIVLNFAPAYGEDPEAVDVADRYHNRYFLDPILGKGYPESPFRDPPPVPILSRDLELVARPLDFLGVNYYAPVRVAPGTGTLPVRYLPPEGPATAMGWEVYPEGLHHLLKRLGREVPWPLYVTENGAAYPDLWTGEAVVEDPERVAYLEAHVEAALRAREEGVDLRGYFVWSLMDNFEWAFGYTRRFGLYYVDFPSQRRIPKRSALWYRERIARAQT

SEQ ID NO: 5232 - protein, 431 aa, Artificial Sequence
  anti-influenza_Chain
MTENAEKFLWGVATSAYQIEGATQEDGRGPSIWDAFAQRPGAIRDGSTGEPACDHYRRYEEDIALMQSLGVRAYRFSVAWPRILPEGRGRINPKGLAFYDRLVDRLLASGITPFLTLYHWDLPLALEERGGWRSRETAFAFAEYAEAVARALADRVPFFATLNEPWCSAFLGHWTGEHAPGLRNLEAALRAAHHLLLGHGLAVEALRAAGARRVGIVLNFAPAYGEDPEAVDVADRYHNRFFLDPILGKGYPESPFRDPPPVPILSRDLELVARPLDFLGVNYYAPVRVAPGTGTLPVRYLPPEGPATAMGWEVYPEGLYHLLKRLGREVPWPLYVTENGAAYPDLWTGEAVVEDPERVAYLEAHVEAALRAREEGVDLRGYFVWSLMDNFEWAFGYTRRFGLYYVDFPSQRRIPKRSALWYRERIARAQT

SEQ ID NO: 5233 - protein, 431 aa, Artificial Sequence
  anti-influenza_Chain
MAENAEKFLWGVATSAYQIEGATQEDGRGPSIWDTFARRPGAIRDGSTGEPACDHYHRYEEDIALMQSLGVGVYRFSVAWPRILPEGRGRINPKGLAFYDRLVDRLLAAGITPFLTLYHWDLPQALEDRGGWRSRETAFAFAEYAEAVARALADRVPFFATLNEPWCSAFLGHWTGEHAPGLRNLEAALRAAHHLLLGHGLAVEALRAAGAKRVGIVLNFAPVYGEDPEAVDVADRYHNRYFLDPILGRGYPESPFQDPPPTPNLSRDLELVARPLDFLGVNYYAPVRVAPGTGPLPVRYLPPEGPVTAMGWEVYPEGLYHLLKRLGREVPWPLYITENGAAYPDLWTGEAVVEDPERVAYLEAHVEAALRAREEGVDLRGYFVWSLMDNFEWAFGYTRRFGLYYVDFPSQRRIPKRSALWYRERIARAQL

SEQ ID NO: 5234 - protein, 431 aa, Artificial Sequence; identical to SEQ ID NO: 5231
  anti-influenza_Chain

SEQ ID NO: 5235 - protein, 431 aa, Artificial Sequence; identical to SEQ ID NO: 5232
  anti-influenza_Chain

SEQ ID NO: 5236 - protein, 431 aa, Artificial Sequence; identical to SEQ ID NO: 5233
  anti-influenza_Chain

SEQ ID NO: 5237 - protein, 432 aa, Artificial Sequence
  anti-influenza_Chain
MFKPNYHFFPITGWMNDPNGLIFWKGKYHMFYQYNPRKPEWGNICWGHAVSDDLVHWRHLPVALYPDDETHGVFSGSAVEKDGKMFLVYTYYRDPTHNKGEKETQCVAMSENGLDFVKYDGNPVISKPPEEGTHAFRDPKVNRSNGEWRMVLGSGKDEKIGRVLLYTSDDLFHWKYEGVIFEDETTKEIECPDLVRIGEKDILIYSITSTNSVLFSMGELKEGKLNVEKRGLLDHGTDFYAAQTFFGTDRVVVIGWLQSWLRTGLYPTKREGWNGVMSLPRELYVENNELKVKPVDELLALRKRKVFETAKSGTFLLDVKENSYEIVCEFSGEIELRMGNESEEVVITKSRDELIVDTTRSGVSGGEVRKSTVEDEATNRIRAFLDSCSVEFFFNDSIAFSFRIHPENVYNILSVKSNQVKLEVFELENIWL

SEQ ID NO: 5238 - protein, 432 aa, Artificial Sequence; identical to SEQ ID NO: 5237
  anti-influenza_Chain

SEQ ID NO: 5239 - protein, 441 aa, Artificial Sequence
  anti-influenza_Chain
EVKLVESGGGLVQPGGSLRLSCATSGFTFSDYYMSWVRQSPGKALEWLGFTRSRVLGYTTDYSASVKGRFTISRDNSQSILYLQMNSLRGEDSATYYCARDRPMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 5240 - protein, 441 aa, Artificial Sequence; identical to SEQ ID NO: 5239
  anti-influenza_Chain

SEQ ID NO: 5241 - protein, 443 aa, Artificial Sequence
  anti-influenza_Chain
EVQLQQSGPELVKPGASVKMSCKASGYTFTSYVMHWVKQKPGQGLEWIGYINPYNDGTRYNEKFRVKATLTSDKSSSTAYMELSSLTSEDSAVYYCARRGLITTPTLDYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 5242 - protein, 443 aa, Artificial Sequence; identical to SEQ ID NO: 5241
  anti-influenza_Chain

SEQ ID NO: 5243 - protein, 444 aa, Artificial Sequence
  anti-influenza_Chain
NVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKKGYIPEAPRDGQAYVRKDGEWVLLSTFLRSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5244 - protein, 444 aa, Artificial Sequence; identical to SEQ ID NO: 5243
  anti-influenza_Chain

SEQ ID NO: 5245 - protein, 447 aa, Artificial Sequence
  anti-influenza_Chain
QVQLQESGPGLVKPSETLSLTCTVSGGLIGTGSYYWGWIRQTPGKGMEWIGSISYSGSTYYHPSLKSRVTISDDTSKNQLFLKLRSVTAADTAQYYCARYNWGIRYFDFWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKTRESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPAQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5246 - protein, 447 aa, Artificial Sequence; identical to SEQ ID NO: 5245
  anti-influenza_Chain

SEQ ID NO: 5247 - protein, 448 aa, Artificial Sequence
  anti-influenza_Chain
EVQLQESGPGLVKPSQTLSLTCNVSGGSITGDYKWSWIRQPPGKGLEWIGHIHSTGTTYYNPSLRSRITISMDTSKNNLSLRLTSVTAADTAVYYCASHTLTSGHYPRDFDFWGQGTLVTVSSASTKGPSVFPLAPCSRSTSESTAALGCLVKDYFPEPVTVSWNSGALTSGVHTFPAVLQSSGLYSLSSVVTVTSSNFGTQTYTCNVDHKPSNTKVDKTVERKCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSGK

SEQ ID NO: 5248 - protein, 450 aa, Artificial Sequence
  anti-influenza_Chain
QVQLQQSGAEVKKPGSSVKVSCKVSGVIFSGSAISWVRQAPGQGLEWMGGISPLFGTTNYAQKFQGRVTITADQSTNTTYMEVNSLRYEDTAVYFCARGPKYYSEYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5249 - protein, 450 aa, Artificial Sequence
  anti-influenza_Chain
QVQLVQSGAEVKKPGSSVKVSCKASGGTFSSYAISWVRQAPGQGLEWMGGIMGMFGTTNYAQKFQGRVTITADEFTSAAYMELRSLRSEDTAVYYCARSSGYYPEYFQDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5250 - protein, 450 aa, Artificial Sequence
  anti-influenza_Chain
EVQLVESGAEVKKPGSSVKVSCKASGGTFSSYGISWVRQAPGQGLEWMGDIIGMFGSTNYAQNFQGRLTITADESTSTAYMELSSLRSEDTAVYYCARSSGYYPAYLPHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5251 - protein, 450 aa, Artificial Sequence
  anti-influenza_Chain
EVQLVESGAEVKKPGSSVKVSCKASGGTFSSYAISWVRQAPGQGLEWMGGIIGMFGTANYAQKFQGRVTITADEFTSTAYMELSSLRSEDTAVYYCARGNYYYESSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5252 - protein, 450 aa, Artificial Sequence
  anti-influenza_Chain
EVQLVQSGAEVKKPGSSMKVSCKASGSIFSNYGISWVRQAPGQGLEWMGGIIPIFGAANYAQKFQGRVTITADESTSTVYMEVRSLRSEDTAVYYCARRQQLYKGYYHHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5253 - protein, 450 aa, Artificial Sequence
  anti-influenza_Chain
QVQLVQSGAGVKKPGSSMKVSCKASGSIFSNYGISWVRQAPGQGLEWMGGIIPIFGAANYAQKFQGRVTITADESTSTVYMEVRSLRSEDTAVYYCARRQQLYKGYYHHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5254 - protein, 450 aa, Artificial Sequence
  anti-influenza_Chain
QVQLVQSGAEVRKPGSSVKVSCKVSGGIIRKYAINWVRQAPGQGLEWMGGIIAIFNTANYAQKFQGRVTITADESTSTVYMELSSLRSEDTALYYCARGMNYYSDYFDYWGQGSLVTVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5255 - protein, 450 aa, Artificial Sequence; identical to SEQ ID NO: 5254
  anti-influenza_Chain

SEQ ID NO: 5256 - protein, 450 aa, Artificial Sequence; identical to SEQ ID NO: 5252
  anti-influenza_Chain

SEQ ID NO: 5257 - protein, 450 aa, Artificial Sequence; identical to SEQ ID NO: 5253
  anti-influenza_Chain

SEQ ID NO: 5258 - protein, 450 aa, Artificial Sequence; identical to SEQ ID NO: 5248
  anti-influenza_Chain

SEQ ID NO: 5259 - protein, 450 aa, Artificial Sequence; identical to SEQ ID NO: 5249
  anti-influenza_Chain

SEQ ID NO: 5260 - protein, 450 aa, Artificial Sequence; identical to SEQ ID NO: 5250
  anti-influenza_Chain

SEQ ID NO: 5261 - protein, 450 aa, Artificial Sequence; identical to SEQ ID NO: 5251
  anti-influenza_Chain

SEQ ID NO: 5262 - protein, 451 aa, Artificial Sequence
  anti-influenza_Chain
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5263 - protein, 451 aa, Artificial Sequence
  anti-influenza_Chain
QVQLVQSGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5264 - protein, 451 aa, Artificial Sequence
  anti-influenza_Chain
EVQLVESGAEVKKPGSSVKVSCKASGGTFSFYSMSWVRQAPGQGLEWMGGIIPMFGTTNYAQKFQGRVTITAVESTSTAYMEVSSLRSEDTAVYYCARGDKGIYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5265 - protein, 451 aa, Artificial Sequence; identical to SEQ ID NO: 5262
  anti-influenza_Chain

SEQ ID NO: 5266 - protein, 451 aa, Artificial Sequence; identical to SEQ ID NO: 5263
  anti-influenza_Chain

SEQ ID NO: 5267 - protein, 451 aa, Artificial Sequence; identical to SEQ ID NO: 5264
  anti-influenza_Chain

SEQ ID NO: 5268 - protein, 452 aa, Artificial Sequence
  anti-influenza_Chain
QVQLVQSGGGLVKPGGSLRLSCAASGFTFSSYSMNWVRQAPGKGLEWVSSISSSSSYIYYVDSVKGRFTISRDNAKNSLYLQMNSLRAEDTAVYYCARGGGSYGAYEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5269 - protein, 452 aa, Artificial Sequence
  anti-influenza_Chain
QVQLVQSGAEVKQPGASVKVSCKASGYTFNAYYIHWVRQAPGQGLEWMGWINPNFGGTHYARKFQGRVTMTRDASINTAYMELDRLISDDTAVYYCVRWRAAAVIMDQFYKMDVWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKTRESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPAQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5270 - protein, 452 aa, Artificial Sequence
  anti-influenza_Chain
EVQLVQSGAEVKKPGASVKVSCKASGYIFTGYYIHWVRQAPGQGLEWMGRIDPNGAGTTYAQKFQGRVTLTMDTSITTAYMELSRLRFDDTAIYYCARWDWNFDLYLGWFDPWGQGTPVTVASASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5271 - protein, 452 aa, Artificial Sequence; identical to SEQ ID NO: 5269
  anti-influenza_Chain

SEQ ID NO: 5272 - protein, 452 aa, Artificial Sequence; identical to SEQ ID NO: 5268
  anti-influenza_Chain

SEQ ID NO: 5273 - protein, 452 aa, Artificial Sequence; identical to SEQ ID NO: 5270
  anti-influenza_Chain

SEQ ID NO: 5274 - protein, 453 aa, Artificial Sequence
  anti-influenza_Chain
QVQLVQSGAEVKKPGSSVRVSCKASGSIFRNYAMSWVRQAPGQGLEWMGGIIAIFGTPKYAQKFQGRVTITADESTSTVYMELSGLRSEDTAMYYCARIPHYNFGSGSYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5275 - protein, 453 aa, Artificial Sequence
  anti-influenza_Chain
QVQLVQSGAEVKKPGASVKVSCKASGYIFTGYYIHWVRQAPGQGLEWMGRIDPNGSGTTYAQKFQGRVTLTMDTSITTAYMELSRLRFDDTAIYYCARWDWNFDLYLGWFDPWGQGTPVTVASASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5276 - protein, 453 aa, Artificial Sequence
  anti-influenza_Chain
EVQLVQSGAEVKKPGASVKVSCKASGYIFTGYYIHWVRQAPGQGLEWMGRIDPNGAGTTYAQKFQGRVTLTMDTSITTAYMELSRLRFDDTAIYYCARWDWNFDLYLGWFDPWGQGTPVTVASASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5277 - protein, 453 aa, Artificial Sequence
  anti-influenza_Chain
QVQLVQSGAEVKKPGASVKVSCKASGYTFNAHHMHWVRQAPGQGLGWMGWIDPNNDGTIYAQKFQGRVTLTMDTSIHTAYMELSGLRYDDTAIYYCVRWAWNFDFFLGWFDPWGQGTLVTVASASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5278 - protein, 453 aa, Artificial Sequence
  anti-influenza_Chain
EVQLVQSGAEVKKPGESLKISCKVSGYSFTSQWIGWVRQMPGKGLEWIGMMYPGDSDTIYSPSFQGQVTISADNSISTAYLQWSSLKASDTAIYYCASGPGYSGYHYGWFDTWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5279 - protein, 453 aa, Artificial Sequence
  anti-influenza_Chain
EVQLVQSGAEVKKPGESLKISCKVSGYSFTSQWIGWVRQMPGKGLEWIGMMYPGDADAIYSPSFQGQVTISADNSISTAYLQWSSLKASDTAIYYCASGPGYSGYHYGWFDTWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5280 - protein, 453 aa, Artificial Sequence; identical to SEQ ID NO: 1023
  anti-influenza_Chain

SEQ ID NO: 5281 - protein, 453 aa, Artificial Sequence
  anti-influenza_Chain
EVQLVQSGAEVKKPGESLKISCKVSGYSFTSQWIGWVRQMPGKGLEWIGMMYPGDADTIYSPSFQGQVTISADNSISTAYLQWSSLKASDTAIYYCASGPGYSGYHYGWFDTWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5282 - protein, 453 aa, Artificial Sequence
  anti-influenza_Chain
EVQLVQSGAEVKKPGESLKISCKVSGYSFTSQWIGWVRQMPGKGLEWIGMMYPGSSDTIYSPSFQGQVTISADNSISTAYLQWSSLKASDTAIYYCASGPGYSGYHYGWFDTWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5283 - protein, 453 aa, Artificial Sequence
  anti-influenza_Chain
EVQLVQSGAEVKKPGESLKISCKVSGYSFTSQWIGWVRQMPGKGLEWIGMMYPGDSDAIYSPSFQGQVTISADNSISTAYLQWSSLKASDTAIYYCASGPGYSGYHYGWFDTWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5284 - protein, 453 aa, Artificial Sequence
  anti-influenza_Chain
EVQLVQSGAEVKKPGESLKISCKVSGYSFTSQWIGWVRQMPGKGLEWIGMMYPGDTDTIYSPSFQGQVTISADNSISTAYLQWSSLKASDTAIYYCASGPGYSGYHYGWFDTWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5285 - protein, 453 aa, Artificial Sequence
  anti-influenza_Chain
EVQLVQSGAEVKKPGESLKISCKVSGYSFTSQWIGWVRQMPGKGLEWIGMMYPGESDTIYSPSFQGQVTISADNSISTAYLQWSSLKASDTAIYYCASGPGYSGYHYGWFDTWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5286 - protein, 453 aa, Artificial Sequence; identical to SEQ ID NO: 5274
  anti-influenza_Chain

SEQ ID NO: 5287 - protein, 453 aa, Artificial Sequence; identical to SEQ ID NO: 5275
  anti-influenza_Chain

SEQ ID NO: 5288 - protein, 453 aa, Artificial Sequence; identical to SEQ ID NO: 5276
  anti-influenza_Chain

SEQ ID NO: 5289 - protein, 453 aa, Artificial Sequence; identical to SEQ ID NO: 5277
  anti-influenza_Chain

SEQ ID NO: 5290 - protein, 453 aa, Artificial Sequence; identical to SEQ ID NO: 5278
  anti-influenza_Chain

SEQ ID NO: 5291 - protein, 453 aa, Artificial Sequence; identical to SEQ ID NO: 5279
  anti-influenza_Chain

SEQ ID NO: 5292 - protein, 453 aa, Artificial Sequence; identical to SEQ ID NO: 1023
  anti-influenza_Chain

SEQ ID NO: 5293 - protein, 453 aa, Artificial Sequence; identical to SEQ ID NO: 5281
  anti-influenza_Chain

SEQ ID NO: 5294 - protein, 453 aa, Artificial Sequence; identical to SEQ ID NO: 5282
  anti-influenza_Chain

SEQ ID NO: 5295 - protein, 453 aa, Artificial Sequence; identical to SEQ ID NO: 5283
  anti-influenza_Chain

SEQ ID NO: 5296 - protein, 453 aa, Artificial Sequence; identical to SEQ ID NO: 5284
  anti-influenza_Chain

SEQ ID NO: 5297 - protein, 453 aa, Artificial Sequence; identical to SEQ ID NO: 5285
  anti-influenza_Chain

SEQ ID NO: 5298 - protein, 455 aa, Artificial Sequence
  anti-influenza_Chain
QVQLVESGGGVVQPGRSLRLSCAASGFAFHNRAMHWVRQAPGKGLEWVALIYFDGSKQYYADSVKGRFTISRDNSKNTVFLQMNSLRPEDTAVYYCAVPGPIFGIFPPWSYFDHWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5299 - protein, 455 aa, Artificial Sequence
  anti-influenza_Chain
EVQLVESGGGVVQPGRSLRLSCAASGFAFHNRAMHWVRQAPGKGLEWVALIYFDGSKQYYADSVKGRFTISRDNSKNTVFLQMNSLRPEDTAVYYCAVPGPIFGIFPPWSYFDHWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5300 - protein, 455 aa, Artificial Sequence
  anti-influenza_Chain
EVQLVQSGGGVVQPGKSLRLSCAASGLTFSSYAVHWVRQAPGKGLEWVTLISYDGANQYYADSVKGRFTISRDNSKNTVYLQMNSLRPEDTAVYYCAVPGPVFGIFPPWSYFDNWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5301 - protein, 455 aa, Artificial Sequence
  anti-influenza_Chain
QVQLVESGGGVVQPGKSLRLSCAASGLTFSSYAVHWVRQAPGKGLEWVTLISYDGANQYYADSVKGRFTISRDNSKNTVYLQMNSLRPEDTAVYYCAVPGPVFGIFPPWSYFDNWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5302 - protein, 455 aa, Artificial Sequence
  anti-influenza_Chain
QVQLVESGGGVVQPGKSPRLSCAASGPTFSSYAVHWVRQAPGKGLEWVTLISYDGANQYYADSVKGRFTISRDNSKNTVYLQMNSLRPEDTAVYYCAVPGPVFGIFPPWSYFDNWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5303 - protein, 455 aa, Artificial Sequence; identical to SEQ ID NO: 1007
  anti-influenza_Chain

SEQ ID NO: 5304 - protein, 455 aa, Artificial Sequence
  anti-influenza_Chain
QVQLVQSGAELKRPGASVKVSCKTSGYSFNNYGINWVRQAPGQGLEWMGWISAYTGNTHYAKNFEGRVTLTTDTSTSTAYMEVRSLRSDDSAVYFCARAMIQGVVTLYLRPGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5305 - protein, 455 aa, Artificial Sequence; identical to SEQ ID NO: 5298
  anti-influenza_Chain

SEQ ID NO: 5306 - protein, 455 aa, Artificial Sequence; identical to SEQ ID NO: 5299
  anti-influenza_Chain

SEQ ID NO: 5307 - protein, 455 aa, Artificial Sequence; identical to SEQ ID NO: 5300
  anti-influenza_Chain

SEQ ID NO: 5308 - protein, 455 aa, Artificial Sequence; identical to SEQ ID NO: 5301
  anti-influenza_Chain

SEQ ID NO: 5309 - protein, 455 aa, Artificial Sequence; identical to SEQ ID NO: 5302
  anti-influenza_Chain

SEQ ID NO: 5310 - protein, 455 aa, Artificial Sequence; identical to SEQ ID NO: 1007
  anti-influenza_Chain

SEQ ID NO: 5311 - protein, 455 aa, Artificial Sequence; identical to SEQ ID NO: 5304
  anti-influenza_Chain

SEQ ID NO: 5312 - protein, 456 aa, Artificial Sequence
  anti-influenza_Chain
EVQLVQSGGGVVQPRRSLRLSCAASGFTFSSYAMHWVRQAPGKGLEWVAVISYDGRNKYYADSVKGRFTVSRDNSKNTLYLQMNSLRAEDTSVYYCARELLMDYYDHIGYSPGPTWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5313 - protein, 457 aa, Artificial Sequence
  anti-influenza_Chain
MVIQRNSILLLIIIFASSISTCRSNVIDDNLFKQVYDNILEQEFAHDFQAYLSYLSKNIESNNNIDKVDKNGIKVINVLSFGAKGDGKTYDNIAFEQAWNEACSSRTPVQFVVPKNKNYLLKQITFSGPCRSSISVKIFGSLEASSKISDYKDRRLWIAFDSVQNLVVGGGGTINGNGQVWWPSSCKINKSLPCRDAPTALTFWNCKNLKVNNLKSKNAQQIHIKFESCTNVVASNLMINASAKSPNTDGVHVSNTQYIQISDTIIGTGDDCISIVSGSQNVQATNITCGPGHGISIGSLGSGNSEAYVSNVTVNEAKIIGAENGVRIKTWQGGSGQASNIKFLNVEMQDVKYPIIIDQNYCDRVEPCIQQFSAVQVKNVVYENIKGTSATKVAIKFDCSTNFPCEGIIMENINLVGESGKPSEATCKNVHFNNAEHVTPHCTSLEISEDEALLYNY

SEQ ID NO: 5314 - protein, 457 aa, Artificial Sequence; identical to SEQ ID NO: 5313
  anti-influenza_Chain

SEQ ID NO: 5315 - protein, 460 aa, Artificial Sequence
  anti-influenza_Chain
MKLWLNWIFLVTLLNDIQCEVKLVESGGGLVQPGGSLRLSCATSGFTFSDYYMSWVRQSPGKALEWLGFTRSRVLGYTTDYSASVKGRFTISRDNSQSILYLQMNSLRGEDSATYYCARDRPMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 5316 - protein, 460 aa, Artificial Sequence; identical to SEQ ID NO: 5315
  anti-influenza_Chain

SEQ ID NO: 5317 - protein, 462 aa, Artificial Sequence
  anti-influenza_Chain
MEWSWIFLFLLSGTAGVHSEVQLQQSGPELVKPGASVKMSCKASGYTFTSYVMHWVKQKPGQGLEWIGYINPYNDGTRYNEKFRVKATLTSDKSSSTAYMELSSLTSEDSAVYYCARRGLITTPTLDYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 5318 - protein, 462 aa, Artificial Sequence
  anti-influenza_Chain
QVQLVQSGAEVKKPGASVKVSCKTSGYTFTAYTIHWVRQAPGQRLEWMGWINAGNGHTKYSQRFKGRVTITRDTSARTTYMELRSLTSEDTALYFCARGPETYYYDKTNWLNSHPDEYFQHWGHGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5319 - protein, 462 aa, Artificial Sequence; identical to SEQ ID NO: 5318
  anti-influenza_Chain

SEQ ID NO: 5320 - protein, 462 aa, Artificial Sequence; identical to SEQ ID NO: 5317
  anti-influenza_Chain

SEQ ID NO: 5321 - protein, 466 aa, Artificial Sequence
  anti-influenza_Chain
MLPSTVQTLTLLLTSGGVLLSLYVSASLSYLLYSDVLLKFSSTKTTAPTMSLECTNASNAQTVNHSATKEMTFPPPEPEWTYPRLSCQGSTFQKALLISPHRFGEIKGNSAPLIIREPFVACGPKECRHFALTHYAAQPGGYYNGTRKDRNKLRHLVSVKLGKIPTVENSIFHMAAWSGSACHDGREWTYIGVDGPDNDALVKIKYGEAYTDTYHSYAHNILRTQESACNCIGGDCYLMITDGSASGISKCRFLKIREGRIIKEILPTGRVEHTEECTCGFASNKTIECACRDNSYTAKRPFVKLNVETDTAEIRLMCTKTYLDTPRPDDGSIAGPCESNGDKWLGGIKGGFVHQRMASKIGRWYSRTMSKTNRMGMELYVKYDGDPWTDSDALTLSGVMVSIEEPGWYSFGFEIKDKKCDVPCIGIEMVHDGGKDTWHSAATAIYCLMGSGQLLWDTVTGVDMAL

SEQ ID NO: 5322 - protein, 466 aa, Artificial Sequence; identical to SEQ ID NO: 5321
  anti-influenza_Chain

SEQ ID NO: 5323 - protein, 469 aa, Artificial Sequence
  anti-influenza_Chain
MDWTWRFLFVVAAATGVQSQVQLVQSGAEVKKPGSSVKVSCKASGGTLNNYAISWVRQAPGQGLEWMGGISPIFGTLNYAERFQGRVTITADVFTNTVYMELSSLRSEDTAVYFCARGCGYNCYYFDGWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEGLHNHYTQKSLSLSPGK

SEQ ID NO: 5324 - protein, 469 aa, Artificial Sequence; identical to SEQ ID NO: 5323
  anti-influenza_Chain

SEQ ID NO: 5325 - protein, 469 aa, Artificial Sequence; identical to SEQ ID NO: 5323
  anti-influenza_Chain

SEQ ID NO: 5326 - protein, 471 aa, Artificial Sequence
  anti-influenza_Chain
DGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKKGYIPEAPRDGQAYVRKDGEWVLLSTFLRSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5327 - protein, 471 aa, Artificial Sequence; identical to SEQ ID NO: 5326
  anti-influenza_Chain

SEQ ID NO: 5328 - protein, 472 aa, Artificial Sequence
  anti-influenza_Chain
MDWTWRFLFVVAAATGVQCQVQLVQSGAEVKMPGSSVKVSCKTSGVFFSSHAISWVRQAPGQGLEWMGGISPMFGTTHYAQKFQGRVTITADQSTTTAYMELTSLTSEDTAVYYCARDGAGSYYPLNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEGLHNHYTQKSLSLSPGK

SEQ ID NO: 5329 - protein, 472 aa, Artificial Sequence; identical to SEQ ID NO: 5328
  anti-influenza_Chain

SEQ ID NO: 5330 - protein, 472 aa, Artificial Sequence; identical to SEQ ID NO: 5328
  anti-influenza_Chain

SEQ ID NO: 5331 - protein, 473 aa, Artificial Sequence
  anti-influenza_Chain
MTESAMTSRAGRGRGADLVAAVVQGHAAASDAAGDLSFPDGFIWGAATAAYQIEGAWREDGRGLWDVFSHTPGKVASGHTGDIACDHYHRYADDVRLMAGLGDRVYRFSVAWPRIVPDGSGPVNPAGLDFYDRLVDELLGHGITPYPTLYHWDLPQTLEDRGGWAARDTAYRFAEYALAVHRRLGDRVRCWITLNEPWVAAFLATHRGAPGAADVPRFRAVHHLLLGHGLGLRLRSAGAGQLGLTLSLSPVIEARPGVRGGGRRVDALANRQFLDPALRGRYPEEVLKIMAGHARLGHPGRDLETIHQPVDLLGVNYYSHVRLAAEGEPANRLPGSEGIRFERPTAVTAWPGDRPDGLRTLLLRLSRDYPGVGLIITENGAAFDDRADGDRVHDPERIRYLTATLRAVHDAIMAGADLRGYFVWSVLDNFEWAYGYHKRGIVYVDYTTMRRIPRESALWYRDVVRRNGLRNGE

SEQ ID NO: 5332 - protein, 473 aa, Artificial Sequence; identical to SEQ ID NO: 5331
  anti-influenza_Chain

SEQ ID NO: 5333 - protein, 474 aa, Artificial Sequence
  anti-influenza_Chain
LSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKKGDSAIVKSEVEYGNCNTKCQTPIGAINSSMPFHNIHPLTIGECPKYVKSNKLVLATGLRNSPLGYIPEAPRDGQAYVRKDGEWVLLSTFLRSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5334 - protein, 474 aa, Artificial Sequence; identical to SEQ ID NO: 5333
  anti-influenza_Chain

SEQ ID NO: 5335 - protein, 476 aa, Artificial Sequence
  anti-influenza_Chain
MEFGLSWVFLVALLRGVQCQVQLVESGGGVVQPGRSLRLSCAASGFTFSRFGIHWVRQAPGKGLEWMAVIWYDGSNKFYADSVKGRFTISRDNSKNTVYLQMNSLRAEDTAVYYCAKDSRGYCSSIICFEGGLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEGLHNHYTQKSLSLSPGK

SEQ ID NO: 5336 - protein, 476 aa, Artificial Sequence; identical to SEQ ID NO: 5335
  anti-influenza_Chain

SEQ ID NO: 5337 - protein, 476 aa, Artificial Sequence; identical to SEQ ID NO: 5335
  anti-influenza_Chain

SEQ ID NO: 5338 - protein, 480 aa, Artificial Sequence
  anti-influenza_Chain
MPSVKIGIIGAGSAVFSLRLVSDLCKTPGLSGSTVTLMDIDEERLDAILTIAKKYVEEVGADLKFEKTMNLDDVIIDADFVINTAMVGGHTYLEKVRQIGEKYGYYRGIDAQEFNMVSDYYTFSNYNQLKYFVDIARKIEKLSPKAWYLQAANPIFEGTTLVTRTVPIKAVGFCHGHYGVMEIVEKLGLEEEKVDWQVAGVNHGIWLNRFRYNGGNAYPLLDKWIEEKSKDWKPENPFNDQLSPAAIDMYRFYGVMPIGDTVRNSSWRYHRDLETKKKWYGEPWGGADSEIGWKWYQDTLGKVTEITKKVAKFIKENPSVRLSDLGSVLGKDLSEKQFVLEVEKILDPERKSGEQHIPFIDALLNDNKARFVVNIPNKGIIHGIDDDVVVEVPALVDKNGIHPEKIEPPLPDRVVKYYLRPRIMRMEMALEAFLTGDIRIIKELLYRDPRTKSDEQVEKVIEEILALPENEEMRKHYLKR

SEQ ID NO: 5339 - protein, 480 aa, Artificial Sequence; identical to SEQ ID NO: 5338
  anti-influenza_Chain

SEQ ID NO: 5340 - protein, 481 aa, Artificial Sequence
  anti-influenza_Chain
MKFPKDFMIGYSSSPFQFEAGIPGSEDPNSDWWVWVHDPENTAAGLVSGDFPENGPGYWNLNQNDHDLAEKLGVNTIRVGVEWSRIFPKPTFNVKVPVERDENGSIVHVDVDDKAVERLDELANKEAVNHYVEMYKDWVERGRKLILNLYHWPLPLWLHNPIMVRRMGPDRAPSGWLNEESVVEFAKYAAYIAWKMGELPVMWSTMNEPNVVYEQGYMFVKGGFPPGYLSLEAADKARRNMIQAHARAYDNIKRFSKKPVGLIYAFQWFELLEGPAEVFDKFKSSKLYYFTDIVSKGSSIINVEYRRDLANRLDWLGVNYYSRLVYKIVDDKPIILHGYGFLCTPGGISPAENPCSDFGWEVYPEGLYLLLKELYNRYGVDLIVTENGVSDSRDALRPAYLVSHVYSVWKAANEGIPVKGYLHWSLTDNYEWAQGFRQKFGLVMVDFKTKKRYLRPSALVFREIATHNGIPDELQHLTLIQ

SEQ ID NO: 5341 - protein, 481 aa, Artificial Sequence; identical to SEQ ID NO: 5340
  anti-influenza_Chain

SEQ ID NO: 5342 - protein, 488 aa, Artificial Sequence
  anti-influenza_Chain
HAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKKGYIPEAPRDGQAYVRKDGEWVLLSTFLRSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5343 - protein, 488 aa, Artificial Sequence; identical to SEQ ID NO: 5342
  anti-influenza_Chain

SEQ ID NO: 5344 - protein, 491 aa, Artificial Sequence
  anti-influenza_Chain
MLSFPKGFKFGWSQSGFQSEMGTPGSEDPNSDWHVWVHDRENIVSQVVSGDLPENGPGYWGNYKRFHDEAEKIGLNAVRINVEWSRIFPRPLPKPEMQTGTDKENSPVISVDLNESKLREMDNYANHEALSHYRQILEDLRNRGFHIVLNMYHWTLPIWLHDPIRVRRGDFTGPTGWLNSRTVYEFARFSAYVAWKLDDLASEYATMNEPNVVWGAGYAFPRAGFPPNYLSFRLSEIAKWNIIQAHARAYDAIKSVSKKSVGIIYANTSYYPLRPQDNEAVEIAERLNRWSFFDSIIKGEITSEGQNVREDLRNRLDWIGVNYYTRTVVTKAESGYLTLPGYGDRCERNSLSLANLPTSDFGWEFFPEGLYDVLLKYWNRYGLPLYVMENGIADDADYQRPYYLVSHIYQVHRALNEGVDVRGYLHWSLADNYEWSSGFSMRFGLLKVDYLTKRLYWRPSALVYREITRSNGIPEELEHLNRVPPIKPLRH

SEQ ID NO: 5345 - protein, 491 aa, Artificial Sequence; identical to SEQ ID NO: 5344
  anti-influenza_Chain

SEQ ID NO: 5346 - protein, 498 aa, Artificial Sequence
  anti-influenza_Chain
MASQGTKRSYEQMETDGERQNATEIRASVGKMIGGIGRFYIQMCTELKLSDYEGRLIQNSLTIERMVLSAFDERRNKYLEEHPSAGKDPKKTGGPIYRRVNGKWMRELILYDKEEIRRIWRQANNGDDATAGLTHMMIWHSNLNDATYQRTRALVRTGMDPRMCSLMQGSTLPRRSGAAGAAVKGVGTMVMELVRMIKRGINDRNFWRGENGRKTRIAYERMCNILKGKFQTAAQKAMMDQVRESRDPGNAEFEDLTFLARSALILRGSVAHKSCLPACVYGPAVASGYDFEREGYSLVGIDPFRLLQNSQVYSLIRPNENPAHKSQLVWMACHSAAFEDLRVLSFIKGTKVVPRGKLSTRGVQIASNENMETMESSTLELRSRYWAIRTRSGGNTNQQRASAGQISIQPTFSVQRNLPFDRTTVMAAFTGNTEGRTSDMRTEIIRMMESARPEDVSFQGRGVFELSDEKAASPIVPSFDMSNEGSYFFGDNAEEYDN

SEQ ID NO: 5347 - protein, 498 aa, Artificial Sequence
  anti-influenza_Chain
MASQGTKRSYEQMETDGERQNATEIRASVGKMIDGIGRFYIQMCTELKLSDYEGRLIQNSLTIERMVLSAFDERRNKYLEEHPSAGKDPKKTGGPIYKRVDGKWMRELVLYDKEEIRRIWRQANNGDDATAGLTHMMIWHSNLNDTTYQRTRALVRTGMDPRMCSLMQGSTLPRRSGAAGAAVKGVGTMVMELIRMIKRGINDRNFWRGENGRKTRSAYERMCNILKGKFQTAAQRAMMDQVRESRNPGNAEIEDLIFLARSALILRGSVAHKSCLPACVYGPAIASGYNFEKEGYSLVGIDPFKLLQNSQVYSLIRPNENPAHKSQLVWMACNSAAFEDLRVLSFIRGTKVSPRGKLSTRGVQIASNENMDTMESSTLELRSRYWAIRTRSGGNTNQQRASAGQISVQPAFSVQRNLPFDKPTIMAAFTGNTEGRTSDMRAEIIRMMEGAKPEEMSFQGRGVFELSDEKATNPIVPSFDMSNEGSYFFGDNAEEYDN

SEQ ID NO: 5348 - protein, 498 aa, Artificial Sequence
  anti-influenza_Chain
MASQGTKRSYEQMETGGERQNATEIRASVGRMVGGIGRFYVQMCTELKLSDQEGRLIQNSITIERMVLSAFDERRNRYLEEHPSAGKDPKKTGGPIYRRRDGKWVRELILYDKEEIRRIWRQANNGEDATAGLTHMMIWHSNLNDATYQRTRALVRTGMDPRMCSLMQGSTLPRRSGAAGAAIKGVGTMVMELIRMIKRGINDRNFWRGDNGRRTRIAYERMCNILKGKFQTAAQRAMMDQVRESRNPGNAEIEDLIFLARSALILRGSVAHKSCLPACVYGLAVASGYDFEREGYSLVGIDPFRLLQNSQVFSLIRPNENPAHKSQLVWMACHSAAFEDLRVSSFIRGTRVIPRGQLSTRGVQIASNENVEAMDSSTLELRSRYWAIRTRSGGNTNQQRASAGQISVQPTFSVQRNLPFERPTIMAAFKGNTEGRTSDMRTEIIRMMESARPEDVSFQGRGVFELSDEKATNPIVPSFDMSNEGSYFFGDNAEEYDN

SEQ ID NO: 5349 - protein, 498 aa, Artificial Sequence; identical to SEQ ID NO: 5346
  anti-influenza_Chain

SEQ ID NO: 5350 - protein, 498 aa, Artificial Sequence; identical to SEQ ID NO: 5347
  anti-influenza_Chain

SEQ ID NO: 5351 - protein, 498 aa, Artificial Sequence; identical to SEQ ID NO: 5348
  anti-influenza_Chain

SEQ ID NO: 5352 - protein, 510 aa, Artificial Sequence
  anti-influenza_Chain
MFPEKFLWGVAQSGFQFEMGDKLRRNIDTNTDWWHWVRDKTNIEKGLVSGDLPEEGINNYELYEKDHEIARKLGLNAYRIGIEWSRIFPWPTTFIDVDYSYNESYNLIEDVKITKDTLEELDEIANKREVAYYRSVINSLRSKGFKVIVNLNHFTLPYWLHDPIEARERALTNKRNGWVNPRTVIEFAKYAAYIAYKFGDIVDMWSTFNEPMVVVELGYLAPYSGFPPGVLNPEAAKLAILHMINAHALAYRQIKKFDTEKADKDSKEPAEVGIIYNNIGVAYPKDPNDSKDVKAAENDNFFHSGLFFEAIHKGKLNIEFDGETFIDAPYLKGNDWIGVNYYTREVVTYQEPMFPSIPLITFKGVQGYGYACRPGTLSKDDRPVSDIGWELYPEGMYDSIVEAHKYGVPVYVTENGIADSKDILRPYYIASHIKMTEKAFEDGYEVKGYFHWALTDNFEWALGFRMRFGLYEVNLITKERIPREKSVSIFREIVANNGVTKKIEEELLRG

SEQ ID NO: 5353 - protein, 510 aa, Artificial Sequence; identical to SEQ ID NO: 5352
  anti-influenza_Chain

SEQ ID NO: 5354 - protein, 512 aa, Artificial Sequence
  anti-influenza_Chain
MKRKVKKMAAMATSIIMAIMIILHSIPVLAGRIIYDNETGTHGGYDYELWKDYGNTIMELNDGGTFSCQWSNIGNALFRKGRKFNSDKTYQELGDIVVEYGCDYNPNGNSYLCVYGWTRNPLVEYYIVESWGSWRPPGATPKGTITQWMAGTYEIYETTRVNQPSIDGTATFQQYWSVRTSKRTSGTISVTEHFKQWERMGMRMGKMYEVALTVEGYQSSGYANVYKNEIRIGANPTPAPSQSPIRRDAFSIIEAEEYNSTNSSTLQVIGTPNNGRGIGYIENGNTVTYSNIDFGSGATGFSATVATEVNTSIQIRSDSPTGTLLGTLYVSSTGSWNTYQTVSTNISKITGVHDIVLVFSGPVNVDNFIFSRSSPVPAPGDNTRDAYSIIQAEDYDSSYGPNLQIFSLPGGGSAIGYIENGYSTTYKNIDFGDGATSVTARVATQNATTIQVRLGSPSGTLLGTIYVGSTGSFDTYRDVSATISNTAGVKDIVLVFSGPVNVDWFVFSKSGT

SEQ ID NO: 5355 - protein, 512 aa, Artificial Sequence; identical to SEQ ID NO: 5354
  anti-influenza_Chain

SEQ ID NO: 5356 - protein, 513 aa, Artificial Sequence
  anti-influenza_Chain
ICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKKGYIPEAPRDGQAYVRKDGEWVLLSTFLRSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5357 - protein, 513 aa, Artificial Sequence; identical to SEQ ID NO: 5356
  anti-influenza_Chain

SEQ ID NO: 5358 - protein, 531 aa, Artificial Sequence
  anti-influenza_Chain
TLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGA

SEQ ID NO: 5359 - protein, 531 aa, Artificial Sequence
  anti-influenza_Chain
TLCIGYHANNSTDTVDTVLEKNVTVTHSVNLLEDKHNGKLCKLRGVAPLHLGKCNIAGWILGNPECESLSTASSWSCIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGA

SEQ ID NO: 5360 - protein, 531 aa, Artificial Sequence
  anti-influenza_Chain
TLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPNTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGA

SEQ ID NO: 5361 - protein, 531 aa, Artificial Sequence
  anti-influenza_Chain
TLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFGPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGA

SEQ ID NO: 5362 - protein, 531 aa, Artificial Sequence; identical to SEQ ID NO: 5358
  anti-influenza_Chain

SEQ ID NO: 5363 - protein, 531 aa, Artificial Sequence; identical to SEQ ID NO: 5359
  anti-influenza_Chain

SEQ ID NO: 5364 - protein, 531 aa, Artificial Sequence; identical to SEQ ID NO: 5360
  anti-influenza_Chain

SEQ ID NO: 5365 - protein, 531 aa, Artificial Sequence; identical to SEQ ID NO: 5361
  anti-influenza_Chain

SEQ ID NO: 5366 - protein, 535 aa, Artificial Sequence
  anti-influenza_Chain
ANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGA

SEQ ID NO: 5367 - protein, 535 aa, Artificial Sequence
  anti-influenza_Chain
ANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPRAGAKGFYKNLIWLVKKGNSYPKLNKSYINDKGKEVLVLWGIHHPSTTADQQSLYQNADTYVFVGTSRYSKKFKPEIEIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVDKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGA

SEQ ID NO: 5368 - protein, 535 aa, Artificial Sequence; identical to SEQ ID NO: 5366
  anti-influenza_Chain

SEQ ID NO: 5369 - protein, 535 aa, Artificial Sequence; identical to SEQ ID NO: 5367
  anti-influenza_Chain

SEQ ID NO: 5370 - protein, 548 aa, Artificial Sequence
  anti-influenza_Chain
QKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFPYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNI

SEQ ID NO: 5371 - protein, 548 aa, Artificial Sequence; identical to SEQ ID NO: 5370
  anti-influenza_Chain

SEQ ID NO: 5372 - protein, 549 aa, Artificial Sequence
  anti-influenza_Chain
MLTFHRIIRKGWMFLLAFLLTALLFCPTGQPAKAAAPFNGTMMQYFEWYLPDDGTLWTKVANEANNLSSLGITALWLPPAYKGTSRSDVGYGVYDLYDLGEFNQKGAVRTKYGTKAQYLQAIQAAHAAGMQVYADVVFDHKGGADGTEWVDAVEVNPSDRNQEISGTYQIQAWTKFDFPGRGNTYSSFKWRWYHFDGVDWDESRKLSRIYKFRGIGKAWDWEVDTENGNYDYLMYADLDMDHPEVVTELKSWGKWYVNTTNIDGFRLDAVKHIKFSFFPDWLSDVRSQTGKPLFTVGEYWSYDINKLHNYIMKTNGTMSLFDAPLHNKFYTASKSGGTFDMRTLMTNTLMKDQPTLAVTFVDNHDTEPGQALQSWVDPWFKPLAYAFILTRQEGYPCVFYGDYYGIPQYNIPSLKSKIDPLLIARRDYAYGTQHDYLDHSDIIGWTREGVTEKPGSGLAALITDGPGGSKWMYVGKQHAGKVFYDLTGNRSDTVTINSDGWGEFKVNGGSVSVWVPRKTTVSTIAWSITTRPWTDEFVRWTEPRLVAWP

SEQ ID NO: 5373 - protein, 549 aa, Artificial Sequence
  anti-influenza_Chain
ICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKKGDSAIVKSEVEYGNCNTKCQTPIGAINSSMPFHNIHPLTIGECPKYVKSNKLVLATGLRNSPLRSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5374 - protein, 549 aa, Artificial Sequence; identical to SEQ ID NO: 5373
  anti-influenza_Chain

SEQ ID NO: 5375 - protein, 549 aa, Artificial Sequence; identical to SEQ ID NO: 5372
  anti-influenza_Chain

SEQ ID NO: 5376 - protein, 550 aa, Artificial Sequence
  anti-influenza_Chain
DQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWAILKPNDAINFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNPQYSEEARLKREEISGVKLESIGTYQILSIYSTVASSLALAIMIAGLSLWMCSNGSLQCRICI

SEQ ID NO: 5377 - protein, 550 aa, Artificial Sequence; identical to SEQ ID NO: 5376
  anti-influenza_Chain

SEQ ID NO: 5378 - protein, 552 aa, Artificial Sequence
  anti-influenza_Chain
MNIQILAFIACVLTGAKGDKICLGHHAVANGTKVNTLTEKGIEVVNATETVETADVKKICTQGKRATDLGRCGLLGTLIGPPQCDQFLEFSSDLIIERREGTDVCYPGRFTNEESLRQILRRSGGIGKESMGFTYSGIRTNGAASACTRSGSSFYAEMKWLLSNSDNSAFPQMTKAYRNPRNKPALIIWGVHHSESASEQTKLYGSGNKLITVRSSKYQQSFTPSPGTRRIDFHWLLLDPNDTVTFTFNGAFIAPDRASFFRGESLGVQSDAPLDSSCRGDCFHSGGTIVSSLPFQNINSRTVGRCPRYVKQKSLLLATGMRNVPEKPKPRGLFGAIAGFIENGWEGLINGWYGFRHQNAQGEGTAADYKSTQSAIDQITGKLNRLIGKTNQQFELIDNEFNEIEQQIGNVINWTRDAMTEIWSYNAELLVAMENQHTIDLADSEMSKLYERVKKQLRENAEEDGTGCFEIFHKCDDQCMESIRNNTYDHTQYRTESLQNRIQIDPVKLSSGYKDIILWFSFGASCFILLAIAMGLVFICIKNGNMQCTICI

SEQ ID NO: 5379 - protein, 552 aa, Artificial Sequence
  anti-influenza_Chain
MNTQILAFIACVLTGVKGDKICLGHHAVANGTKVNTLTEKGIEVVNATETVETADVKKICTQGKRATDLGRCGLLGTLIGPPQCDQFLEFSSDLIIERREGTDVCYPGRFTNEESLRQILRRSGGIGKESMGFTYSGIRTNGATSACTRSGSSFYAEMKWLLSNSDNSAFPQMTKAYRNPRNKPALIIWGVHHSESVSEQTKLYGSGNKLITVRSSKYQQSFTPSPGARRIDFHWLLLDPNDTVTFTFNGAFIAPDRASFFRGESLGVQSDVPLDSSCRGDCFHSGGTIVSSLPFQNINSRTVGKCPRYVKQKSLLLATGMRNVPEKPKPRGLFGAIAGFIENGWEGLINGWYGFRHQNAQGEGTAADYKSTQSAIDQITGKLNRLIGKTNQQFELIDNEFNEIEQQIGNVINWTRDAMTEIWSYNAELLVAMENQHTIDLADSEMSKLYERVKKQLRENAEEDGTGCFEIFHKCDDQCMESIRNNTYDHTQYRTESLQNRIQIDPVKLSSGYKDIILWFSFGASCFLLLAIAMGLVFICIKNGNMQCTICI

SEQ ID NO: 5380 - protein, 552 aa, Artificial Sequence
  anti-influenza_Chain
MNIQILAFIACVLTGAKGDKICLGHHAVANGTKVNTLTEKGIEVVNATETVETANIKKICTQGKRPTDLGQCGLLGTLIGPPQCDQFLEFSSDLIIERREGTDVCYPGKFTNEESLRQILRRSGGIGKESMGFTYSGIRTNGATSACTRSGSSFYAEMKWLLSNSDNAAFPQMTKSYRNPRNKPALIIWGVHHSESVSEQTKLYGSGNKLIKVRSSKYQQSFTPNPGARRIDFHWLLLDPNDTVTFTFNGAFIAPDRASFFRGESIGVQSDAPLDSSCGGNCFHNGGTIVSSLPFQNINPRTVGKCPRYVKQKSLLLATGMRNVPEKPKKRGLFGAIAGFIENGWEGLINGWYGFRHQNAQGEGTAADYKSTQSAIDQITGKLNRLIGKTNQQFELINNEFNEVEQQIGNVINWTQDAMTEVWSYNAELLVAMENQHTIDLTDSEMSKLYERVRKQLRENAEEDGTGCFEIFHKCDDHCMESIRNNTYDHTQYRTESLQNRIQIDPVKLSGGYKDIILWFSFGASCFLLLAIAMGLVFICIKNGNMQCTICI

SEQ ID NO: 5381 - protein, 552 aa, Artificial Sequence
  anti-influenza_Chain
DQICIGYHANNSTEQVDTIMEKNVTVTHAQNILEKTHNGKLCDLDGVKPLILRDCSVAGWLLGNPMCDEFLNVPEWSYIVEKINPANDLCYPGNFNDYEELKHLLSRINHFEKIQIIPKSSWSDHEASSGVSSACPYQGRSSFFRNVVWLIKKDNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSNKLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKIRLQLRDNAKELGNGCFEFYHRCDNECMESVRNGTYDYPQYSEEARLKREEISGVKLESIGTYQILSIYSTVASSLTLAIMVAGLSLWMCSNGSLQCRICI

SEQ ID NO: 5382 - protein, 552 aa, Artificial Sequence
  anti-influenza_Chain
DQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILNPNDAINFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQILSIYSTVASSLALAIMMAGLSLWMCSNGSLQCRICI

SEQ ID NO: 5383 - protein, 552 aa, Artificial Sequence; identical to SEQ ID NO: 5378
  anti-influenza_Chain

SEQ ID NO: 5384 - protein, 552 aa, Artificial Sequence; identical to SEQ ID NO: 5379
  anti-influenza_Chain

SEQ ID NO: 5385 - protein, 552 aa, Artificial Sequence; identical to SEQ ID NO: 5380
  anti-influenza_Chain

SEQ ID NO: 5386 - protein, 552 aa, Artificial Sequence; identical to SEQ ID NO: 5381
  anti-influenza_Chain

SEQ ID NO: 5387 - protein, 552 aa, Artificial Sequence; identical to SEQ ID NO: 5382
  anti-influenza_Chain

SEQ ID NO: 5388 - protein, 560 aa, Artificial Sequence
  anti-influenza_Chain
MSNMDIDSINTGTIDKTPEELTPGTSGATRPIIKPATLAPPSNKRTRNPSPERTTTSSETDIGRKIQKKQTPTEIKKSVYKMVVKLGEFYNQMMVKAGLNDDMERNLIQNAQAVERILLAATDDKKTEYQKKRNARDVKEGKEEIDHNKTGGTFYKMVRDDKTIYFSPIKITFLKEEVKTMYKTTMGSDGFSGLNHIMIGHSQMNDVCFQRSKGLKRVGLDPSLISTFAGSTLPRRSGTTGVAIKGGGTLVDEAIRFIGRAMADRGLLRDIKAKTAYEKILLNLKNKCSAPQQKALVDQVIGSRNPGIADIEDLTLLARSMVVVRPSVASKVVLPISIYAKIPQLGFNTEEYSMVGYEAMALYNMATPVSILRMGDDAKDKSQLFFMSCFGAAYEDLRVLSALTGTEFKPRSALKCKGFHVPAKEQVEGMGAALMSIKLQFWAPMTRSGGNEVSGEGGSGQISCSPVFAVERPIALSKQAVRRMLSMNVEGRDADVKGNLLKMMNDSMAKKTSGNAFIGKKMFQISDKNKVNPIEIPIKQTIPNFFFGRDTAEDYDDLDY

SEQ ID NO: 5389 - protein, 560 aa, Artificial Sequence
  anti-influenza_Chain
MNTQILALIAYMLIGAKGDKICLGHHAVANGTKVNTLTERGIEVVNATETVETVNIKKICTQGKRPTDLGQCGLLGTLIGPPQCDQFLEFDADLIIERREGTDVCYPGKFTNEESLRQILRGSGGIDKESMGFTYSGIRTNGVTSACRRSGSSFYAEMKWLLSNSDNAAFPQMTKSYRNPRNKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDVPLDSGCEGDCFHSRGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELIDNEFSEIEQQIGNVINWTRDSMTEVWSYNAELLVAMENQHTIDLADSEMNKLYERVRKQLRENAEEDGTGCFEIFHKCDDQCMESIRNNTYDHTQYRTESLQNRIQIDPVKLSSGYKDIILWFSFGASCFLLLAIAMGLVFICIKNGNMRCTICI

SEQ ID NO: 5390 - protein, 560 aa, Artificial Sequence
  anti-influenza_Chain
MNTQILALIACMLIGAKGDKICLGHHAVANGTKVNTLTERGIEVVNATETVETANIKKICTQGKRPTDLGQCGLLGTLIGPPQCDQFLEFDADLIIERREGTDVCYPGKFTNEESLRQILRGSGGIDKESMGFTYSGIRTNGATSACRRSGSSFYAEMKWLLSNSDNAAFPQMTKSYRNPRNKPALIIWGVHHSGSATEQTKLYGSGNKLITVGSSKYQQSFTPSPGARPQVNGQSGRIDFHWLLLDPNDTVTFTFNGAFIAPDRASFFRGGSLGVQSDVPLDSGCEGDCFHSGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELIDNEFNEIEQQIGNVINWTRDSMTEVWSYNAELLVAMENQHTIDLADSEMNKLYERVRKQLRENAEEDGTGCFEIFHKCDDQCMESIRNNTYDHTQYRTESLQNRIQINPVKLSSGYKDIILWFSFGASCFLLLAIAMGLVFICIKNGNMRCTICI

SEQ ID NO: 5391 - protein, 560 aa, Artificial Sequence
  anti-influenza_Chain
MERIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGNFNDYEELKHLLSRINHFERIQIIPKSSWSDHEASSGVSSACPYQGRSSFFRNVVWLIKKNNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKNCQKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNG

SEQ ID NO: 5392 - protein, 560 aa, Artificial Sequence; identical to SEQ ID NO: 5388
  anti-influenza_Chain

SEQ ID NO: 5393 - protein, 560 aa, Artificial Sequence; identical to SEQ ID NO: 5389
  anti-influenza_Chain

SEQ ID NO: 5394 - protein, 560 aa, Artificial Sequence; identical to SEQ ID NO: 5390
  anti-influenza_Chain

SEQ ID NO: 5395 - protein, 560 aa, Artificial Sequence; identical to SEQ ID NO: 5391
  anti-influenza_Chain

SEQ ID NO: 5396 - protein, 562 aa, Artificial Sequence
  anti-influenza_Chain
MPRALRRVPGSRVMLRVGVVVAVLALVAALANLAVPRPARAAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 5397 - protein, 562 aa, Artificial Sequence
  anti-influenza_Chain
MERVWWKEAVVYQIYPRSFYDSNGDGIGDIRGIIAKLDYLKELGVDVVWLSPVYKSPNDDNGYDISDYRDIMDEFGTMADWKTMLEEMHKRGIKLVMDLVVNHTSDEHPWFIESRKSKDNPYRDYYIWRPGKNGKEPNNWESVFSGSAWEYDEMTGEYYLHLFSKKQPDLNWENPKVRREVYEMMKFWLDKGVDGFRMDVINMISKVPELPDGEPQSGKKYASGSRYYMNGPRVHEFLQEMNREVLSKYDIMTVGETPGVTPKEGILYTDPSRRELNMVFQFEHMDLDSGPGGKWDIRPWSLADLKKTMTKWQKELEGKGWNSLYLNNHDQPRAVSRFGDDGKYRVESAKMLATFLHMMQGTPYIYQGEEIGMTNVRFPSIEDYRDIETLNMYKERVEEYGEDPQEVMEKIYYKGRDNARTPMQWDDSENAGFTAGTPWIPVNPNYKEINVKAALEDPNSVFHYYKKLIQLRKQHDIIVYGTYDLILEDDPYIYRYTRTLGNEQLIVITNFSEKTPVFRLPDHIIYKTKELLISNYDVDEAEELKEIRLRPWEARVYKIRLP

SEQ ID NO: 5398 - protein, 562 aa, Artificial Sequence; identical to SEQ ID NO: 5396
  anti-influenza_Chain

SEQ ID NO: 5399 - protein, 562 aa, Artificial Sequence; identical to SEQ ID NO: 5397
  anti-influenza_Chain

SEQ ID NO: 5400 - protein, 563 aa, Artificial Sequence
  anti-influenza_Chain
MEKIVLLFAIVSLVKSDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKTSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRETRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRIC

SEQ ID NO: 5401 - protein, 563 aa, Artificial Sequence; identical to SEQ ID NO: 5400
  anti-influenza_Chain

SEQ ID NO: 5402 - protein, 564 aa, Artificial Sequence
  anti-influenza_Chain
MEKIVLLFAIVSLVKSDQICIGYHANNSTEQVDTIMEKNVTVTHAQDILEKTHNGKLCSLNGVKPLILRDCSVAGWLLGNPMCDEFLNVPEWSYIVEKDSPINGLCYPGDFNDYEELKHLLSSTNHFEKIQIIPRSSWSDHDASSGVSSACPYNGRSSFFRNVVWLIKKNNAYPTIKRNYNNTNQEDLLVLWGIHHPNDATEQTKLYQNPTTYVSVGTSTLNQRSVPEIATRPKVNGQSGRIEFFWTILKPNDAINFESNGNFIAPEYAYKIAKKGDSAIMKSGLEYGNCNTKCQTPMGAINSSMPFHNIHPLTIGECPRYVKSDRLVLATGLRNVPQRETRGLFGAIAGFIEGGWQGMVDGWYGYHHSNEQGSGYAADKESTQKAIDGITNKVNSIIDKMNTQFEAVGKEFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLNREEISGVKLESIGTYQILSIYSTVASSLALAIMVAGLSFWMCSNGSLQCRICI

SEQ ID NO: 5403 - protein, 564 aa, Artificial Sequence; identical to SEQ ID NO: 5402
  anti-influenza_Chain

SEQ ID NO: 5404 - protein, 565 aa, Artificial Sequence
  anti-influenza_Chain
MEKIVLLFAIVSLVKSDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCR

SEQ ID NO: 5405 - protein, 565 aa, Artificial Sequence
  anti-influenza_Chain
MEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCR

SEQ ID NO: 5406 - protein, 565 aa, Artificial Sequence
  anti-influenza_Chain
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGKSSFFRNVVWLIKKNSSYPTIKRSYNNTNQEDLLVLWGIHHPNDAAEQTRLYQNPTTYISVGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCR

SEQ ID NO: 5407 - protein, 565 aa, Artificial Sequence
  anti-influenza_Chain
MSDRRQNRKTPDEQRKANALIINENIEAYIAICKEVGLNGDEMLILENGIAIEKAIRICCDGKYQEKREKKAREAQRADSNFNADSIGIRLVKRAGSGTNITYHAVVELTSRSRIVQILKSHWGNELNRAKIAGKRLGFSALFASNLEAIIYQRGRNAARRNGSAELFTLTQGAGIETRYKWIMEKHIGIGVLIADAKGLINGKREGKRGVDANVKLRAGTTGSPLERAMQGIEKKAFPGPLRALARRVVKANYNDAREALNVIAEASLLLKPQITNKMTMPWCMWLAARLTLKDEFANFCAYAGRRAFEVFNIAMEKIGICSFQGTIMNDDEIESIEDKAQVLMMACFGLAYEDFSLVSAMVSHPLKLRNRMKIGNFRVGEKVSTVLSPLLRFTRWAEFAQRFALQANTSREGAQISNSAVFAVERKITTDVQRVEELLNKVQAHEDEPLQTLYKKVREQISIIGRNKSEIKEFLGSSMYDLNDQEKQNPINFRSGAHPFFFEFDPDYNPIRVKRPKKPIAKRNSNISRLEEEGMDENSEIGQAKKMKPLDQLTSTSSNIPGKN

SEQ ID NO: 5408 - protein, 565 aa, Artificial Sequence
  anti-influenza_Chain
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYHWTLLEPGDTIIFEANGNLIAPRYAFTLSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5409 - protein, 565 aa, Artificial Sequence
  anti-influenza_Chain
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5410 - protein, 565 aa, Artificial Sequence
  anti-influenza_Chain
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPDIGDQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5411 - protein, 565 aa, Artificial Sequence
  anti-influenza_Chain
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5412 - protein, 565 aa, Artificial Sequence
  anti-influenza_Chain
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 5413 - protein, 565 aa, Artificial Sequence
  anti-influenza_Chain
MKVKLLVLLCTFTATYADTICIGYHANNSTDTVDTVLEKNVTVTHSVNLLEDSHNGKLCLLKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5414 - protein, 559 aa, Artificial Sequence
  anti-influenza_Chain
DKICIGYQSTNSTETVDTLTKTNVPVTQAKELLHTEHNGMLCATNLGHPLILDTCTIEGLIYGNPSCDLLLGGREWSYIVERPSAVNGMCYPGNVENLEELRLLFSSASSYQRVQIFPDTIWNVTYSGTSSACSNSFYRSMRWLTQKDNTYPVQDAQYTNNRGKSILFMWGINHPPTDTVQTNLYTRTDTTTSVTTEDINRAFKPVIGPRPLVNGLQGRIDYYWSVLKPGQTLRVRSNGNLIAPWYGHILSGESHGRILKSDLNSGNCVVQCQTERGGLNTTLPFHNVSKYAFGNCPKYVGVKSLKLAVGMRNVPARSSRGLFGAIAGFIEGGWPGLVAGWYGFQHSNDQGVGMAADRDSTQKAIDKITSKVNNIVDKMNKQYEIIDHEFSEIETRLNMINNKIDDQIQDIWAYNAELLVLLENQKTLDEHDANVNNLYNKVKRALGSNAMEDGKGCFELYHKCDDRCMETIRNGTYNRGKYKEESRLERQKIEGVKLESEGTYKSGRLVPRGSPGSGYIPEAPRDGQAYVRKDGEWVLLSTFLGKPIPNPLLGLDSTG

SEQ ID NO: 5415 - protein, 559 aa, Artificial Sequence; identical to SEQ ID NO: 5414
  anti-influenza_Chain

SEQ ID NO: 5416 - protein, 565 aa, Artificial Sequence; identical to SEQ ID NO: 5407
  anti-influenza_Chain

SEQ ID NO: 5417 - protein, 565 aa, Artificial Sequence; identical to SEQ ID NO: 5404
  anti-influenza_Chain

SEQ ID NO: 5418 - protein, 565 aa, Artificial Sequence; identical to SEQ ID NO: 5405
  anti-influenza_Chain

SEQ ID NO: 5419 - protein, 565 aa, Artificial Sequence; identical to SEQ ID NO: 5406
  anti-influenza_Chain

SEQ ID NO: 5420 - protein, 565 aa, Artificial Sequence; identical to SEQ ID NO: 5408
  anti-influenza_Chain

SEQ ID NO: 5421 - protein, 565 aa, Artificial Sequence; identical to SEQ ID NO: 5409
  anti-influenza_Chain

SEQ ID NO: 5422 - protein, 565 aa, Artificial Sequence; identical to SEQ ID NO: 5410
  anti-influenza_Chain

SEQ ID NO: 5423 - protein, 565 aa, Artificial Sequence; identical to SEQ ID NO: 5411
  anti-influenza_Chain

SEQ ID NO: 5424 - protein, 565 aa, Artificial Sequence; identical to SEQ ID NO: 5412
  anti-influenza_Chain

SEQ ID NO: 5425 - protein, 565 aa, Artificial Sequence; identical to SEQ ID NO: 5413
  anti-influenza_Chain

SEQ ID NO: 5426 - protein, 566 aa, Artificial Sequence
  anti-influenza_Chain
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPSIGSRPRIRDVPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5427 - protein, 566 aa, Artificial Sequence
  anti-influenza_Chain
MKTIIALSYILCLVSAQKFPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEEFDKLYIWGVHHPGTDNDQIFLYAQASGRITVSTKRSQQTVIPNIRSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5428 - protein, 566 aa, Artificial Sequence
  anti-influenza_Chain
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFKNESFNWTGVTQNGTSSACIRRSNNSFFSRLNWLTHLKFKYPALNVTMPNKEKFDKLYIWGVHHPGTDNDQIFLYAQASGRITVSTKRSQQTVIPNIGSRLRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5429 - protein, 566 aa, Artificial Sequence
  anti-influenza_Chain
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSKCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5430 - protein, 566 aa, Artificial Sequence
  anti-influenza_Chain
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5431 - protein, 566 aa, Artificial Sequence
  anti-influenza_Chain
MKTIIALSYILCLVFSQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWAGVTQNGTSSACKRRSNKSFFSRLNWLTHLKYKYPALNVTMPNNEKFDKLYIWGVHHPVTDSDQISLYAQASGRITVSTKRSQQTVIPNIGYRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIESIRNGTYDHDVYRDEALNNRFQIKGVELKSGYKDWILWISFAISCFLLCVALLGFIMWACQKGNIRCNICI

SEQ ID NO: 5432 - protein, 566 aa, Artificial Sequence
  anti-influenza_Chain
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNDESFNWTGVTQNGTSSSCKRRSNNSFFSRLNWLTHLKFKYPALNVTMPNNEKFDKLYIWGVHHPVTDNDQIFLYAQASGRITVSTKRSQQTVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5433 - protein, 566 aa, Artificial Sequence
  anti-influenza_Chain
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWAILKPNDAINFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNPQYSEEARLKREEISGVKLESIGTYQILSIYSTVASSLALAIMIAGLSLWMCSNGSLQCRICI

SEQ ID NO: 5434 - protein, 566 aa, Artificial Sequence
  anti-influenza_Chain
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5435 - protein, 566 aa, Artificial Sequence
  anti-influenza_Chain
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPPTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5436 - protein, 566 aa, Artificial Sequence; identical to SEQ ID NO: 5433
  anti-influenza_Chain

SEQ ID NO: 5437 - protein, 566 aa, Artificial Sequence; identical to SEQ ID NO: 5426
  anti-influenza_Chain

SEQ ID NO: 5438 - protein, 566 aa, Artificial Sequence; identical to SEQ ID NO: 5434
  anti-influenza_Chain

SEQ ID NO: 5439 - protein, 566 aa, Artificial Sequence; identical to SEQ ID NO: 5435
  anti-influenza_Chain

SEQ ID NO: 5440 - protein, 566 aa, Artificial Sequence; identical to SEQ ID NO: 5427
  anti-influenza_Chain

SEQ ID NO: 5441 - protein, 566 aa, Artificial Sequence; identical to SEQ ID NO: 5428
  anti-influenza_Chain

SEQ ID NO: 5442 - protein, 566 aa, Artificial Sequence; identical to SEQ ID NO: 5429
  anti-influenza_Chain

SEQ ID NO: 5443 - protein, 566 aa, Artificial Sequence; identical to SEQ ID NO: 5430
  anti-influenza_Chain

SEQ ID NO: 5444 - protein, 566 aa, Artificial Sequence; identical to SEQ ID NO: 5431
  anti-influenza_Chain

SEQ ID NO: 5445 - protein, 566 aa, Artificial Sequence; identical to SEQ ID NO: 5432
  anti-influenza_Chain

SEQ ID NO: 5446 - protein, 561 aa, Artificial Sequence
  anti-influenza_Chain
MEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQIQHSGGRSSLEGPRFEQKLISEEDLNMHTG

SEQ ID NO: 5447 - protein, 561 aa, Artificial Sequence
  anti-influenza_Chain
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGKSSFFRNVVWLIKKNSSYPTIKRSYNNTNQEDLLVLWGIHHPNDAAEQTRLYQNPTTYISVGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQIQHSGGRSSLEGPRFEQKLISEEDLNMHTG

SEQ ID NO: 5448 - protein, 567 aa, Artificial Sequence
  anti-influenza_Chain
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIISKSSWSDHEASSGVSSACPYQGTPSFFRNVVWLIKKNNTYPTIKRSYNNTNQEDLLILWGIHHSNNAAEQTKLYQNPTTYISVGTSTLNLRLVPKIATRSKVNGQSGRMDFFWTILKPNDAINFESNGNFIAPEYAYKIVKKGDSAIMKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 5449 - protein, 567 aa, Artificial Sequence
  anti-influenza_Chain
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAIVKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 5450 - protein, 561 aa, Artificial Sequence
  anti-influenza_Chain
DKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGFTYSGIRTNGTTSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLILNPNDTVTFSFNGAFIAPDRASFLRGKSMGIQSEVQVDANCEGDCYHSGGTIISNLPFQNINSRAVGKCPRYVKQESLLLATGMKNVPEIPKRRRRGLFGAIAGFIENGWEGLIDGWYGFRHQNAQGEGTAADYKSTQSAIDQITGKLNRLIEKTNQQFELIDNEFTEVERQIGNVINWTRDSMTEVWSYNAELLVAMENQHTIDLADSEMNKLYERVKRQLRENAEEDGTGCFEIFHKCDDDCMASIRNNTYDHSKYREEAIQNRIQIDPVKLSSGYKDSGRLVPRGSPGSGYIPEAPRDGQAYVRKDGEWVLLSTFLGKPIPNPLLGLDSTG

SEQ ID NO: 5451 - protein, 567 aa, Artificial Sequence
  anti-influenza_Chain
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKKGDSAIVKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 5452 - protein, 561 aa, Artificial Sequence; identical to SEQ ID NO: 5450
  anti-influenza_Chain

SEQ ID NO: 5453 - protein, 561 aa, Artificial Sequence; identical to SEQ ID NO: 5446
  anti-influenza_Chain

SEQ ID NO: 5454 - protein, 561 aa, Artificial Sequence; identical to SEQ ID NO: 5447
  anti-influenza_Chain

SEQ ID NO: 5455 - protein, 567 aa, Artificial Sequence; identical to SEQ ID NO: 5451
  anti-influenza_Chain

SEQ ID NO: 5456 - protein, 567 aa, Artificial Sequence; identical to SEQ ID NO: 5448
  anti-influenza_Chain

SEQ ID NO: 5457 - protein, 567 aa, Artificial Sequence; identical to SEQ ID NO: 5449
  anti-influenza_Chain

SEQ ID NO: 5458 - protein, 568 aa, Artificial Sequence
  anti-influenza_Chain
MEKIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGDFNDYEELKHLLSRINHFEKIQIIPKSSWSDYEASSGVSSACPYQGRSSFFRNVVWLIKKNNAYPTIKRSYNNTNQEDLLVLWGIHHPNDAAEQIRLYQNPTTYISIGTSTLNQRLVPKIATRSKVNGQSGRMEFFWTILKSNDAINFESNGNFIAPEYAYKIVKKGDSTIMKSELEYGNCNTKCQTPIGAINSSMPFHNIHPLTIGECPKYVKSNRLVLATGLRNSPQGERRRRKRGLFGAIAGFIEGGWQGMVDGWYGYHHSNEQGSGYAADKESTQKAIDGVTNKVNSIINKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESMGIYQILSIYSTVASSLALAIMVAGLFLWMCSNGSLQCRICI

SEQ ID NO: 5459 - protein, 568 aa, Artificial Sequence
  anti-influenza_Chain
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQILSIYSTVASSLALAIMMAGLSLWMCSNGSLQCRICI

SEQ ID NO: 5460 - protein, 568 aa, Artificial Sequence
  anti-influenza_Chain
MEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 5461 - protein, 568 aa, Artificial Sequence; identical to SEQ ID NO: 5458
  anti-influenza_Chain

SEQ ID NO: 5462 - protein, 568 aa, Artificial Sequence; identical to SEQ ID NO: 5459
  anti-influenza_Chain

SEQ ID NO: 5463 - protein, 568 aa, Artificial Sequence; identical to SEQ ID NO: 5460
  anti-influenza_Chain

SEQ ID NO: 5464 - protein, 569 aa, Artificial Sequence
  anti-influenza_Chain
SKSRGYKMNTQILVFALVASIPTNADKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGFTYSGIRTNGTTSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLILNPNDTVTFSFNGAFIAPDRASFLRGKSMGIQSEVQVDANCEGDCYHSGGTIISNLPFQNINSRAVGKCPRYVKQESLLLATGMKNVPEIPKRRRRGLFGAIAGFIENGWEGLIDGWYGFRHQNAQGEGTAADYKSTQSAIDQITGKLNRLIEKTNQQFELIDNEFTEVERQIGNVINWTRDSMTEVWSYNAELLVAMENQHTIDLADSEMNKLYERVKRQLRENAEEDGTGCFEIFHKCDDDCMASIRNNTYDHSKYREEAIQNRIQIDPVKLSSGYKDVILWFSFGASCFILLAIAMGLVFICVKNGNMRCTICI

SEQ ID NO: 5465 - protein, 569 aa, Artificial Sequence; identical to SEQ ID NO: 5464
  anti-influenza_Chain

SEQ ID NO: 5466 - protein, 564 aa, Artificial Sequence
  anti-influenza_Chain
DQICIGYHANNSTEKVDTNLERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTKEGSDYPVAKGSYNNTSGEQMLIIWGVHHPIDETEQRTLYQNVGTYVSVGTSTLNKRSTPEIATRPKVNGQGGRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFGNLERRLENLNKRMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQSGRLVPRGSPGSGYIPEAPRDGQAYVRKDGEWVLLSTFLGKPIPNPLLGLDSTG

SEQ ID NO: 5467 - protein, 564 aa, Artificial Sequence
  anti-influenza_Chain
QKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNDESFNWTGVTQNGTSSSCKRRSNNSFFSRLNWLTQLKFKYPALNVTMPNNEKFDKLYIWGVHHPVTDNDQIFLYAQASGRITVSTKRSQQTVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGSGRLVPRGSPGSGYIPEAPRDGQAYVRKDGEWVLLSTFLGKPIPNPLLGLDSTG

SEQ ID NO: 5468 - protein, 564 aa, Artificial Sequence; identical to SEQ ID NO: 5466
  anti-influenza_Chain

SEQ ID NO: 5469 - protein, 564 aa, Artificial Sequence; identical to SEQ ID NO: 5467
  anti-influenza_Chain

SEQ ID NO: 5470 - protein, 565 aa, Artificial Sequence
  anti-influenza_Chain
DTICIGYHANNSTDTVDTVLEKNVTVTHSVNLLEDSHNGKLCLLKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQSGRLVPRGSPGSGYIPEAPRDGQAYVRKDGEWVLLSTFLGKPIPNPLLGLDSTG

SEQ ID NO: 5471 - protein, 565 aa, Artificial Sequence
  anti-influenza_Chain
QNYTGNPVICLGHHAVSNGTMVKTLTDDQIEVVTAQELVESQHLPELCPSPLRLVDGQTCDIVNGALGSPGCDHLNGAEWDVFIERPTAVDTCYPFDVPDYQSLRSILANNGKFEFIAEEFQWNTVKQNGKSGACKRANVNDFFNRLNWLTKSDGNAYPLQNLTKVNNGDYARLYIWGVHHPSTDTEQTNLYKNNPGRVTVSTQTSQTSVVPNIGSRPWVRGLSSRISFYWTIVEPGDLIVFNTIGNLIAPRGHYKLNSQKKSTILNTAVPIGSCVSKCHTDKGSISTTKPFQNISRISIGDCPKYVKQGSLKLATGMRSILEKATRGLFGAIAGFIENGWQGLIDGWYGFRHQNAEGTGTAADLKSTQAAIDQINGKLNRLIGKPNEKYHQIEKEFEQVEGRIQDLEKYVEDTKIDLWSYNAELLVALENQHTIDVTDSEMNKLFERVRHQLRENAEDKGNGCFEIFHQCDNSCIESIRNGTYDHDIYRDEAINNRFQIQGVKLIQGYKDSGRLVPRGSPGSGYIPEAPRDGQAYVRKDGEWVLLSTFLGKPIPNPLLGLDSTG

SEQ ID NO: 5472 - protein, 565 aa, Artificial Sequence
  anti-influenza_Chain
DQICIGYHANNSTEQVDTIMEKNVTVTHAQDILEKTHNGKLCNLDGVKPLILKDCSVAGWLLGNPMCDEFLNVSEWSYIVEKASPANGLCYPGDFNDYEELKHLLSRINHLKKIKIIPKSYWSNHEASSGVSAACSYLGEPSFFRNVVWLIKKNNTYPPIKVNYTNTNQEDLLVLWGIHHPNDEKEQIRIYQNPNTSISVGTSTLNQRLVPKIATRPKVNGQSGRMEFFWTILKPNDSINFDSNGNFIAPEYAYKIAKKGDSVIMKSELEYGNCNTKCQTPMGAINSSMPFHNIHPLTIGECPKYVKSNRLVLATGLRNAPQTETRGLFGAIAGFIEGGWQGMVDGWYGYHHSNEQGSGYAADKESTQKAIDGITNKVNSIIDKMNTQFEIVGREFNNLERRIENLNKKMEDGFLDVWTYNAELLVLMENERTLDFHDSNVKNLYEKVRLQLRDNAKELGNGCFEFYHKCDNECMESVRNGTYDYPQYSEEARLSREEISGVKMESMVTYQSGRLVPRGSPGSGYIPEAPRDGQAYVRKDGEWVLLSTFLGKPIPNPLLGLDSTG

SEQ ID NO: 5473 - protein, 565 aa, Artificial Sequence; identical to SEQ ID NO: 5470
  anti-influenza_Chain

SEQ ID NO: 5474 - protein, 565 aa, Artificial Sequence; identical to SEQ ID NO: 5471
  anti-influenza_Chain

SEQ ID NO: 5475 - protein, 565 aa, Artificial Sequence; identical to SEQ ID NO: 5472
  anti-influenza_Chain

SEQ ID NO: 5476 - protein, 566 aa, Artificial Sequence
  anti-influenza_Chain
DTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQSGRLVPRGSPGSGYIPEAPRDGQAYVRKDGEWVLLSTFLGKPIPNPLLGLDSTG

SEQ ID NO: 5477 - protein, 566 aa, Artificial Sequence
  anti-influenza_Chain
DRICIGYQSNNSTDTVNTLIEQKVPVTQTMELVETEKHPAYCNTDLGAPLELRDCKIEAVIYGNPKCDIHLKDQGWSYIVERPSAPEGMCYPGSVENLEELRFVFSSAASYKRIRLFDYSRWNVTSSGTSKACNASTGGQSFYRSINWLTKKKPDTYDFNEGTYVNNEDGDIIFLWGIHHPPDTKEQTTLYKNANTLSSVTTNTINRSFQPNIGPRPLVRGQQGRMDYYWGILKRGETLKIRTNGNLIAPEFGYLLKGESHGRTIQNEDIPIGNCYTKCQTYAGAINSSKPFQNASRHYMGECPKYVKKASLRLAVGLRNTPSVEPRGLFGAIAGFIEGGWSGMIDGWYGFHHSNSEGTGMAADQKSTQEAIDKITNKVNNIVDKMNREFEVVNHEFSEVEKRINMINDKIDDQIEDLWAYNAELLVLLENQKTLDEHDSNVKNLFDEVKRRLSANAIDAGNGCFDILHKCDNECMETIKNGTYDHKEYEEEAKLERSKINGVKLEENTTYKSGRLVPRGSPGSGYIPEAPRDGQAYVRKDGEWVLLSTFLGKPIPNPLLGLDSTG

SEQ ID NO: 5478 - protein, 566 aa, Artificial Sequence; identical to SEQ ID NO: 5476
  anti-influenza_Chain

SEQ ID NO: 5479 - protein, 566 aa, Artificial Sequence; identical to SEQ ID NO: 5477
  anti-influenza_Chain

SEQ ID NO: 5480 - protein, 567 aa, Artificial Sequence
  anti-influenza_Chain
DKICIGYHANNSTTQVDTILEKNVTVTHSVELLENQKEERFCKILNKAPLDLRGCTIEGWILGNPQCDLLLGDQSWSYIVERPTAQNGICYPGALNEVEELKALIGSGERVERFEMFPKSTWTGVDTSSGVTKACPYNSGSSFYRNLLWIIKTKSAAYPVIKGTYNNTGSQPILYFWGVHHPPDTNEQNTLYGSGDRYVRMGTESMNFAKSPEIAARPAVNGQRGRIDYYWSVLKPGETLNVESNGNLIAPWYAYKFVSTNNKGAIFKSNLPIENCDATCQTIAGVLRTNKTFQNVSPLWIGECPKYVKSESLRLATGLRNVPQIETRGLFGAIAGFIEGGWTGMIDGWYGYHHENSQGSGYAADKESTQKAIDGITNKVNSIIDKMNTQFEAVDHEFSNLERRIDNLNKRMEDGFLDVWTYNAELLVLLENERTLDLHDANVKNLYEKVKSQLRDNANDLGNGCFEFWHKCDNECIESVKNGTYDYPKYQDESKLNRQEIESVKLDNLGVYQSGRLVPRGSPGSGYIPEAPRDGQAYVRKDGEWVLLSTFLGKPIPNPLLGLDSTG

SEQ ID NO: 5481 - protein, 567 aa, Artificial Sequence; identical to SEQ ID NO: 5480
  anti-influenza_Chain

SEQ ID NO: 5482 - protein, 568 aa, Artificial Sequence
  anti-influenza_Chain
DHICIGYHANNSTEQVDTIMEKNVTVTHAQDILEKTHNGKLCDLNGVKPLILKDCSVAGWLLGNPMCDEFINVPEWSYIVEKANPANDLCYPGNFNDYEELKHLLSRINHFEKIQIIPKDSWSDHEASLGVSSACPYQGNSSFFRNVVWLIKKGNAYPTIKKSYNNTNQEDLLVLWGIHHPNDEAEQTRLYQNPTTYISIGTSTLNQRLVPKIATRSKVNGQSGRIDFFWTILKPNDAINFESNGNFIAPEYAYKIVKKGDSTIMKSEVEYGNCNTRCQTPMGAINSSMPFHNIHPLTIGECPKYVKSNKLVLATGLRNSPQRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQSGRLVPRGSPGSGYIPEAPRDGQAYVRKDGEWVLLSTFLGKPIPNPLLGLDSTG

SEQ ID NO: 5483 - protein, 568 aa, Artificial Sequence
  anti-influenza_Chain
DQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAIVKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQSGRLVPRGSPGSGYIPEAPRDGQAYVRKDGEWVLLSTFLGKPIPNPLLGLDSTG

SEQ ID NO: 5484 - protein, 568 aa, Artificial Sequence; identical to SEQ ID NO: 5482
  anti-influenza_Chain

SEQ ID NO: 5485 - protein, 568 aa, Artificial Sequence; identical to SEQ ID NO: 5483
  anti-influenza_Chain

SEQ ID NO: 5486 - protein, 569 aa, Artificial Sequence
  anti-influenza_Chain
DQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQSGRLVPRGSPGSGYIPEAPRDGQAYVRKDGEWVLLSTFLGKPIPNPLLGLDSTG

SEQ ID NO: 5487 - protein, 569 aa, Artificial Sequence
  anti-influenza_Chain
DQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQSGRLVPRGSPGSGYIPEAPRDGQAYVRKDGEWVLLSTFLGKPIPNPLLGLDSTG

SEQ ID NO: 5488 - protein, 569 aa, Artificial Sequence
  anti-influenza_Chain
DQICIGYHANNSTEQVDTIMEKNVTVTHAQDILEKTHNGKLCDLDGVKPLILRDCSVAGWLLGNPMCDEFLNVSEWSYIVEKINPANDLCYPGNFNNYEELKHLLSRINRFEKIQIIPKSSWPDHEASLGVSSACPYQGGPSFYRNVVWLIKKNNTYPTIKKSYHNTNQEDLLVLWGIHHPNDEAEQTRIYKNPTTYISVGTSTLNQRLVPKIATRSKVNGQSGRVEFFWTILKSNDTINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQSGRLVPRGSPGSGYIPEAPRDGQAYVRKDGEWVLLSTFLGKPIPNPLLGLDSTG

SEQ ID NO: 5489 - protein, 569 aa, Artificial Sequence; identical to SEQ ID NO: 5486
  anti-influenza_Chain

SEQ ID NO: 5490 - protein, 569 aa, Artificial Sequence; identical to SEQ ID NO: 5487
  anti-influenza_Chain

SEQ ID NO: 5491 - protein, 569 aa, Artificial Sequence; identical to SEQ ID NO: 5488
  anti-influenza_Chain

SEQ ID NO: 5492 - protein, 576 aa, Artificial Sequence
  anti-influenza_Chain
ICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKKGDSAIVKSEVEYGNCNTKCQTPIGAINSSMPFHNIHPLTIGECPKYVKSNKLVLATGLRNSPLGYIPEAPRDGQAYVRKDGEWVLLSTFLRSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5493 - protein, 576 aa, Artificial Sequence
  anti-influenza_Chain
MVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGKSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCFHS

SEQ ID NO: 5494 - protein, 576 aa, Artificial Sequence; identical to SEQ ID NO: 5493
  anti-influenza_Chain

SEQ ID NO: 5495 - protein, 576 aa, Artificial Sequence; identical to SEQ ID NO: 5492
  anti-influenza_Chain

SEQ ID NO: 5496 - protein, 577 aa, Artificial Sequence
  anti-influenza_Chain
AKAGVQSVKMEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALALMVAGLSLWMCSNGSLQCRICI

SEQ ID NO: 5497 - protein, 577 aa, Artificial Sequence; identical to SEQ ID NO: 5496
  anti-influenza_Chain

SEQ ID NO: 5498 - protein, 579 aa, Artificial Sequence
  anti-influenza_Chain
MVVTSNADRICTGITSSNSPHVVKTATQGEVNVTGVIPLTTTPTKSHFANLKGTQTRGKLCPNCLNCTDLDVALGRPKCMGTIPSAKASILHEVKPVTSGCFPIMHDRTKIRQLPNLLRGYENIRLSARNVINAETAPGGPYIVGTSGSCPNVTNGKGFFATMAWAVPKNKNKTATNPLTVEVPYICTKGEDQITVWGFHSDNEAQMVTLYGDSKPQKFTSSANGVTTHYVSQIGGFPNQTEDEGLQQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVFLLHLSIRK

SEQ ID NO: 5499 - protein, 579 aa, Artificial Sequence; identical to SEQ ID NO: 5498
  anti-influenza_Chain

SEQ ID NO: 5500 - protein, 577 aa, Artificial Sequence
  anti-influenza_Chain
METISLITILLVVTASNADKICIGHQSTNSTETVDTLTETNVPVTHAKELLHTEHNGMLCATSLGHPLILDTCTIEGLVYGNPSCDLLLGGREWSYIVERSSAVNGTCYPGNVENLEELRTLFSSASSYQRIQIFPDTTWNVTYTGTSRACSGSFYRSMRWLTQKSGFYPVQDAQYTNNRGKSILFVWGIHHPPTYTEQTNLYIRNDTTTSVTTEDLNRTFKPVIGPRPLVNGLQGRIDYYWSVLKPGQTLRVRSNGNLIAPWYGHVLSGGSHGRILKTDLKGGNCVVQCQTEKGGLNSTLPFHNISKYAFGTCPKYVRVNSLKLAVGLRNVPARSSRGLFGAIAGFIEGGWPGLVAGWYGFQHSNDQGVGMAADRDSTQKAIDKITSKVNNIVDKMNKQYEIIDHEFSEVETRLNMINNKIDDQIQDVWAYNAELLVLLENQKTLDEHDANVNNLYNKVKRALGSNAMEDGKGCFELYHKCDDQCMETIRNGTYNRRKYREESRLERQKIEGVKLESEGTYKSGRLVPRGSPGSGYIPEAPRDGQAYVRKDGEWVLLSTFLGKPIPNPLLGLDSTG

SEQ ID NO: 5501 - protein, 577 aa, Artificial Sequence; identical to SEQ ID NO: 5500
  anti-influenza_Chain

SEQ ID NO: 5502 - protein, 584 aa, Artificial Sequence
  anti-influenza_Chain
MKAIIVLLMVVTSNADRICTGITSSNSPHVVKTATQGEVNVTGVIPLTTTPTKSHFANLKGTQTRGKLCPNCFNCTDLDVALGRPKCMGNTPSAKVSILHEVKPATSGCFPIMHDRTKIRQLPNLLRGYENIRLSTSNVINTETAPGGPYKVGTSGSCPNVANGNGFFNTMAWVIPKDNNKTAINPVTVEVPYICSEGEDQITVWGFHSDDKTQMERLYGDSNPQKFTSSANGVTTHYVSQIGGFPNQTEDEGLKQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNYLSELEVKNLQRLSGAMNELHDEILELDEKVDDLRADTISSQIELAVLLSNEGIINSEDEHLLALERKLKKMLGPSAVEIGNGCFETKHKCNQTCLDRIAAGTFNAGDFSLPTFDSLNITAASLNDDGLDNHTILLYYSTAASSLAVTLMIAIFIVYMVSRDNVSCSICL

SEQ ID NO: 5503 - protein, 584 aa, Artificial Sequence
  anti-influenza_Chain
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 5504 - protein, 584 aa, Artificial Sequence
  anti-influenza_Chain
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVKPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGSFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 5505 - protein, 584 aa, Artificial Sequence; identical to SEQ ID NO: 5502
  anti-influenza_Chain

SEQ ID NO: 5506 - protein, 584 aa, Artificial Sequence; identical to SEQ ID NO: 5503
  anti-influenza_Chain

SEQ ID NO: 5507 - protein, 584 aa, Artificial Sequence; identical to SEQ ID NO: 5504
  anti-influenza_Chain

SEQ ID NO: 5508 - protein, 586 aa, Artificial Sequence
  anti-influenza_Chain
MKAIIVLLMVVTSNADRIICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 5509 - protein, 586 aa, Artificial Sequence; identical to SEQ ID NO: 5508
  anti-influenza_Chain

SEQ ID NO: 5510 - protein, 583 aa, Artificial Sequence
  anti-influenza_Chain
MEARLLVLLCAFAATNADTICIGYHANNSTDTVDTVLEKNVTVTHSVNLLEDSHNGKLCKLKGIAPLQLGKCNIAGWLLGNPECDLLLTASSWSYIVETSNSENGTCYPGDFIDYEELREQLSSVSSFEKFEIFPKTSSWPNHETTKGVTAACSYAGASSFYRNLLWLTKKGSSYPKLSKSYVNNKGKEVLVLWGVHHPPTGTDQQSLYQNADAYVSVGSSKYNRRFTPEIAARPKVRDQAGRMNYYWTLLEPGDTITFEATGNLIAPWYAFALNRGSGSGIITSDAPVHDCNTKCQTPHGAINSSLPFQNIHPVTIGECPKYVRSTKLRMATGLRNIPSIQSRGLFGAIAGFIEGGWTGMIDGWYGYHHQNEQGSGYAADQKSTQNAIDGITNKVNSVIEKMNTQFTAVGKEFNNLERRIENLNKKVDDGFLDIWTYNAELLVLLENERTLDFHDSNVRNLYEKVKSQLKNNAKEIGNGCFEFYHKCDDACMESVRNGTYDYPKYSEESKLNREEIDGVKLESMGVYQSGRLVPRGSPGSGYIPEAPRDGQAYVRKDGEWVLLSTFLGKPIPNPLLGLDSTG

SEQ ID NO: 5511 - protein, 583 aa, Artificial Sequence; identical to SEQ ID NO: 5510
  anti-influenza_Chain

SEQ ID NO: 5512 - protein, 585 aa, Artificial Sequence
  anti-influenza_Chain
MERTVLLLATVSLVKSDQICIGYHANNSTEQVDTIMEKNVTVTHAQDILERTHNGKLCDLNGVKPLILRDCSVAGWLLGNPMCDEFINVPEWSYIVEKASPANDLCYPGNFNDYEELKHLLSRINHFEKIQIIPKSSWSNHDASSGVSSACPYLGRSSFFRNVVWLIKKNSAYPTIKRSYNNTNQEDLLVLWGVHHPNDAAEQTKLYQNPTTYISVGTSTLNQRLVPEIATRPKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNTPQRERRRKKRGLFGAIAGFIEGGWQGMVDGWYGYHHSNEQGSCYSADKESTQKAIDGVTNKVNSIINKMNTQFEAVGREFNNLERRIENLNKKMEDGFLDVWTYNAELLVLMENERTLDFHDSNVKNLYDKVRLQLRDNAKELGNGCFEFYHKCDNECMESVKNGTYDYPQYSEEARLNREEISGVKLESMGTYQSGRLVPRGSPGSGYIPEAPRDGQAYVRKDGEWVLLSTFLGKPIPNPLLGLDSTG

SEQ ID NO: 5513 - protein, 585 aa, Artificial Sequence; identical to SEQ ID NO: 5512
  anti-influenza_Chain

SEQ ID NO: 5514 - protein, 649 aa, Artificial Sequence
  anti-influenza_Chain
MGDKINFIFGIHNHQPLGNFGWVFEEAYEKCYWPFLETLEEYPNMKVAIHTSGPLIEWLQDNRPEYIDLLRSLVKRGQVEIVVAGFYEPVLASIPKEDRIEQIRLMKEWAKSIGFDARGVWLTERVWQPELVKTLKESGIDYVIVDDYHFMSAGLSKEELYWPYYTEDGGEVIAVFPIDEKLRYLIPFRPVDKVLEYLHSLIDGDESKVAVFHDDGEKFGIWPGTYEWVYEKGWLREFFDRISSDEKINLMLYTEYLEKYKPRGLVYLPIASYFEMSEWSLPAKQARLFVEFVNELKVKGIFEKYRVFVRGGIWKNFFYKYPESNYMHKRMLMVSKLVRNNPEARKYLLRAQCNDAYWHGLFGGVYLPHLRRAIWNNLIKANSYVSLGKVIRDIDYDGFEEVLIENDNFYAVFKPSYGGSLVEFSSKNRLVNYVDVLARRWEHYHGYVESQFDGVASIHELEKKIPDEIRKEVAYDKYRRFMLQDHVVPLGTTLEDFMFSRQQEIGEFPRVPYSYELLDGGIRLKREHLGIEVEKTVKLVNDGFEVEYIVNNKTGNPVLFAVELNVAVQSIMESPGVLRGKEIVVDDKYAVGKFALKFEDEMEVWKYPVKTLSQSESGWDLIQQGVSYIVPIRLEDKIRFKLKFEEASG

SEQ ID NO: 5515 - protein, 649 aa, Artificial Sequence
  anti-influenza_Chain
MSRMTLKSSMKKRVLSLLIAVVFLSLTGVFPSGLIETKVSAAKITENYQFDSRIRLNSIGFIPNHSKKATIAANCSTFYVVKEDGTIVYTGTATSMFDNDTKETVYIADFSSVNEEGTYYLAVPGVGKSVNFKIAMNVYEDAFKTAMLGMYLLRCGTSVSATYNGIHYSHGPCHTNDAYLDYINGQHTKKDSTKGWHDAGDYNKYVVNAGITVGSMFLAWEHFKDQLEPVALEIPEKNNSIPDFLDELKYEIDWILTMQYPDGSGRVAHKVSTRNFGGFIMPENEHDERFFVPWSSAATADFVAMTAMAARIFRPYDPQYAEKCINAAKVSYEFLKNNPANVFANQSGFSTGEYATVSDADDRLWAAAEMWETLGDEEYLRDFENRAAQFSKKIEADFDWDNVANLGMFTYLLSERPGKNPALVQSIKDSLLSTADSIVRTSQNHGYGRTLGTTYYWGCNGTVVRQTMILQVANKISPNNDYVNAALDAISHVFGRNYYNRSYVTGLGINPPMNPHDRRSGADGIWEPWPGYLVGGGWPGPKDWVDIQDSYQTNEIAINWNAALIYALAGFVNYNSPQNEVLYGDVNDDGKVNSTDLTLLKRYVLKAVSTLPSSKAEKNADVNRDGRVNSSDVTILSRYLIRVIEKLPI

SEQ ID NO: 5516 - protein, 649 aa, Artificial Sequence; identical to SEQ ID NO: 5514
  anti-influenza_Chain

SEQ ID NO: 5517 - protein, 649 aa, Artificial Sequence; identical to SEQ ID NO: 5515
  anti-influenza_Chain

SEQ ID NO: 5518 - protein, 682 aa, Artificial Sequence
  anti-influenza_Chain
MKPSHFTEKRFMKKVLGLFLVVVMLASVGVLPTSKVQAAGTTVTSMEYFSPADGPVISKSGVGKASYGFVMPKFNGGSATWNDVYSDVGVNVKVGNNWVDIDQAGGYIYNQNWGHWSDGGFNGYWFTLSATTEIQLYSKANGVKLEYQLVFQNINKTTITAMNPTQGPQITASFTGGAGFTYPTFNNDSAVTYEAVADDLKVYVKPVNSSSWIDIDNNAASGWIYDHNFGQFTDGGGGYWFNVTESINVKLESKTSSANLVYTITFNEPTRNSYVITPYEGTTFTADANGSIGIPLPKIDGGAPIAKELGNFVYQININGQWVDLSNSSQSKFAYSANGYNNMSDANQWGYWADYIYGLWFQPIQENMQIRIGYPLNGQAGGNIGNNFVNYTFIGNPNAPRPDVSDQEDISIGTPTDPAIAGMNLIWQDEFNGTTLDTSKWNYETGYYLNNDPATWGWGNAELQHYTNSTQNVYVQDGKLNIKAMNDSKSFPQDPNRYAQYSSGKINTKDKLSLKYGRVDFRAKLPTGDGVWPALWMLPKDSVYGTWAASGEIDVMEARGRLPGSVSGTIHFGGQWPVNQSSGGDYHFPEGQTFANDYHVYSVVWEEDNIKWYVDGKFFYKVTNQQWYSTAAPNNPNAPFDEPFYLIMNLAVGGNFDGGRTPNASDIPATMQVDYVRVYKEQ

SEQ ID NO: 5519 - protein, 682 aa, Artificial Sequence; identical to SEQ ID NO: 5518
  anti-influenza_Chain

SEQ ID NO: 5520 - protein, 686 aa, Artificial Sequence
  anti-influenza_Chain
MTKSIYFSLGIHNHQPVGNFDFVIERAYEMSYKPLINFFFKHPDFPINVHFSGFLLLWLEKNHPEYFEKLKIMAERGQIEFVSGGFYEPILPIIPDKDKVQQIKKLNKYIYDKFGQTPKGMWLAERVWEPHLVKYIAEAGIEYVVVDDAHFFSVGLKEEDLFGYYLMEEQGYKLAVFPISMKLRYLIPFADPEETITYLDKFASEDKSKIALLFDDGEKFGLWPDTYRTVYEEGWLETFVSKIKENFLLVTPVNLYTYMQRVKPKGRIYLPTASYREMMEWVLFPEAQKELEELVEKLKTENLWDKFSPYVKGGFWRNFLAKYDESNHMQKKMLYVWKKVQDSPNEEVKEKAMEEVFQGQANDAYWHGIFGGLYLPHLRTAIYEHLIKAENYLENSEIRFNIFDFDCDGNDEIIVESPFFNLYLSPNHGGSVLEWDFKTKAFNLTNVLTRRKEAYHSKLSYVTSEAQGKSIHERWTAKEEGLENILFYDNHRRVSFTEKIFESEPVLEDLWKDSSRLEVDSFYENYDYEINKDENKIRVLFSGVFRGFELCKSYILYKDKSFVDVVYEIKNVSETPISLNFGWEINLNFLAPNHPDYYFLIGDQKYPLSSFGIEKVNNWKIFSGIGIELECVLDVEASLYRYPIETVSLSEEGFERVYQGSALIHFYKVDLPVGSTWRTTIRFWVK

SEQ ID NO: 5521 - protein, 686 aa, Artificial Sequence; identical to SEQ ID NO: 5520
  anti-influenza_Chain

SEQ ID NO: 5522 - protein, 705 aa, Artificial Sequence
  anti-influenza_Chain
MPTNLFFNAHHSPVGAFASFTLGFPGKSGGLDLELARPPRQNVLIGVESLHESGLYHVLPFLETAEEDESKRYDIENPDPNPQKPNILIPFAKEEIQREFHVATDTWKAGDLTFTIYSPVKAVPNPETADEEELKLALVPAVIVEMTIDNTNGTRARRAFFGFEGTDPYTSMRRIDDTCPQLRGVGQGRILSIVSKDEGVRSALHFSMEDILTAQLEENWTFGLGKVGALIVDVPAGEKKTYQFAVCFYRGGYVTAGMDASYFYTRFFQNIEEVGLYALEQAEVLKEQSFRSNKLIEKEWLSDDQTFMMAHAIRSYYGNTQLLEHEGKPIWVVNEGEYRMMNTFDLTVDQLFFELKLNPWTVKNVLDLYVERYSYEDRVRFPGEETEYPSGISFTHDMGVANTFSRPHYSSYELYGISGCFSHMTHEQLVNWVLCAAVYIEQTKDWAWRDKRLAILEQCLESMVRRDHPDPEQRNGVMGLDSTRTMGGAEITTYDSLDVSLGQARNNLYLAGKCWAAYVALEKLFRDVGKEELAALAGEQAEKCAATIVSHVTDDGYIPAIMGEGNDSKIIPAIEGLVFPYFTNCHEALDENGRFGAYIQALRNHLQYVLREGICLFPDGGWKISSTSNNSWLSKIYLCQFIARHILGWEWDEQGKRADAAHVAWLTHPTLSIWSWSDQIIAGEITGSKYYPRGVTSILWLEEGE

SEQ ID NO: 5523 - protein, 705 aa, Artificial Sequence; identical to SEQ ID NO: 5522
  anti-influenza_Chain

SEQ ID NO: 5524 - protein, 716 aa, Artificial Sequence
  anti-influenza_Chain
MEDFVRQCFNPMIVELAEKAMKEYGEDLKIETNKFAAICTHLEVCFMYSDFHFINEQGESIIVEPEDPNALLKHRFEIIEGRDRTMAWTVVNSICNTTGAEKPKFLPDLYDYKENRFIEIGVTRREVHIYYLEKANKIKSEKTHIHIFSFTGEEMATKADYTLDEESRARIKTRLFTIRQEMASRGLWDSFRQSERGEETIEERFEITGTMRRLADQSLPPNFSCLENFRAYVDGFEPNGYIEGKLSQMSKEVNARIEPFLRTTPRPIRLPDGPPCFQRSKFLLMDSLKLSIEDPSHEGEGIPLYDAIKCMRTFFGWKEPSVVKPHGKGINPNYLLSWKQVLAELQDIESEEKIPRTKNMKKTSQLKWALGENMAPEKVDFDDCKDISDLKQYDSDEPELRSLSSWIQNEFNKACELTDSIWIELDEIGEDVAPIEHIASMRRNYFTAEVSHCRATEYIMKGVYINTALLNASCAAMDDFQLIPMISKCRTKEGRRKTNLYGFIIKGRSHLRNDTDVVNFVSMEFSLTDPRLEPHKWEKYCVLEIGDMLLRSAIGQVSRPMFLYVRTNGTSKIKMKWGMEMRRCLLQSLQQIESMIEAESSVKEKDMTKEFFENRSETWPIGESPKGVEEGSIGKVCRTLLAKSVFNSLYASPQLEGFSAESRKLLLIVQALRDNLEPGTFDLGGLYEAIEECLINDPWVLLNASWFNSFLTHALR

SEQ ID NO: 5525 - protein, 716 aa, Artificial Sequence; identical to SEQ ID NO: 5524
  anti-influenza_Chain

SEQ ID NO: 5526 - protein, 752 aa, Artificial Sequence
  anti-influenza_Chain
MNINPYFLFIDVPIQAAISTTFPYTGVPPYSHGTGTGYTIDTVIRTHEYSNKGKQYISDVTGCVMVDPTNGPLPEDNEPSAYAQLDCVLEALDRMDEEHPGLFQAGSQNAMEALMVTTVDKLTQGRQTFDWTVCRNQPAATALNTTITSFRLNDLNGADKGGLVPFCQDIIDSLDKPEMIFFTVKNIKKKLPAKNRKGFLIKRIPMKVKDRITRVEYIKRALSLNTMTKDAERGKLKRRAIATAGIQIRGFVLVVENLAKNICENLEQSGLPVGGNEKKAKLSNAVAKMLSNCPPGGISMTVTGDNTKWNECLNPRIFLAMTERITRDSPIWFRDFCSIAPVLFSNKIARLGKGFMITSKTKRLKAQIPCPDLFNIPLERYNEETRAKLKKLKPFFNEEGTASLSPGMMMGMFNMLSTVLGVAALGIKNIGNKEYLWDGLQSSDDFALFVNAKDEETCMEGINDFYRTCKLLGINMSKKKSYCNETGMFEFTSMFYRDGFVSNFAMELPSFGVAGVNESADMAIGMTIIKNNMINNGMGPATAQTAIQLFIADYRYTYKCHRGDSKVEGKRMKIIKELWENTKGRDGLLVADGGPNLYNLRNLHIPEIILKYNIMDPEYKGRLLHPQNPFVGHLSIEGIKEADITPAHGPIKKMDYDAVSGTHSWRTKRNRSILNTDQRNMILEEQCYAKCCNLFEACFNSASYRKPVGQHSMLEAMAHRLRMDARLDYESGRMSKEDFEKAMAHLGEIGYM

SEQ ID NO: 5527 - protein, 752 aa, Artificial Sequence; identical to SEQ ID NO: 5526
  anti-influenza_Chain

SEQ ID NO: 5528 - protein, 755 aa, Artificial Sequence
  anti-influenza_Chain
MAVDIKKIIKQMTLEEKAGLCSGLDFWHTKPVERLGIPSIMMTDGPHGLRKQREDAEIADINNSVPATCFPSAAGLACSWDRELVERVGAALGEECQAENVSILLGPGANIKRSPLCGRNFEYFSEDPYLSSELAASHIKGVQSQGVGACLKHFAANNQEHRRMTVDTIVDERTLREIYFASFENAVKKARPWVVMCAYNKLNGEYCSENRYLLTEVLKNEWMHDGFVVSDWGAVNDRVSGLDAGLDLEMPTSHGITDKKIVEAVKSGKLSENILNRAVERILKVIFMALENKKENAQYDKDAHHRLARQAAAESMVLLKNEDDVLPLKKSGTIALIGAFVKKPRYQGSGSSHITPTRLDDIYEEIKKAGGDKVNLVYSEGYRLENDGIDEELINEAKKAASSSDVAVVFAGLPDEYESEGFDRTHMSIPENQNRLIEAVAEVQSNIVVVLLNGSPVEMPWIDKVKSVLEAYLGGQALGGALADVLFGEVNPSGKLAETFPVKLSHNPSYLNFPGEDDRVEYKEGLFVGYRYYDTKGIEPLFPFGHGLSYTKFEYSDISVDKKDVSDNSIINVSVKVKNVGKMAGKEIVQLYVKDVKSSVRRPEKELKGFEKVFLNPGEEKTVTFTLDKRAFAYYNTQIKDWHVESGEFLILIGRSSRDIVLKESVRVNSTVKIRKRFTVNSAVEDVMSDSSAAAVLGPVLKEITDALQIDMDNAHDMMAANIKNMPLRSLVGYSQGRLSEEMLEELVDKINNVE

SEQ ID NO: 5529 - protein, 755 aa, Artificial Sequence; identical to SEQ ID NO: 5528
  anti-influenza_Chain

SEQ ID NO: 5530 - protein, 759 aa, Artificial Sequence
  anti-influenza_Chain
MERIKELRNLMSQSRTREILTKTTVDHMAIIKKYTSGRQEKNPALRMKWMMAMKYPITADKRITEMIPERNEQGQTLWSKMNDAGSDRVMVSPLAVTWWNRNGPMTNTVHYPKIYKTYFERVERLKHGTFGPVHFRNQVKIRRRVDINPGHADLSAKEAQDVIMEVVFPNEVGARILTSESQLTITKEKKEELQDCKISPLMVAYMLERELVRKTRFLPVAGGTSSVYIEVLHLTQGTCWEQMYTPGGEVKNDDVDQSLIIAARNIVRRAAVSADPLASLLEMCHSTQIGGIRMVDILKQNPTEEQAVGICKAAMGLRISSSFSFGGFTFKRTSGSSVKREEEVLTGNLQTLKIRVHEGYEEFTMVGRRATAILRKATRRLIQLIVSGRDEQSIAEAIIVAMVFSQEDCMIKAVRGDLNFVNRANQRLNPMHQLLRHFQKDAKVLFQNWGVEPIDNVMGMIGILPDMTPSIEMSMRGVRISKMGVDEYSSTERVVVSIDRFLRVRDQRGNVLLSPEEVSETQGTEKLTITYSSSMMWEINGPESVLVNTYQWIIRNWETVKIQWSQNPTMLYNKMEFEPFQSLVPKAIRGQYSGFVRTLFQQMRDVLGTFDTAQIIKLLPFAAAPPKQSRMQFSSFTVNVRGSGMRILVRGNSPVFNYNKATKRLTVLGKDAGTLTEDPDEGTAGVESAVLRGFLILGKEDRRYGPALSINELSNLAKGEKANVLIGQGDVVLVMKRKRDSSILTDSQTATKRIRMAIN

SEQ ID NO: 5531 - protein, 759 aa, Artificial Sequence; identical to SEQ ID NO: 5530
  anti-influenza_Chain

SEQ ID NO: 5532 - protein, 824 aa, Artificial Sequence
  anti-influenza_Chain
MMLRKKTKQLISSILILVLLLSLFPAALAAEGNTREDNFKHLLGNDNVKRPSEAGALQLQEVDGQMTLVDQHGEKIQLRGMSTHGLQWFPEILNDNAYKALSNDWDSNMIRLAMYVGENGYATNPELIKQRVIDGIELAIENDMYVIVDWHVHAPGDPRDPVYAGAKDFFREIAALYPNNPHIIYELANEPSSNNNGGAGIPNNEEGWKAVKEYADPIVEMLRKSGNADDNIIIVGSPNWSQRPDLAADNPIDDHHTMYTVHFYTGSHAASTESYPSETPNSERGNVMSNTRYALENGVAVFATEWGTSQASGDGGPYFDEADVWIEFLNENNISWANWSLTNKNEVSGAFTPFELGKSNATNLDPGPDHVWAPEELSLSGEYVRARIKGVNYEPIDRTKYTKVLWDFNDGTKQGFGVNSDSPNKELIAVDNENNTLKVSGLDVSNDVSDGNFWANARLSANGWGKSVDILGAEKLTMDVIVDEPTTVAIAAIPQSSKSGWANPERAVRVNAEDFVQQTDGKYKAGLTITGEDAPNLKNIAFHEEDNNMNNIILFVGTDAADVIYLDNIKVIGTEVEIPVVHDPKGEAVLPSVFEDGTRQGWDWAGESGVKTALTIEEANGSNALSWEFGYPEVKPSDNWATAPRLDFWKSDLVRGENDYVAFDFYLDPVRATEGAMNINLVFQPPTNGYWVQAPKTYTINFDELEEANQVNGLYHYEVKINVRDITNIQDDTLLRNMMIIFADVESDFAGRVFVDNVRFEGAATTEPVEPEPVDPGEETPPVDEKEAKKEQKEAEKEEKEAVKEEKKEAKEEKKAVKNEAKKK

SEQ ID NO: 5533 - protein, 824 aa, Artificial Sequence; identical to SEQ ID NO: 5532
  anti-influenza_Chain

SEQ ID NO: 5534 - protein, 1021 aa, Artificial Sequence
  anti-influenza_Chain
MAGPHRSRAAGPPPFAVDEHVALEMVAFRGEVFAGHGLLADQRLIAHTGRPALNAQRITQQKQRDQCRGQRHRHHQGGRNLRKAHRTFHEHQSTQDQAHDAPHGQQAKTGHEGLGHEHAQAQHQQGQSNVVDRQDGEPVEAQHQKDGAQRAGNAPAGRVELEQQPVEAQHQQQEGDVRIGKRRQNAFAPPALDHVHGGPGRLQRHGLAVERHVPAVQQHQQRVQRGRQQIDHVLGHGLPGRQRLAFRDGPRRPVGVASPVLGQRPCPGHRIVQNLFRHGIDPCRVGRCRRSPSELHGMGCADVRARGHGRHMRGQRDEHPGRGRPCARRRHVDDDRDRTPQEKLYDVARGLDEPARRVHFDDEADRSVFRGLAQPAPDEPEGRRRDRLVLQRQSVNHRRGRLSRHRQQHQPQQQRPHGNQAFLGKYEKRRRKPTACLKSLRRFPDKDAPVLYFVNQLEKTKRRMTLLLVWLIFTGVAGEIRLEAEDGELLGVAVDSTLTGYSGRGYVTGFDAPEDSVRFSFEAPRGVYRVVFGVSFSSRFASYALRVDDWHQTGSLIKRGGGFFEASIGEIWLDEGAHTMAFQLMNGALDYVRLEPVSYGPPARPPAQLSDSQATASAQALFAFLLSEYGRHILAGQQQNPYRRDFDAINYVRNVTGKEPALVSFDLIDYSPTREAHGVVHYQTPEDWIAWAGRDGIVSLMWHWNAPTDLIEDPSQDCYWWYGFYTRCTTFDVAAALADTSSERYRLLLRDIDVIAAQLQKFQQADIPVLWRPLHEAAGGWFWWGAKGPEPFKQLWRLLYERLVHHHGLHNLIWVYTHEPGAAEWYPGDAYVDIVGRDVYADDPDALMRSDWNELQTLFGGRKLVALTETGTLPDVEVITDYGIWWSWFSIWTDPFLRDVDPDRLTRVYHSERVLTRDELPDWRSYVLHATTVQPAGDLALAVYPNPGAGRLHVEVGLPVAAPVVVEVFNLLGQRVFQYQAGMQPAGLWRRAFELALAPGVYLVQVRAGNLVARRRWVSVR

SEQ ID NO: 5535 - protein, 1021 aa, Artificial Sequence; identical to SEQ ID NO: 5534
  anti-influenza_Chain

SEQ ID NO: 5536 - protein, 1055 aa, Artificial Sequence
  anti-influenza_Chain
MRKKRRGFLNASTAVLVGILAGFLGVVLAATGALGFAVRESLLLKQFLFLSFEGNTDGASPFGKDVVVTASQDVAADGEYSLKVENRTSVWDGVEIDLTGKVNTGTDYLLSFHVYQTSDSPQLFSVLARTEDEKGERYKILADKVVVPNYWKEILVPFSPTFEGTPAKFSLIITSPKKTDFVFYVDNVQVLTPKEAGPKVVYETSFEKGIGDWQPRGSDVKISISPKVAHSGKKSLFVSNRQKGWHGAQISLKGILKTGKTYAFEAWVYQESGQDQTIIMTMQRKYSSDSSTKYEWIKAATVPSGQWVQLSGTYTIPAGVTVEDLTLYFESQNPTLEFYVDDVKVVDTTSAEIKLEMNPEEEIPALKDVLKDYFRVGVALPSKVFINQKDIALISKHSNSSTAENEMKPDSLLAGIENGKLKFRFETADKYIEFAQQNGMVVRGHTLVWHNQTPEWFFKDENGNLLSKEEMTERLREYIHTVVGHFKGKVYAWDVVNEAVDPNQPDGLRRSTWYQIMGPDYIELAFKFAREADPNAKLFYNDYNTFEPKKRDIIYNLVKSLKEKGLIDGIGMQCHISLATDIRQIEEAIKKFSTIPGIEIHITELDISVYRDSTSNYSEAPRTALIEQAHKMAQLFKIFKKYSNVITNVTFWGLKDDYSWRATRRNDWPLIFDKDYQAKLAYWAIVAPEVLPPLPKESKISEGEAVVVGMMDDSYMMSKPIEIYDEEGNVKATIRAIWKDSTIYVYGEVQDATKKPAEDGVAIFINPNNERTPYLQPDDTYVVLWTNWKSEVNREDVEVKKFVGPGFRRYSFEMSITIPGVEFKKDSYIGFDVAVIDDGKWYSWSDTTNSQKTNTMNYGTLKLEGVMVATAKYGTPVIDGEIDDIWNTTEEIETKSVAMGSLEKNATAKVRVLWDEENLYVLAIVKDPVLNKDNSNPWEQDSVEIFIDENNHKTGYYEDDDAQFRVNYMNEQSFGTGASAARFKTAVKLIEGGYIVEAAIKWKTIKPSPNTVIGFNVQVNDANEKGQRVGIISWSDPTNNSWRDPSKFGNLRLIK

SEQ ID NO: 5537 - protein, 1055 aa, Artificial Sequence; identical to SEQ ID NO: 5536
  anti-influenza_Chain

SEQ ID NO: 5538 - protein, 1059 aa, Artificial Sequence
  anti-influenza_Chain
MQVRKRRGLLDVSTAVLVGILAGFLGVVLAASGVLSFGKEASSKGDSSLETVLALSFEGTTEGVVPFGKDVVLTASQDVAADGEYSLKVENRTSPWDGVEIDLTGKVKSGADYLLSFQVYQSSDAPQLFNVVARTEDEKGERYDVILDKVVVSDHWKEILVPFSPTFEGTPAKYSLIIVASKNTNFNFYLDKVQVLAPKESGPKVIYETSFENGVGDWQPRGDVNIEASSEVAHSGKSSLFISNRQKGWQGAQINLKGILKTGKTYAFEAWVYQNSGQDQTIIMTMQRKYSSDASTQYEWIKSATVPSGQWVQLSGTYTIPAGVTVEDLTLYFESQNPTLEFYVDDVKIVDTTSAEIKIEMEPEKEIPALKEVLKDYFKVGVALPSKVFLNPKDIELITKHFNSITAENEMKPESLLAGIENGKLKFRFETADKYIQFVEENGMVIRGHTLVWHNQTPDWFFKDENGNLLSKEAMTERLKEYIHTVVGHFKGKVYAWDVVNEAVDPNQPDGLRRSTWYQIMGPDYIELAFKFAREADPDAKLFYNDYNTFEPRKRDIIYNLVKDLKEKGLIDGIGMQCHISLATDIKQIEEAIKKFSTIPGIEIHITELDMSVYRDSSSNYPEAPRTALIEQAHKMMQLFEIFKKYSNVITNVTFWGLKDDYSWRATRRNDWPLIFDKDHQAKLAYWAIVAPEVLPPLPKESRISEGEAVVVGMMDDSYLMSKPIEILDEEGNVKATIRAVWKDSTIYIYGEVQDKTKKPAEDGVAIFINPNNERTPYLQPDDTYAVLWTNWKTEVNREDVQVKKFVGPGFRRYSFEMSITIPGVEFKKDSYIGFDAAVIDDGKWYSWSDTTNSQKTNTMNYGTLKLEGIMVATAKYGTPVIDGEIDEIWNTTEEIETKAVAMGSLDKNATAKVRVLWDENYLYVLAIVKDPVLNKDNSNPWEQDSVEIFIDENNHKTGYYEDDDAQFRVNYMNEQTFGTGGSPARFKTAVKLIEGGYIVEAAIKWKTIKPTPNTVIGFNIQVNDANEKGQRVGIISWSDPTNNSWRDPSKFGNLRLIK

SEQ ID NO: 5539 - protein, 1059 aa, Artificial Sequence; identical to SEQ ID NO: 5538
  anti-influenza_Chain

SEQ ID NO: 5540 - protein, 106 aa, Artificial Sequence
  anti-OX40_LightChain
EIVVTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIK

SEQ ID NO: 5541 - protein, 107 aa, Artificial Sequence
  anti-OX40_LightChain
DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIK

SEQ ID NO: 5542 - protein, 107 aa, Artificial Sequence
  anti-OX40_LightChain
DIQMTQSPSSLSASVGDRVTITCRASQDISNYLNWYQQKPGKAPKLLIYYTSRLRSGVPSRFSGSGSGTDFTLTISSLQPEDFATYYCQQGHTLPPTFGQGTKVEIK

SEQ ID NO: 5543 - protein, 107 aa, Artificial Sequence
  anti-OX40_LightChain
DIQMTQSPSSLSASVGDRVTITCRASQDISNYLNWYQQKPGKTVKLLIYYTSRLRSGVPSRFSGSGSGTDFTLTISSLQPEDFATYYCQQGHTLPPTFGQGTKVEIK

SEQ ID NO: 5544 - protein, 107 aa, Artificial Sequence
  anti-OX40_LightChain
DIQMTQSPSSLSASVGDRVTITCRASQDISNYLNWYQQKPGKTVKLLIYYTSRLRSGVPSRFSGSGSGKDYTLTISSLQPEDFATYFCQQGHTLPPTFGQGTKVEIK

SEQ ID NO: 5545 - protein, 107 aa, Artificial Sequence
  anti-OX40_LightChain
DIQMTQSPSSLSASVGDRVTITCRASQDISNYLNWYQQKPGKAPKLLIYYTSRLRSGVPSRFSGSGSGTDFTLTISSLQPEDFATYYCQQGHTLPATFGQGTKVEIK

SEQ ID NO: 5546 - protein, 107 aa, Artificial Sequence
  anti-OX40_LightChain
DIQMTQSPSSLSASVGDRVTITCRASQDISNYLNWYQQKPGKAPKLLIYYTSRLRSGVPSRFSGSGSGTDFTLTISSLQPEDFATYYCQQGHTAPPTFGQGTKVEIK

SEQ ID NO: 5547 - protein, 107 aa, Artificial Sequence
  anti-OX40_LightChain
DIQMTQSPSSLSASVGDRVTITCRASQDISNYLNWYQQKPGKAPKLLIYYTSRLRSGVPSRFSGSGSGTDFTLTISSLQPEDFATYYCQQGATLPPTFGQGTKVEIK

SEQ ID NO: 5548 - protein, 107 aa, Artificial Sequence
  anti-OX40_LightChain
DIQMTQSPSSLSASVGDRVTITCRASQDISNYLNWYQQKPGKAPKLLIYYTSRLRSGVPSRFSGSGSGTDFTLTISSLQPEDFATYYCQQGHALPPTFGQGTKVEIK

SEQ ID NO: 5549 - protein, 107 aa, Artificial Sequence
  anti-OX40_LightChain
DIQMTQSPSSLSASVGDRVTITCRASQDISNYLNWYQQKPGKAPKLLIYYTSRLRSGVPSRFSGSGSGTDFTLTISSLQPEDFATYYCQQAHTLPPTFGQGTKVEIK

SEQ ID NO: 5550 - protein, 107 aa, Artificial Sequence
  anti-OX40_LightChain
DIQMTQSPSSLSASVGDRVTITCRASQDISNYLNWYQQKPGKAPKLLIYYTSRLRSGVPSRFSGSGSGTDFTLTISSLQPEDFATYYCQQGHTLAPTFGQGTKVEIK

SEQ ID NO: 5551 - protein, 107 aa, Artificial Sequence
  anti-OX40_LightChain
DIQMTQSPSSLSASVGDRVTITCRASQDISNYLNWYQQKPGKAPKLLIYYTSRLRSGVPSRFSGSGSGTDFTLTISSLQPEDFATYYCQAGHTLPPTFGQGTKVEIK

SEQ ID NO: 5552 - protein, 107 aa, Artificial Sequence
  anti-OX40_LightChain
DIQMTQSPSSLSASVGDRVTITCRASQDISNYLNWYQQKPGKAPKLLIYYTSKLHSGVPSRFSGSGSGTDYTLTISSLQPEDFATYYCQQGSALPWTFGQGTKVEIK

SEQ ID NO: 5553 - protein, 107 aa, Artificial Sequence
  anti-OX40_LightChain
DIQMTQSPSSLSASVGDRVTITCRASQDISNYLNWYQQKPGKAVKLLIYYTSKLHSGVPSRFSGSGSRTDYTLTISSLQPEDFATYYCQQGSALPWTFGQGTKVEIK

SEQ ID NO: 5554 - protein, 117 aa, Artificial Sequence
  anti-OX40_HeavyChain
EVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCVLAPRWYFSVWGQGTLVTVSS

SEQ ID NO: 5555 - protein, 117 aa, Artificial Sequence
  anti-OX40_HeavyChain
EVQLVQSGAEVKKPGASVKVSCKASGYTFTDSYMSWVRQAPGQGLEWIGDMYPDNGDSSYNQKFRERVTITVDTSTSTAYLELSSLRSEDTAVYYCVLAPRWYFSVWGQGTLVTVSS

SEQ ID NO: 5556 - protein, 117 aa, Artificial Sequence
  anti-OX40_HeavyChain
EVQLVQSGAEVKKPGASVKVSCKASGYTFTDSYMSWVRQAPGQGLEWIGDMYPDNGDSSYNQKFRERVTLTVDTSTSTAYLELSSLRSEDTAVYYCVLAPRWYFSVWGQGTLVTVSS

SEQ ID NO: 5557 - protein, 117 aa, Artificial Sequence
  anti-OX40_HeavyChain
EVQLVQSGAEVKKPGASVKVSCKASGYTFTDAYMSWVRQAPGQGLEWIGDMYPDNGDSSYNQKFRERVTITRDTSTSTAYLELSSLRSEDTAVYYCVLAPRWYFSVWGQGTLVTVSS

SEQ ID NO: 5558 - protein, 117 aa, Artificial Sequence
  anti-OX40_HeavyChain
EVQLVQSGAEVKKPGASVKVSCKASGYTFTESYMSWVRQAPGQGLEWIGDMYPDNGDSSYNQKFRERVTITRDTSTSTAYLELSSLRSEDTAVYYCVLAPRWYFSVWGQGTLVTVSS

SEQ ID NO: 5559 - protein, 117 aa, Artificial Sequence
  anti-OX40_HeavyChain
EVQLVQSGAEVKKPGASVKVSCKASGYTFTDSYMSWVRQAPGQGLEWIGDMYPDNADSSYNQKFRERVTITRDTSTSTAYLELSSLRSEDTAVYYCVLAPRWYFSVWGQGTLVTVSS

SEQ ID NO: 5560 - protein, 117 aa, Artificial Sequence
  anti-OX40_HeavyChain
EVQLVQSGAEVKKPGASVKVSCKASGYTFTDSYMSWVRQAPGQGLEWIGDMYPDNADASYNQKFRERVTITRDTSTSTAYLELSSLRSEDTAVYYCVLAPRWYFSVWGQGTLVTVSS

SEQ ID NO: 5561 - protein, 117 aa, Artificial Sequence
  anti-OX40_HeavyChain
EVQLVQSGAEVKKPGASVKVSCKASGYTFTDSYMSWVRQAPGQGLEWIGDMYPDNGDASYNQKFRERVTITRDTSTSTAYLELSSLRSEDTAVYYCVLAPRWYFSVWGQGTLVTVSS

SEQ ID NO: 5562 - protein, 117 aa, Artificial Sequence
  anti-OX40_HeavyChain
EVQLVQSGAEVKKPGASVKVSCKASGYTFTDSYMSWVRQAPGQGLEWIGDMYPDSGDSSYNQKFRERVTITRDTSTSTAYLELSSLRSEDTAVYYCVLAPRWYFSVWGQGTLVTVSS

SEQ ID NO: 5563 - protein, 117 aa, Artificial Sequence
  anti-OX40_HeavyChain
EVQLVQSGAEVKKPGASVKVSCKASGYTFTDSYMSWVRQAPGQGLEWIGDMYPDNGSSSYNQKFRERVTITRDTSTSTAYLELSSLRSEDTAVYYCVLAPRWYFSVWGQGTLVTVSS

SEQ ID NO: 5564 - protein, 117 aa, Artificial Sequence
  anti-OX40_HeavyChain
EVQLVQSGAEVKKPGASVKVSCKASGYTFTDAYMSWVRQAPGQGLEWIGDMYPDNADASYNQKFRERVTITRDTSTSTAYLELSSLRSEDTAVYYCVLAPRWYFSVWGQGTLVTVSS

SEQ ID NO: 5565 - protein, 117 aa, Artificial Sequence
  anti-OX40_HeavyChain
EVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCVLAPRWYFSAWGQGTLVTVSS

SEQ ID NO: 5566 - protein, 117 aa, Artificial Sequence
  anti-OX40_HeavyChain
EVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCVLAPRWYFAVWGQGTLVTVSS

SEQ ID NO: 5567 - protein, 117 aa, Artificial Sequence
  anti-OX40_HeavyChain
EVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCALAPRWYFSVWGQGTLVTVSS

SEQ ID NO: 5568 - protein, 117 aa, Artificial Sequence
  anti-OX40_HeavyChain
EVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCVAAPRWYFSVWGQGTLVTVSS

SEQ ID NO: 5569 - protein, 118 aa, Artificial Sequence
  anti-OX40_HeavyChain
EVQLVESGGGLVQPGGSLRLSCAASGFTFSSYSMNWVRQAPGKGLEWVSYISSSSSTIDYADSVKGRFTISRDNAKNSLYLQMNSLRDEDTAVYYCARESGWYLFDYWGQGTLVTVSS

SEQ ID NO: 5570 - protein, 121 aa, Artificial Sequence
  anti-OX40_HeavyChain
QVQLQESGPGLVKPSQTLSLTCAVYGGSFSSGYWNWIRQHPGKGLEWIGYISYNGITYHNPSLKSRITINPDTSKNQFSLQLNSVTPEDTAVYYCARYRYDYDGGHAMDYWGQGTLVTVSS

SEQ ID NO: 5571 - protein, 121 aa, Artificial Sequence
  anti-OX40_HeavyChain
QVQLQESGPGLVKPSQTLSLTCAVYGGSFSSGYWNWIRKHPGKGLEWIGYISYNGITYHNPSLKSRITINRDTSKNQFSLQLNSVTPEDTAVYYCARYRYDYDGGHAMDYWGQGTLVTVSS

SEQ ID NO: 5572 - protein, 121 aa, Artificial Sequence
  anti-OX40_HeavyChain
QVQLQESGPGLVKPSQTLSLTCAVYGDSFSSGYWNWIRKHPGKGLEYMGYISYNGITYHNPSLKSRITINRDTSKNQYSLQLNSVTPEDTAVYFCARYRYDYDGGHAMDYWGQGTLVTVSS

SEQ ID NO: 5573 - protein, 121 aa, Artificial Sequence
  anti-OX40_HeavyChain
QVQLQESGPGLVKPSQTLSLTCAVYGDSFSSGYWNWIRKHPGKGLEYIGYISYNGITYHNPSLKSRITINRDTSKNQYSLQLNSVTPEDTAVYFCARYRYDYDGGHAMDYWGQGTLVTVSS

SEQ ID NO: 5574 - protein, 121 aa, Artificial Sequence
  anti-OX40_HeavyChain
QVQLQESGPGLVKPSQTLSLTCAVYGDSFSSGYWNWIRKHPGKGLEYIGYISYNGITYHNPSLKSRITINRDTSKNQFSLQLNSVTPEDTAVYFCARYRYDYDGGHAMDYWGQGTLVTVSS

SEQ ID NO: 5575 - protein, 121 aa, Artificial Sequence
  anti-OX40_HeavyChain
QVQLQESGPGLVKPSQTLSLTCAVYGDSFSSGYWNWIRKHPGKGLEYIGYISYNGITYHNPSLKSRITINRDTSKNQYSLQLNSVTPEDTAVYYCARYRYDYDGGHAMDYWGQGTLVTVSS

SEQ ID NO: 5576 - protein, 121 aa, Artificial Sequence
  anti-OX40_HeavyChain
QVQLQESGPGLVKPSQTLSLTCAVYGDSFSSGYWNWIRKHPGKGLEYIGYISYNGITYHNPSLKSRITINRDTSKNQFSLQLNSVTPEDTAVYYCARYRYDYDGGHAMDYWGQGTLVTVSS

SEQ ID NO: 5577 - protein, 121 aa, Artificial Sequence
  anti-OX40_HeavyChain
QVQLQESGPGLVKPSQTLSLTCAVYGGSFSSGYWNWIRKHPGKGLEYIGYISYNGITYHNPSLKSRITINPDTSKNQYSLQLNSVTPEDTAVYFCARYRYDYDGGHAMDYWGQGTLVTVSS

SEQ ID NO: 5578 - protein, 121 aa, Artificial Sequence
  anti-OX40_HeavyChain
QVQLQESGPGLVKPSQTLSLTCAVYGGSFSSGYWNWIRKHPGKGLEYIGYISYNGITYHNPSLKSRITINRDTSKNQYSLQLNSVTPEDTAVYFCARYRYDYDGGHAMDYWGQGTLVTVSS

SEQ ID NO: 5579 - protein, 121 aa, Artificial Sequence
  anti-OX40_HeavyChain
QVQLQESGPGLVKPSQTLSLTCAVYGGSFSSGYWNWIRKHPGKGLEYIGYISYNGITYHNPSLKSRITINRDTSKNQYSLQLNSVTPEDTAVYYCARYRYDYDGGHAMDYWGQGTLVTVSS

SEQ ID NO: 5580 - protein, 121 aa, Artificial Sequence
  anti-OX40_HeavyChain
QVQLQESGPGLVKPSQTLSLTCAVYGGSFSSGYWNWIRKHPGKGLEYIGYISYNGITYHNPSLKSRITINPDTSKNQYSLQLNSVTPEDTAVYYCARYRYDYDGGHAMDYWGQGTLVTVSS

SEQ ID NO: 5581 - protein, 121 aa, Artificial Sequence
  anti-OX40_HeavyChain
QVQLQESGPGLVKPSQTLSLTCAVYGGSFSSGYWNWIRKHPGKGLEYIGYISYNAITYHNPSLKSRITINRDTSKNQYSLQLNSVTPEDTAVYYCARYKYDYDAGHAMDYWGQGTLVTVSS

SEQ ID NO: 5582 - protein, 121 aa, Artificial Sequence
  anti-OX40_HeavyChain
QVQLQESGPGLVKPSQTLSLTCAVYGGSFSSGYWNWIRKHPGKGLEYIGYISYNAITYHNPSLKSRITINRDTSKNQYSLQLNSVTPEDTAVYYCARYRYDYDGGHAMDYWGQGTLVTVSS

SEQ ID NO: 5583 - protein, 121 aa, Artificial Sequence
  anti-OX40_HeavyChain
QVQLQESGPGLVKPSQTLSLTCAVYGGSFSSGYWNWIRKHPGKGLEYIGYISYNGITYHNPSLKSRITINRDTSKNQYSLQLNSVTPEDTAVYYCARYKYDYDGGHAMDYWGQGTLVTVSS

SEQ ID NO: 5584 - protein, 121 aa, Artificial Sequence
  anti-OX40_HeavyChain
QVQLQESGPGLVKPSQTLSLTCAVYGGSFSSGYWNWIRKHPGKGLEYIGYISYSGITYHNPSLKSRITINRDTSKNQYSLQLNSVTPEDTAVYYCARYRYDYDGGHAMDYWGQGTLVTVSS

SEQ ID NO: 5585 - protein, 121 aa, Artificial Sequence
  anti-OX40_HeavyChain
QVQLQESGPGLVKPSQTLSLTCAVYGGSFSSGYWNWIRKHPGKGLEYIGYISYSGITYHNPSLKSRITINRDTSKNQYSLQLNSVTPEDTAVYYCARYKYDYDGGHAMDYWGQGTLVTVSS

SEQ ID NO: 5586 - protein, 121 aa, Artificial Sequence
  anti-OX40_HeavyChain
EVQLQESGPSLVKPSQTLSLTCSVTGDSFTSGYWNWIRKFPGNRLEYMGYISYNAITYHNPSLKSRISITRDTSKNHYYLQLNSVTTEDTATYFCARYRYDYDGGHAMDYWGQGTLVTVSS

SEQ ID NO: 5587 - protein, 121 aa, Artificial Sequence
  anti-OX40_HeavyChain
QVQLQESGPGLVKPSQTLSLTCAVYGGSFSSGYWNWIRKHPGKGLEYIGYISYNAITYHNPSLKSRITINRDTSKNQYSLQLNSVTPEDTAVYYCARYKYDYDGGHAMDYWGQGTLVTVSS

SEQ ID NO: 5588 - protein, 124 aa, Artificial Sequence
  anti-OX40_HeavyChain
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDQSTADYYFYYGMDVWGQGTTVTVSS

SEQ ID NO: 5589 - protein, 127 aa, Artificial Sequence
  anti-OX40_LightChain
METPAQLLFLLLLWLPDTTGEIVLTQSPGTLSLSPGERAILSCRASQSVSSSFLAWYQQKPGQAPRLLIYGAFSRATGIPDRFSGSGSGTDFTLTISRLEPEDFAVYYCQQYDSSRTFGQGTKVEIK

SEQ ID NO: 5590 - protein, 127 aa, Artificial Sequence
  anti-OX40_LightChain
MEAPAQLLFLLLLWLPDTTGEIVLTQSPATLSLSPGERATLSCRASQGVSSYLAWYQQKPGQAPRLLIYDASNRATGIPARFSGSGPGTDFTLTISSLEPEDFAVYYCQQRSNWHPTFGQGTKVEIK

SEQ ID NO: 5591 - protein, 127 aa, Artificial Sequence
  anti-OX40_LightChain
MEAPAQLLFLLLLWLPDTTGEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIK

SEQ ID NO: 5592 - protein, 129 aa, Artificial Sequence
  anti-OX40_LightChain
METPAQLLFLLLLWLPDTTGEIVLTQSPGTLSLSPGERATLSCRASQSVSSSYLAWYQQKPGQAPRLLIYGASSRATGIPDRFSGSGSGTDFTLTISRLEPEDFAVYYCQQYDSSLTFGGGTKVEIKRT

SEQ ID NO: 5593 - protein, 130 aa, Artificial Sequence
  anti-OX40_LightChain
MDMRVLAQLLGLLLLCFPGARCDIQMTQSPSSLSASVGNRVTITCRASQDISSWLAWYQQKPEKAPKSLIYAASSLQSGVPSRFSGSGSGTDFTLTISSLQPEDFATYYCQQYNSYPLTFGQGTRLEIKR

SEQ ID NO: 5594 - protein, 136 aa, Artificial Sequence
  anti-OX40_HeavyChain
MDTLCSTLLLLTIPSWVLSQITLKESGPTLVKPTQTLTLSCTFSGFSLSTSGVGVGWIRQPPGKALEWLALIHWDDAERYSPSLKSRLTITKDTSKNQVVLTMTNMDLVDTATYYCAHTRGAFDIWGQGTMVTVSS

SEQ ID NO: 5595 - protein, 136 aa, Artificial Sequence
  anti-OX40_HeavyChain
MDTLCSTLLLLTIPSWVLSQITLKESGPTLVKPTQTLTLTCTFSGFSLSTSGVGVGWIRQPPGKALEWLALIYWDDHSPYSPSLKSRLTITKDTSKNQVVLTMTNMDPVDTATYYCARTRGAFDIWGQGTMVTVSS

SEQ ID NO: 5596 - protein, 140 aa, Artificial Sequence
  anti-OX40_HeavyChain
MEWGPCWVFLVVILEGVQCGVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARGVYHNGWSFFDYWGQGTLLTVSS

SEQ ID NO: 5597 - protein, 141 aa, Artificial Sequence
  anti-OX40_HeavyChain
MDTLCSTLLLLTIPSWVLSQITLKESGPTLVKPKQTLTLTCTFSGFSLSTSGMGVGWIRQPPGKALEWLAVIYWDDHQLYSPSLKSRLTITKDTSKNQVVLTMTNMDPVDTATYYCAHRRGAFQHWGQGTLVTVSSASTKG

SEQ ID NO: 5598 - protein, 154 aa, Artificial Sequence
  anti-OX40_HeavyChain
MTMITPSLVPSSDPLVTAASVLEFALLIRLTIGQAVVSTQSTGGGLVQPGRSLRLSCAASGFTLDDYGMHWVRQAPGKGLEWVSGISWNSDSIGYVDSVKGRFTISRDNAKNSLYLQMNSLRVEDTALYYCVKDISGWYSFDYWGQGTLVTVSS

SEQ ID NO: 5599 - protein, 213 aa, Artificial Sequence
  anti-OX40_LightChain
EIVVTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5600 - protein, 450 aa, Artificial Sequence
  anti-OX40_HeavyChain
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDQSTADYYFYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 5601 - protein, 7 aa, Artificial Sequence
  anti-HIV_VRC01_VRC02_NIH45-46_LightChain_CDR
CQQYEFF

SEQ ID NO: 5602 - protein, 14 aa, Artificial Sequence
  anti-HIV_VRC01_HeavyChain_CDR
TRGKNCDYNWDFEH

SEQ ID NO: 5603 - protein, 7 aa, Artificial Sequence
  anti-HIV_3BNC60_LightChain_CDR
CQVYEFI

SEQ ID NO: 5604 - protein, 12 aa, Artificial Sequence
  anti-HIV_3BNC60_HeavyChain_CDR
ARQRSDFWDFDV

SEQ ID NO: 5605 - protein, 12 aa, Artificial Sequence
  anti-HIV_5H/I1-BMV-D5_HeavyChain_CDR
ARDNPTLLGSDY

SEQ ID NO: 5606 - protein, 11 aa, Artificial Sequence
  anti-HIV_8ANC195_LightChain_CDR
CQQYDTYPGTF

SEQ ID NO: 5607 - protein, 11 aa, Artificial Sequence [sequence omitted]

SEQ ID NO: 5608 - protein, 26 aa, Artificial Sequence
  anti-HIV_CH01_HeavyChain_CDR
ARGTDYTIDDAGIHYQGSGTFWYFDL

SEQ ID NO: 5609 - protein, 26 aa, Artificial Sequence
  anti-HIV_CH02_HeavyChain_CDR
ARGTDYTIDDQGRFYQGSGTFWYFDF

SEQ ID NO: 5610 - protein, 26 aa, Artificial Sequence
  anti-HIV_CH03_HeavyChain_CDR
ARGTDYTIDDQGIFYKGSGTFWYFDL

SEQ ID NO: 5611 - protein, 11 aa, Artificial Sequence [sequence omitted]

SEQ ID NO: 5612 - protein, 26 aa, Artificial Sequence
  anti-HIV_CH04_HeavyChain_CDR
ARGTDYTIDDQGIRYQGSGTFWYFDV

SEQ ID NO: 5613 - protein, 18 aa, Artificial Sequence
  anti-HIV_NIH45-46_HeavyChain_CDR
TRGKYCTARDYYNWDFEH

SEQ ID NO: 5614 - protein, 30 aa, Artificial Sequence
  anti-HIV_PG16_HeavyChain_CDR
AREAGGPIWHDDVKYYDFNDGYYNYHYMDV

SEQ ID NO: 5615 - protein, 12 aa, Artificial Sequence
  anti-HIV_PGT122_LightChain_CDR
HIWDSRRPTNWV

SEQ ID NO: 5616 - protein, 24 aa, Artificial Sequence
  anti-HIV_PGT122_HeavyChain_CDR
TKHGRRIYGVVAFKEWFTYFYMDV

SEQ ID NO: 5617 - protein, 12 aa, Artificial Sequence
  anti-HIV_PGT123_LightChain_CDR
HIYDARGGTNWV

SEQ ID NO: 5618 - protein, 24 aa, Artificial Sequence
  anti-HIV_PGT123_HeavyChain_CDR
ALHGKRIYGIVALGELFTYFYMDV

SEQ ID NO: 5619 - protein, 10 aa, Artificial Sequence
  anti-HIV_PGT125_PGT128_LightChain_CDR
GSLVGNWDVI

SEQ ID NO: 5620 - protein, 19 aa, Artificial Sequence
  anti-HIV_PGT125_HeavyChain_CDR
FDGEVLVYNHWPKPAWVDL

SEQ ID NO: 5621 - protein, 10 aa, Artificial Sequence
  anti-HIV_PGT126_PGT127_LightChain_CDR
SSLVGNWDVI

SEQ ID NO: 5622 - protein, 19 aa, Artificial Sequence
  anti-HIV_PGT126_HeavyChain_CDR
FDGEVLVYHDWPKPAWVDL

SEQ ID NO: 5623 - protein, 19 aa, Artificial Sequence
  anti-HIV_PGT127_HeavyChain_CDR
FGGEVLVYRDWPKPAWVDL

SEQ ID NO: 5624 - protein, 19 aa, Artificial Sequence
  anti-HIV_PGT128_HeavyChain_CDR
FGGEVLRYTDWPKPAWVDL

SEQ ID NO: 5625 - protein, 10 aa, Artificial Sequence
  anti-HIV_PGT130_LightChain_CDR
SSLFGRWDVV

SEQ ID NO: 5626 - protein, 19 aa, Artificial Sequence
  anti-HIV_PGT130_HeavyChain_CDR
SGGDILYYYEWQKPHWFSP

SEQ ID NO: 5627 - protein, 10 aa, Artificial Sequence
  anti-HIV_PGT131_LightChain_CDR
SSLSGRWDIV

SEQ ID NO: 5628 - protein, 19 aa, Artificial Sequence
  anti-HIV_PGT131_HeavyChain_CDR
SGGDILYYIEWQKPHWFYP

SEQ ID NO: 5629 - protein, 9 aa, Artificial Sequence
  anti-HIV_PGT135_PGT136_PGT137_LightChain_CDR
QQYEEWPRT

SEQ ID NO: 5630 - protein, 18 aa, Artificial Sequence
  anti-HIV_PGT135_HeavyChain_CDR
HRHHDVFMLVPIAGWFDV

SEQ ID NO: 5631 - protein, 18 aa, Artificial Sequence
  anti-HIV_PGT136_HeavyChain_CDR
HKYHDIFRVVPVAGWFDP

SEQ ID NO: 5632 - protein, 18 aa, Artificial Sequence
  anti-HIV_PGT137_HeavyChain_CDR
HKYHDIVMVVPIAGWFDP

SEQ ID NO: 5633 - protein, 9 aa, Artificial Sequence
  anti-HIV_PGT141_PGT142_PGT143_PGT144_LightChain_CDR
MQGLNRPWT

SEQ ID NO: 5634 - protein, 32 aa, Artificial Sequence
  anti-HIV_PGT141_HeavyChain_CDR
GSKHRLRDYVLYDDYGLINYQEWNDYLEFLDV

SEQ ID NO: 5635 - protein, 32 aa, Artificial Sequence
  anti-HIV_PGT144_HeavyChain_CDR
GSKHRLRDYVLYDDYGLINQQEWNDYLEFLDV

SEQ ID NO: 5636 - protein, 9 aa, Artificial Sequence
  anti-HIV_PGT145_LightChain_CDR
MQGLHSPWT

SEQ ID NO: 5637 - protein, 31 aa, Artificial Sequence
  anti-HIV_PGT145_HeavyChain_CDR
GSKHRLRDYFLYNEYGPNYEEWGDYLATLDV

SEQ ID NO: 5638 - protein, 7 aa, Artificial Sequence [sequence omitted]

SEQ ID NO: 5639 - protein, 15 aa, Artificial Sequence
  anti-HIV_VRC-CH30_VRC-CH31_VRC-CH32_VRC-CH34_HeavyChain_CDR
ARAQKRGRSEWAYAH

SEQ ID NO: 5640 - protein, 15 aa, Artificial Sequence
  anti-HIV_VRC-CH33_HeavyChain_CDR
ARAQKRARSEWAYAH

SEQ ID NO: 5641 - protein, 7 aa, Artificial Sequence
  anti-HIV_VRC-PG04_LightChain_CDR
CQQLEFF

SEQ ID NO: 5642 - protein, 16 aa, Artificial Sequence
  anti-HIV_VRC-PG04_HeavyChain_CDR
ARQKFYTGGQGWYFDL

SEQ ID NO: 5643 - protein, 7 aa, Artificial Sequence
  anti-HIV_VRC-PG04b_LightChain_CDR
CQQVEFF

SEQ ID NO: 5644 - protein, 16 aa, Artificial Sequence
  anti-HIV_VRC-PG04b_HeavyChain_CDR
ARQKFERGGQGWYFDL

SEQ ID NO: 5645 - protein, 7 aa, Artificial Sequence
  anti-HIV_VRC03_LightChain_CDR
CQQFEFF

SEQ ID NO: 5646 - protein, 16 aa, Artificial Sequence
  anti-HIV_VRC03_HeavyChain_CDR
VRRGSCDYCGDFPWQY

SEQ ID NO: 5647 - protein, 7 aa, Artificial Sequence
  anti-HIV_1TJG_P-Chain
ELDKWAS

SEQ ID NO: 5648 - protein, 23 aa, Artificial Sequence
  anti-HIV_2B1H_P-Chain
NNTKKSIKIRPRQAFYATNGIIG

SEQ ID NO: 5649 - protein, 23 aa, Artificial Sequence
  anti-HIV_2B1A_P-Chain
NNTRKSIHLGPGRAFYATGDIIG

SEQ ID NO: 5650 - protein, 19 aa, Artificial Sequence
  anti-HIV_2B0S_P-Chain
KRKRIHIGPGRAFYTTKNA

SEQ ID NO: 5651 - protein, 23 aa, Artificial Sequence
  anti-HIV_3UJJ_P-Chain
NNTRKSIRIGPGQAFYATGDIIG

SEQ ID NO: 5652 - protein, 23 aa, Artificial Sequence
  anti-HIV_3UJI_P-Chain
YNKRKRIHIGPGRAFYTTKNIIG

SEQ ID NO: 5653 - protein, 25 aa, Artificial Sequence
  anti-HIV_3MLZ_P-Chain
SNNTRKGIHIGPGRAFYATGQITGD

SEQ ID NO: 5654 - protein, 20 aa, Artificial Sequence
  anti-HIV_3MLV_Q-Chain
NNTRKRIRVGPGQTVYATNA

SEQ ID NO: 5655 - protein, 23 aa, Artificial Sequence
  anti-HIV_3MLU_P-Chain
NNTRKSIRIGPGQAFYATGGIIG

SEQ ID NO: 5656 - protein, 20 aa, Artificial Sequence
  anti-HIV_3MLR_P-Chain
NNTKKGIAIGPGRTLYAREK

SEQ ID NO: 5657 - protein, 16 aa, Artificial Sequence
  anti-HIV_4XCF_P-Chain
NWWDITNWLWYIKKKK

SEQ ID NO: 5658 - protein, 15 aa, Artificial Sequence
  anti-HIV_4XBE_P-Chain
NWFDITNWLWYIKKK

SEQ ID NO: 5659 - protein, 16 aa, Artificial Sequence
  anti-HIV_4XAW_P-Chain
NWFDITNWLWYIKKKK

SEQ ID NO: 5660 - protein, 15 aa, Artificial Sequence
  anti-HIV_2QSC_P-Chain
RKRIHIGPGRAFYTT

SEQ ID NO: 5661 - protein, 20 aa, Artificial Sequence
  anti-HIV_3MLS_S-Chain
ACQAFYASSPRKSIHIGACA

SEQ ID NO: 5662 - protein, 14 aa, Artificial Sequence
  anti-HIV_3GO1_P-Chain
RKRIHIGPGRAFYT

SEQ ID NO: 5663 - protein, 14 aa, Artificial Sequence
  anti-HIV_4M1D_Q-Chain
CRIHIGPGRAFYTC

SEQ ID NO: 5664 - protein, 13 aa, Artificial Sequence
  anti-HIV_3C2A_Q-Chain
KSIHLGPGRAFYA

SEQ ID NO: 5665 - protein, 4 aa, Artificial Sequence
  anti-HIV_CDR
QSKT

SEQ ID NO: 5666 - protein, 4 aa, Artificial Sequence
  anti-HIV_CDR
DLID

SEQ ID NO: 5667 - protein, 5 aa, Artificial Sequence
  anti-HIV_CDR
DHYWS

SEQ ID NO: 5668 - protein, 5 aa, Artificial Sequence
  anti-HIV_CDR
GRFWS

SEQ ID NO: 5669 - protein, 5 aa, Artificial Sequence
  anti-HIV_CDR
NYYWT

SEQ ID NO: 5670 - protein, 5 aa, Artificial Sequence
  anti-HIV_CDR
DAYWS

SEQ ID NO: 5671 - protein, 5 aa, Artificial Sequence
  anti-HIV_CDR
DSYWS

SEQ ID NO: 5672 - protein, 5 aa, Artificial Sequence
  anti-HIV_CDR
DNYWS

SEQ ID NO: 5673 - protein, 5 aa, Artificial Sequence
  anti-HIV_CDR
NSYWT

SEQ ID NO: 5674 - protein, 5 aa, Artificial Sequence
  anti-HIV_CDR
SYYWS

SEQ ID NO: 5675 - protein, 5 aa, Artificial Sequence
  anti-HIV_CDR
SFGMH

SEQ ID NO: 5676 - protein, 5 aa, Artificial Sequence
  anti-HIV_CDR
AAFQW

SEQ ID NO: 5677 - protein, 5 aa, Artificial Sequence
  anti-HIV_CDR
QQLRT

SEQ ID NO: 5678 - protein, 5 aa, Artificial Sequence
  anti-HIV_CDR
QQYDS

SEQ ID NO: 5679 - protein, 5 aa, Artificial Sequence
  anti-HIV_CDR
QQLAT

SEQ ID NO: 5680 - protein, 5 aa, Artificial Sequence
  anti-HIV_CDR
ESFQW

SEQ ID NO: 5681 - protein, 5 aa, Artificial Sequence
  anti-HIV_CDR
EVYEF

SEQ ID NO: 5682 - protein, 5 aa, Artificial Sequence
  anti-HIV_CDR
ASLEF

SEQ ID NO: 5683 - protein, 5 aa, Artificial Sequence
  anti-HIV_CDR
SVYEF

SEQ ID NO: 5684 - protein, 5 aa, Artificial Sequence
  anti-HIV_CDR
AALEF

SEQ ID NO: 5685 - protein, 5 aa, Artificial Sequence
  anti-HIV_CDR
AVVEF

SEQ ID NO: 5686 - protein, 5 aa, Artificial Sequence
  anti-HIV_CDR
QLFEF

SEQ ID NO: 5687 - protein, 5 aa, Artificial Sequence
  anti-HIV_CDR
AVFQW

SEQ ID NO: 5688 - protein, 5 aa, Artificial Sequence
  anti-HIV_CDR
AVLEF

SEQ ID NO: 5689 - protein, 5 aa, Artificial Sequence
  anti-HIV_CDR
NGFDV

SEQ ID NO: 5690 - protein, 5 aa, Artificial Sequence
  anti-HIV_CDR
QQYEF

SEQ ID NO: 5691 - protein, 5 aa, Artificial Sequence
  anti-HIV_CDR
QHYEF

SEQ ID NO: 5692 - protein, 5 aa, Artificial Sequence
  anti-HIV_CDR
QVYEV

SEQ ID NO: 5693 - protein, 5 aa, Artificial Sequence
  anti-HIV_CDR
QVYEF

SEQ ID NO: 5694 - protein, 5 aa, Artificial Sequence
  anti-HIV_CDR
FSKES

SEQ ID NO: 5695 - protein, 5 aa, Artificial Sequence
  anti-HIV_CDR
LKLSS

SEQ ID NO: 5696 - protein, 5 aa, Artificial Sequence
  anti-HIV_CDR
YKVSS

SEQ ID NO: 5697 - protein, 5 aa, Artificial Sequence
  anti-HIV_CDR
PPQES

SEQ ID NO: 5698 - protein, 5 aa, Artificial Sequence
  anti-HIV_CDR
TARDY

SEQ ID NO: 5699 - protein, 5 aa, Artificial Sequence
  anti-HIV_CDR
MQSIQ

SEQ ID NO: 5700 - protein, 5 aa, Artificial Sequence
  anti-HIV_CDR
HQLDT

SEQ ID NO: 5701 - protein, 5 aa, Artificial Sequence
  anti-HIV_CDR
HQLDS

SEQ ID NO: 5702 - protein, 5 aa, Artificial Sequence
  anti-HIV_CDR
QQLGT

SEQ ID NO: 5703 - protein, 5 aa, Artificial Sequence
  anti-HIV_CDR
QKATT

SEQ ID NO: 5704 - protein, 5 aa, Artificial Sequence
  anti-HIV_CDR
LFAGT

SEQ ID NO: 5705 - protein, 6 aa, Artificial Sequence
  anti-HIV_CDR
VRGSSP

SEQ ID NO: 5706 - protein, 6 aa, Artificial Sequence
  anti-HIV_CDR
GLLFVV

SEQ ID NO: 5707 - protein, 6 aa, Artificial Sequence
  anti-HIV_CDR
MDWTWS

SEQ ID NO: 5708 - protein, 6 aa, Artificial Sequence
  anti-HIV_CDR
MDWTWR

SEQ ID NO: 5709 - protein, 6 aa, Artificial Sequence
  anti-HIV_CDR
MKHLWF

SEQ ID NO: 5710 - protein, 6 aa, Artificial Sequence
  anti-HIV_CDR
MDWIWR

SEQ ID NO: 5711 - protein, 6 aa, Artificial Sequence
  anti-HIV_CDR
MDWTWT

SEQ ID NO: 5712 - protein, 6 aa, Artificial Sequence
  anti-HIV_CDR
MKHLFL

SEQ ID NO: 5713 - protein, 6 aa, Artificial Sequence
  anti-HIV_CDR
QLLQSN

SEQ ID NO: 5714 - protein, 6 aa, Artificial Sequence
  anti-HIV_CDR
GGSPEH

SEQ ID NO: 5715 - protein, 6 aa, Artificial Sequence
  anti-HIV_CDR
LEGTDY

SEQ ID NO: 5716 - protein, 6 aa, Artificial Sequence
  anti-HIV_CDR
QQYPST

SEQ ID NO: 5717 - protein, 7 aa, Artificial Sequence
  anti-HIV_CDR
NNHDRPS

SEQ ID NO: 5718 - protein, 7 aa, Artificial Sequence
  anti-HIV_CDR
NNQDRPA

SEQ ID NO: 5719 - protein, 7 aa, Artificial Sequence
  anti-HIV_CDR
NNNDRPS

SEQ ID NO: 5720 - protein, 7 aa, Artificial Sequence
  anti-HIV_CDR
NNQDRPS

SEQ ID NO: 5721 - protein, 7 aa, Artificial Sequence
  anti-HIV_CDR
DDSDRPS

SEQ ID NO: 5722 - protein, 7 aa, Artificial Sequence
  anti-HIV_CDR
WASTRHT

SEQ ID NO: 5723 - protein, 7 aa, Artificial Sequence
  anti-HIV_CDR
GATARDF

SEQ ID NO: 5724 - protein, 7 aa, Artificial Sequence
  anti-HIV_CDR
ASIKLAL

SEQ ID NO: 5725 - protein, 7 aa, Artificial Sequence
  anti-HIV_CDR
QQYGRSP

SEQ ID NO: 5726 - protein, 7 aa, Artificial Sequence
  anti-HIV_CDR
QQYYISP

SEQ ID NO: 5727 - protein, 7 aa, Artificial Sequence
  anti-HIV_CDR
QQSHSPS

SEQ ID NO: 5728 - protein, 7 aa, Artificial Sequence
  anti-HIV_CDR
GRCARRW

SEQ ID NO: 5729 - protein, 7 aa, Artificial Sequence
  anti-HIV_CDR
RFLFVVA

SEQ ID NO: 5730 - protein, 7 aa, Artificial Sequence
  anti-HIV_CDR
MSVSFLI

SEQ ID NO: 5731 - protein, 7 aa, Artificial Sequence
  anti-HIV_CDR
GSSNRCP

SEQ ID NO: 5732 - protein, 7 aa, Artificial Sequence
  anti-HIV_CDR
MKHLWFF

SEQ ID NO: 5733 - protein, 7 aa, Artificial Sequence
  anti-HIV_CDR
ASWDFDF

SEQ ID NO: 5734 - protein, 7 aa, Artificial Sequence
  anti-HIV_CDR
EIGVAEH

SEQ ID NO: 5735 - protein, 7 aa, Artificial Sequence
  anti-HIV_CDR
QKYDTAP

SEQ ID NO: 5736 - protein, 7 aa, Artificial Sequence
  anti-HIV_CDR
QQSSSTP

SEQ ID NO: 5737 - protein, 7 aa, Artificial Sequence
  anti-HIV_CDR
QQSAGTP

SEQ ID NO: 5738 - protein, 7 aa, Artificial Sequence
  anti-HIV_CDR
QQSSSKP

SEQ ID NO: 5739 - protein, 7 aa, Artificial Sequence
  anti-HIV_CDR
QEYNTYT

SEQ ID NO: 5740 - protein, 7 aa, Artificial Sequence
  anti-HIV_CDR
QEYNNYN

SEQ ID NO: 5741 - protein, 7 aa, Artificial Sequence
  anti-HIV_CDR
HYDALDY

SEQ ID NO: 5742 - protein, 8 aa, Artificial Sequence
  anti-HIV_CDR
AIFKGVQC

SEQ ID NO: 5743 - protein, 8 aa, Artificial Sequence
  anti-HIV_CDR
GPLGDYDF

SEQ ID NO: 5744 - protein, 8 aa, Artificial Sequence
  anti-HIV_CDR
QQYGSSLR

SEQ ID NO: 5745 - protein, 8 aa, Artificial Sequence
  anti-HIV_CDR
QQYSHYRT

SEQ ID NO: 5746 - protein, 8 aa, Artificial Sequence
  anti-HIV_CDR
QYYGMSVT

SEQ ID NO: 5747 - protein, 8 aa, Artificial Sequence
  anti-HIV_CDR
QQYENWLT

SEQ ID NO: 5748 - protein, 8 aa, Artificial Sequence
  anti-HIV_CDR
SGVHYMDV

SEQ ID NO: 5749 - protein, 8 aa, Artificial Sequence
  anti-HIV_CDR
QQYSGPLT

SEQ ID NO: 5750 - protein, 8 aa, Artificial Sequence
  anti-HIV_CDR
QQYYTVPS

SEQ ID NO: 5751 - protein, 8 aa, Artificial Sequence
  anti-HIV_CDR
QQYGSSIT

SEQ ID NO: 5752 - protein, 8 aa, Artificial Sequence
  anti-HIV_CDR
HQYNKWDT

SEQ ID NO: 5753 - protein, 8 aa, Artificial Sequence
  anti-HIV_CDR
QQSYTTPL

SEQ ID NO: 5754 - protein, 8 aa, Artificial Sequence
  anti-HIV_CDR
QRWETIDY

SEQ ID NO: 5755 - protein, 8 aa, Artificial Sequence
  anti-HIV_CDR
CSYAGSYT

SEQ ID NO: 5756 - protein, 8 aa, Artificial Sequence
  anti-HIV_CDR
QQYDNLPT

SEQ ID NO: 5757 - protein, 8 aa, Artificial Sequence
  anti-HIV_CDR
QQCTLPLT

SEQ ID NO: 5758 - protein, 8 aa, Artificial Sequence
  anti-HIV_CDR
QQSYSSVT

SEQ ID NO: 5759 - protein, 8 aa, Artificial Sequence
  anti-HIV_CDR
QQSHTSVT

SEQ ID NO: 5760 - protein, 8 aa, Artificial Sequence
  anti-HIV_CDR
QQTYASVT

SEQ ID NO: 5761 - protein, 8 aa, Artificial Sequence
  anti-HIV_CDR
QQYNSDYT

SEQ ID NO: 5762 - protein, 8 aa, Artificial Sequence
  anti-HIV_CDR
HLYVSRPV

SEQ ID NO: 5763 - protein, 8 aa, Artificial Sequence
  anti-HIV_CDR
QQYGRSPL

SEQ ID NO: 5764 - protein, 8 aa, Artificial Sequence
  anti-HIV_CDR
QQYGSSPL

SEQ ID NO: 5765 - protein, 8 aa, Artificial Sequence
  anti-HIV_CDR
QQYNDWPA

SEQ ID NO: 5766 - protein, 8 aa, Artificial Sequence
  anti-HIV_CDR
HQYGSSQR

SEQ ID NO: 5767 - protein, 8 aa, Artificial Sequence
  anti-HIV_CDR
QQTYSSVT

SEQ ID NO: 5768 - protein, 8 aa, Artificial Sequence
  anti-HIV_CDR
QQTYRSVT

SEQ ID NO: 5769 - protein, 8 aa, Artificial Sequence
  anti-HIV_CDR
QQYGSSWT

SEQ ID NO: 5770 - protein, 8 aa, Artificial Sequence
  anti-HIV_CDR
SSYAGINN

SEQ ID NO: 5771 - protein, 8 aa, Artificial Sequence
  anti-HIV_CDR
QKYGSSLT

SEQ ID NO: 5772 - protein, 8 aa, Artificial Sequence
  anti-HIV_CDR
MQALETLG

SEQ ID NO: 5773 - protein, 8 aa, Artificial Sequence
  anti-HIV_CDR
QQYAGSLT

SEQ ID NO: 5774 - protein, 8 aa, Artificial Sequence
  anti-HIV_CDR
RNWGNFDH

SEQ ID NO: 5775 - protein, 9 aa, Artificial Sequence
  anti-HIV_CDR
QQHYTTPWT

SEQ ID NO: 5776 - protein, 9 aa, Artificial Sequence
  anti-HIV_CDR
QQSFAVPYT

SEQ ID NO: 5777 - protein, 9 aa, Artificial Sequence
  anti-HIV_CDR
QQYKSYSGT

SEQ ID NO: 5778 - protein, 9 aa, Artificial Sequence
  anti-HIV_CDR
HQYAYSPRT

SEQ ID NO: 5779 - protein, 9 aa, Artificial Sequence
  anti-HIV_CDR
QQYNSFPPT

SEQ ID NO: 5780 - protein, 9 aa, Artificial Sequence
  anti-HIV_CDR
QQTYSNPRM

SEQ ID NO: 5781 - protein, 9 aa, Artificial Sequence
  anti-HIV_CDR
QQYEDPPWT

SEQ ID NO: 5782 - protein, 9 aa, Artificial Sequence
  anti-HIV_CDR
HQYFNTPRT

SEQ ID NO: 5783 - protein, 9 aa, Artificial Sequence
  anti-HIV_CDR
HQYFSTPRT

SEQ ID NO: 5784 - protein, 9 aa, Artificial Sequence
  anti-HIV_CDR
QHRSNWPWT

SEQ ID NO: 5785 - protein, 9 aa, Artificial Sequence
  anti-HIV_CDR
RGRRQIGDY

SEQ ID NO: 5786 - protein, 9 aa, Artificial Sequence
  anti-HIV_CDR
QQYGLSPWT

SEQ ID NO: 5787 - protein, 9 aa, Artificial Sequence
  anti-HIV_CDR
QQTYTSPIT

SEQ ID NO: 5788 - protein, 9 aa, Artificial Sequence
  anti-HIV_CDR
QQYGSSPPT

SEQ ID NO: 5789 - protein, 9 aa, Artificial Sequence
  anti-HIV_CDR
QQYGTSSCT

SEQ ID NO: 5790 - protein, 9 aa, Artificial Sequence
  anti-HIV_CDR
QQYDDAPIT

SEQ ID NO: 5791 - protein, 9 aa, Artificial Sequence
  anti-HIV_CDR
GPLLRYLDS

SEQ ID NO: 5792 - protein, 9 aa, Artificial Sequence
  anti-HIV_CDR
CLKKTSSYV

SEQ ID NO: 5793 - protein, 9 aa, Artificial Sequence
  anti-HIV_CDR
QQYNHWPQT

SEQ ID NO: 5794 - protein, 9 aa, Artificial Sequence
  anti-HIV_CDR
QQYSNLPYT

SEQ ID NO: 5795 - protein, 9 aa, Artificial Sequence
  anti-HIV_CDR
QQYDTYPGT

SEQ ID NO: 5796 - protein, 9 aa, Artificial Sequence
  anti-HIV_CDR
QEYSSTPYN

SEQ ID NO: 5797 - protein, 9 aa, Artificial Sequence
  anti-HIV_CDR
GAWDDTLYV

SEQ ID NO: 5798 - protein, 9 aa, Artificial Sequence
  anti-HIV_CDR
AAWDDTLYV

SEQ ID NO: 5799 - protein, 9 aa, Artificial Sequence
  anti-HIV_CDR
QQYYSDSIT

SEQ ID NO: 5800 - protein, 9 aa, Artificial Sequence
  anti-HIV_CDR
QQYGRSPYT

SEQ ID NO: 5801 - protein, 9 aa, Artificial Sequence
  anti-HIV_CDR
QQYTNYPWT

SEQ ID NO: 5802 - protein, 9 aa, Artificial Sequence
  anti-HIV_CDR
QQRHNWPIS

SEQ ID NO: 5803 - protein, 9 aa, Artificial Sequence
  anti-HIV_CDR
QQYHNWPRT

SEQ ID NO: 5804 - protein, 9 aa, Artificial Sequence
  anti-HIV_CDR
QQRSTWPPT

SEQ ID NO: 5805 - protein, 9 aa, Artificial Sequence
  anti-HIV_CDR
QQYDSFSWT

SEQ ID NO: 5806 - protein, 9 aa, Artificial Sequence
  anti-HIV_CDR
QQYNNLPVT

SEQ ID NO: 5807 - protein, 9 aa, Artificial Sequence
  anti-HIV_CDR
QQYNRYSYT

SEQ ID NO: 5808 - protein, 9 aa, Artificial Sequence
  anti-HIV_CDR
QEYYILPCS

SEQ ID NO: 5809 - protein, 9 aa, Artificial Sequence
  anti-HIV_CDR
QQYDNLLAH

SEQ ID NO: 5810 - protein, 9 aa, Artificial Sequence
  anti-HIV_CDR
HQCDNLIAR

SEQ ID NO: 5811 - protein, 9 aa, Artificial Sequence
  anti-HIV_CDR
QQSFSTLWT

SEQ ID NO: 5812 - protein, 9 aa, Artificial Sequence
  anti-HIV_CDR
HQSYSTPPT

SEQ ID NO: 5813 - protein, 9 aa, Artificial Sequence
  anti-HIV_CDR
QQGYSTPWT

SEQ ID NO: 5814 - protein, 9 aa, Artificial Sequence
  anti-HIV_CDR
QQYSTTPRT

SEQ ID NO: 5815 - protein, 9 aa, Artificial Sequence
  anti-HIV_CDR
QLYNSVPQT

SEQ ID NO: 5816 - protein, 9 aa, Artificial Sequence
  anti-HIV_CDR
QQRTSWPQT

SEQ ID NO: 5817 - protein, 9 aa, Artificial Sequence
  anti-HIV_CDR
QQFNTYSQT

SEQ ID NO: 5818 - protein, 9 aa, Artificial Sequence
  anti-HIV_CDR
MQSLQTPIT

SEQ ID NO: 5819 - protein, 9 aa, Artificial Sequence
  anti-HIV_CDR
QQYNSYPLT

SEQ ID NO: 5820 - protein, 9 aa, Artificial Sequence
  anti-HIV_CDR
QQYNSYSGT

SEQ ID NO: 5821 - protein, 9 aa, Artificial Sequence
  anti-HIV_CDR
QSYDSSLSG

SEQ ID NO: 5822 - protein, 9 aa, Artificial Sequence
  anti-HIV_CDR
SQGNTAIDY

SEQ ID NO: 5823 - protein, 9 aa, Artificial Sequence
  anti-HIV_CDR
EEPRDAFDL

SEQ ID NO: 5824 - protein, 9 aa, Artificial Sequence
  anti-HIV_CDR
QQSYTTPVT

SEQ ID NO: 5825 - protein, 9 aa, Artificial Sequence
  anti-HIV_CDR
AGREGWFDP

SEQ ID NO: 5826 - protein, 9 aa, Artificial Sequence
  anti-HIV_CDR
QQYYSTPHT

SEQ ID NO: 5827 - protein, 9 aa, Artificial Sequence
  anti-HIV_CDR
QQSYSIAGT

SEQ ID NO: 5828 - protein, 9 aa, Artificial Sequence
  anti-HIV_CDR
QNYNKPPRT

SEQ ID NO: 5829 - protein, 9 aa, Artificial Sequence
  anti-HIV_CDR
MQSIQLPLT

SEQ ID NO: 5830 - protein, 9 aa, Artificial Sequence
  anti-HIV_CDR
MQALQTSLT

SEQ ID NO: 5831 - protein, 9 aa, Artificial Sequence
  anti-HIV_CDR
QQYSSSPRT

SEQ ID NO: 5832 - protein, 9 aa, Artificial Sequence
  anti-HIV_CDR
QAWDSSTAV

SEQ ID NO: 5833 - protein, 9 aa, Artificial Sequence
  anti-HIV_CDR
QHYNNWPYT

SEQ ID NO: 5834 - protein, 9 aa, Artificial Sequence
  anti-HIV_CDR
QQYDRLPIT

SEQ ID NO: 5835 - protein, 9 aa, Artificial Sequence
  anti-HIV_CDR
QQYGSSPIT

SEQ ID NO: 5836 - protein, 9 aa, Artificial Sequence
  anti-HIV_CDR
QQYDVWPLT

SEQ ID NO: 5837 - protein, 9 aa, Artificial Sequence
  anti-HIV_CDR
HQYASSPRT

SEQ ID NO: 5838 - protein, 9 aa, Artificial Sequence
  anti-HIV_CDR
MQSLHLPYT

SEQ ID NO: 5839 - protein, 9 aa, Artificial Sequence
  anti-HIV_CDR
QQYYSSPLT

SEQ ID NO: 5840 - protein, 9 aa, Artificial Sequence
  anti-HIV_CDR
QQHDTFPFT

SEQ ID NO: 5841 - protein, 9 aa, Artificial Sequence
  anti-HIV_CDR
QQSYSTPYT

SEQ ID NO: 5842 - protein, 9 aa, Artificial Sequence
  anti-HIV_CDR
QQYKTYPVT

SEQ ID NO: 5843 - protein, 9 aa, Artificial Sequence
  anti-HIV_CDR
QQYYSTPVT

SEQ ID NO: 5844 - protein, 9 aa, Artificial Sequence
  anti-HIV_CDR
QQYNWPPFT

SEQ ID NO: 5845 - protein, 9 aa, Artificial Sequence
  anti-HIV_CDR
MQGTHWPWT

SEQ ID NO: 5846 - protein, 9 aa, Artificial Sequence
  anti-HIV_CDR
HQCGSSPRT

SEQ ID NO: 5847 - protein, 9 aa, Artificial Sequence
  anti-HIV_CDR
QQYNSYFRT

SEQ ID NO: 5848 - protein, 9 aa, Artificial Sequence
  anti-HIV_CDR
QQYHNWPPS

SEQ ID NO: 5849 - protein, 9 aa, Artificial Sequence
  anti-HIV_CDR
MQGTYWLWT

SEQ ID NO: 5850 - protein, 9 aa, Artificial Sequence
  anti-HIV_CDR
QQGFSAPFT

SEQ ID NO: 5851 - protein, 9 aa, Artificial Sequence
  anti-HIV_CDR
QQYNTYPLT

SEQ ID NO: 5852 - protein, 9 aa, Artificial Sequence
  anti-HIV_CDR
MQGTHWPRT

SEQ ID NO: 5853 - protein, 9 aa, Artificial Sequence
  anti-HIV_CDR
FGRTPWFDP

SEQ ID NO: 5854 - protein, 9 aa, Artificial Sequence
  anti-HIV_CDR
QQYFTSVIT

SEQ ID NO: 5855 - protein, 9 aa, Artificial Sequence
  anti-HIV_CDR
HHYMSDLQT

SEQ ID NO: 5856 - protein, 9 aa, Artificial Sequence
  anti-HIV_CDR
HHYSSSSHT

SEQ ID NO: 5857 - protein, 9 aa, Artificial Sequence
  anti-HIV_CDR
HHYKSDCQT

SEQ ID NO: 5858 - protein, 9 aa, Artificial Sequence
  anti-HIV_CDR
QHRSSWPLT

SEQ ID NO: 5859 - protein, 9 aa, Artificial Sequence
  anti-HIV_CDR
LQHHSYPWT

SEQ ID NO: 5860 - protein, 9 aa, Artificial Sequence
  anti-HIV_CDR
QQYGTSPGT

SEQ ID NO: 5861 - protein, 9 aa, Artificial Sequence
  anti-HIV_CDR
QQYGSSPTT

SEQ ID NO: 5862 - protein, 9 aa, Artificial Sequence
  anti-HIV_CDR
QQYGTSPTT

SEQ ID NO: 5863 - protein, 9 aa, Artificial Sequence
  anti-HIV_CDR
MQATHWPPG

SEQ ID NO: 5864 - protein, 9 aa, Artificial Sequence
  anti-HIV_CDR
QRYNRDPYI

SEQ ID NO: 5865 - protein, 9 aa, Artificial Sequence
  anti-HIV_CDR
QQYDNLPLA

SEQ ID NO: 5866 - protein, 9 aa, Artificial Sequence
  anti-HIV_CDR
SSYSATGVA

SEQ ID NO: 5867 - protein, 9 aa, Artificial Sequence
  anti-HIV_CDR
QHYGNSRWT

SEQ ID NO: 5868 - protein, 9 aa, Artificial Sequence
  anti-HIV_CDR
QQYETYPWT

SEQ ID NO: 5869 - protein, 9 aa, Artificial Sequence
  anti-HIV_CDR
QQYGSSPST

SEQ ID NO: 5870 - protein, 9 aa, Artificial Sequence
  anti-HIV_CDR
QQSQRTPHT

SEQ ID NO: 5871 - protein, 9 aa, Artificial Sequence
  anti-HIV_CDR
QQYDILPLT

SEQ ID NO: 5872 - protein, 9 aa, Artificial Sequence
  anti-HIV_CDR
QQSNSSPWT

SEQ ID NO: 5873 - protein, 9 aa, Artificial Sequence
  anti-HIV_CDR
QQSYDTPRT

SEQ ID NO: 5874 - protein, 9 aa, Artificial Sequence
  anti-HIV_CDR
QQFGSSPGT

SEQ ID NO: 5875 - protein, 9 aa, Artificial Sequence
  anti-HIV_CDR
HQYGSSPQT

SEQ ID NO: 5876 - protein, 9 aa, Artificial Sequence
  anti-HIV_CDR
HQYGSSPQS

SEQ ID NO: 5877 - protein, 9 aa, Artificial Sequence
  anti-HIV_CDR
LQHNSYPLT

SEQ ID NO: 5878 - protein, 9 aa, Artificial Sequence
  anti-HIV_CDR
QQYNDWPIT

SEQ ID NO: 5879 - protein, 9 aa, Artificial Sequence
  anti-HIV_CDR
QQTFTFPYT

SEQ ID NO: 5880 - protein, 9 aa, Artificial Sequence
  anti-HIV_CDR
QQSYTFPYI

SEQ ID NO: 5881 - protein, 9 aa, Artificial Sequence
  anti-HIV_CDR
QYYGSSPYT

SEQ ID NO: 5882 - protein, 9 aa, Artificial Sequence
  anti-HIV_CDR
QQSFGTPRT

SEQ ID NO: 5883 - protein, 9 aa, Artificial Sequence
  anti-HIV_CDR
QQYNDWPRT

SEQ ID NO: 5884 - protein, 9 aa, Artificial Sequence
  anti-HIV_CDR
QQYGSSPRT

SEQ ID NO: 5885 - protein, 9 aa, Artificial Sequence
  anti-HIV_CDR
LQHNRYPWT

SEQ ID NO: 5886 - protein, 9 aa, Artificial Sequence
  anti-HIV_CDR
LQHNNYPWT

SEQ ID NO: 5887 - protein, 9 aa, Artificial Sequence
  anti-HIV_CDR
LQYSTYPLT

SEQ ID NO: 5888 - protein, 9 aa, Artificial Sequence
  anti-HIV_CDR
LQYNAYPLT

SEQ ID NO: 5889 - protein, 9 aa, Artificial Sequence
  anti-HIV_CDR
QQYDSAPVT

SEQ ID NO: 5890 - protein, 9 aa, Artificial Sequence
  anti-HIV_CDR
QQTYTFPYS

SEQ ID NO: 5891 - protein, 9 aa, Artificial Sequence
  anti-HIV_CDR
GYDNSGPDY

SEQ ID NO: 5892 - protein, 9 aa, Artificial Sequence
  anti-HIV_CDR
QQYNNWPPA

SEQ ID NO: 5893 - protein, 9 aa, Artificial Sequence
  anti-HIV_CDR
HQYALSPWT

SEQ ID NO: 5894 - protein, 9 aa, Artificial Sequence
  anti-HIV_CDR
QKYDTDPMT

SEQ ID NO: 5895 - protein, 9 aa, Artificial Sequence
  anti-HIV_CDR
QQYNYYPIT

SEQ ID NO: 5896 - protein, 9 aa, Artificial Sequence
  anti-HIV_CDR
QQTFTDPVT

SEQ ID NO: 5897 - protein, 9 aa, Artificial Sequence
  anti-HIV_CDR
AAWDDSLHV

SEQ ID NO: 5898 - protein, 9 aa, Artificial Sequence
  anti-HIV_CDR
QQYASSPFT

SEQ ID NO: 5899 - protein, 9 aa, Artificial Sequence
  anti-HIV_CDR
QQSSSTPFT

SEQ ID NO: 5900 - protein, 9 aa, Artificial Sequence
  anti-HIV_CDR
QQRSNWAIT

SEQ ID NO: 5901 - protein, 9 aa, Artificial Sequence
  anti-HIV_CDR
QQYGSSPFT

SEQ ID NO: 5902 - protein, 9 aa, Artificial Sequence
  anti-HIV_CDR
QKYNGAPWT

SEQ ID NO: 5903 - protein, 9 aa, Artificial Sequence
  anti-HIV_CDR
QKYNNAPWT

SEQ ID NO: 5904 - protein, 9 aa, Artificial Sequence
  anti-HIV_CDR
QQRVNWPPN

SEQ ID NO: 5905 - protein, 9 aa, Artificial Sequence
  anti-HIV_CDR
QQRGHWPLT

SEQ ID NO: 5906 - protein, 9 aa, Artificial Sequence
  anti-HIV_CDR
QQYRYSVII

SEQ ID NO: 5907 - protein, 9 aa, Artificial Sequence
  anti-HIV_CDR
QQSGTSLLT

SEQ ID NO: 5908 - protein, 9 aa, Artificial Sequence
  anti-HIV_CDR
MKSQHSPRT

SEQ ID NO: 5909 - protein, 9 aa, Artificial Sequence
  anti-HIV_CDR
MQPLQTPYT

SEQ ID NO: 5910 - protein, 9 aa, Artificial Sequence
  anti-HIV_CDR
QQYTAYPWT

SEQ ID NO: 5911 - protein, 9 aa, Artificial Sequence
  anti-HIV_CDR
LQNHNYPRT

SEQ ID NO: 5912 - protein, 9 aa, Artificial Sequence
  anti-HIV_CDR
LQTHSYPRT

SEQ ID NO: 5913 - protein, 10 aa, Artificial Sequence
  anti-HIV_CDR
AAWDDSFDYV

SEQ ID NO: 5914 - protein, 10 aa, Artificial Sequence
  anti-HIV_CDR
QHSFGSPPWT

SEQ ID NO: 5915 - protein, 10 aa, Artificial Sequence
  anti-HIV_CDR
SSFTPTNTLV

SEQ ID NO: 5916 - protein, 10 aa, Artificial Sequence
  anti-HIV_CDR
QQYGTLHPRT

SEQ ID NO: 5917 - protein, 10 aa, Artificial Sequence
  anti-HIV_CDR
QQYNNWPPIT

SEQ ID NO: 5918 - protein, 10 aa, Artificial Sequence
  anti-HIV_CDR
QQYYQWLSYT

SEQ ID NO: 5919 - protein, 10 aa, Artificial Sequence
  anti-HIV_CDR
QQRANWRLLT

SEQ ID NO: 5920 - protein, 10 aa, Artificial Sequence
  anti-HIV_CDR
RHSDYCDLDV

SEQ ID NO: 5921 - protein, 10 aa, Artificial Sequence
  anti-HIV_CDR
RRSDYCDFDV

SEQ ID NO: 5922 - protein, 10 aa, Artificial Sequence
  anti-HIV_CDR
RHTDYCDFDV

SEQ ID NO: 5923 - protein, 10 aa, Artificial Sequence
  anti-HIV_CDR
QRSDYWDFDV

SEQ ID NO: 5924 - protein, 10 aa, Artificial Sequence
  anti-HIV_CDR
RHSDYCDFDI

SEQ ID NO: 5925 - protein, 10 aa, Artificial Sequence
  anti-HIV_CDR
CEVDADETIT

SEQ ID NO: 5926 - protein, 10 aa, Artificial Sequence
  anti-HIV_CDR
CEVDAEETII

SEQ ID NO: 5927 - protein, 10 aa, Artificial Sequence
  anti-HIV_CDR
QRSDFWDFDV

SEQ ID NO: 5928 - protein, 10 aa, Artificial Sequence
  anti-HIV_CDR
RHSDYCDFDV

SEQ ID NO: 5929 - protein, 10 aa, Artificial Sequence
  anti-HIV_CDR
CSYAGGRTVV

SEQ ID NO: 5930 - protein, 10 aa, Artificial Sequence
  anti-HIV_CDR
AAWDDSLDYV

SEQ ID NO: 5931 - protein, 10 aa, Artificial Sequence
  anti-HIV_CDR
QQRSNWPRLT

SEQ ID NO: 5932 - protein, 10 aa, Artificial Sequence
  anti-HIV_CDR
QQYNNWPPFT

SEQ ID NO: 5933 - protein, 10 aa, Artificial Sequence
  anti-HIV_CDR
MQGTYWPPLT

SEQ ID NO: 5934 - protein, 10 aa, Artificial Sequence
  anti-HIV_CDR
QQYGSSLLYT

SEQ ID NO: 5935 - protein, 10 aa, Artificial Sequence
  anti-HIV_CDR
QQSFGIPPWT

SEQ ID NO: 5936 - protein, 10 aa, Artificial Sequence
  anti-HIV_CDR
CSYAGSYSYV

SEQ ID NO: 5937 - protein, 10 aa, Artificial Sequence
  anti-HIV_CDR
YSYAGNSLGV

SEQ ID NO: 5938 - protein, 10 aa, Artificial Sequence
  anti-HIV_CDR
SSYTISSPRV

SEQ ID NO: 5939 - protein, 10 aa, Artificial Sequence
  anti-HIV_CDR
QEWELQPFDY

SEQ ID NO: 5940 - protein, 10 aa, Artificial Sequence
  anti-HIV_CDR
LIPVSGAFDV

SEQ ID NO: 5941 - protein, 10 aa, Artificial Sequence
  anti-HIV_CDR
DRDYDEDFDF

SEQ ID NO: 5942 - protein, 10 aa, Artificial Sequence
  anti-HIV_CDR
QEYGRSPPFP

SEQ ID NO: 5943 - protein, 10 aa, Artificial Sequence
  anti-HIV_CDR
TLDGNFHWDF

SEQ ID NO: 5944 - protein, 10 aa, Artificial Sequence
  anti-HIV_CDR
FTQRQGGFDY

SEQ ID NO: 5945 - protein, 10 aa, Artificial Sequence
  anti-HIV_CDR
QQYYKWPPIT

SEQ ID NO: 5946 - protein, 10 aa, Artificial Sequence
  anti-HIV_CDR
QQYGSSAPYT

SEQ ID NO: 5947 - protein, 10 aa, Artificial Sequence
  anti-HIV_CDR
QQLNSDPPWT

SEQ ID NO: 5948 - protein, 10 aa, Artificial Sequence
  anti-HIV_CDR
QHHGSSPTWT

SEQ ID NO: 5949 - protein, 10 aa, Artificial Sequence
  anti-HIV_CDR
QQYKKWPPWT

SEQ ID NO: 5950 - protein, 10 aa, Artificial Sequence
  anti-HIV_CDR
QQYGFSLPVT

SEQ ID NO: 5951 - protein, 10 aa, Artificial Sequence
  anti-HIV_CDR
QSYNGDPPVT

SEQ ID NO: 5952 - protein, 10 aa, Artificial Sequence
  anti-HIV_CDR
QQYGSSRRWT

SEQ ID NO: 5953 - protein, 10 aa, Artificial Sequence
  anti-HIV_CDR
QQFNSYPPLT

SEQ ID NO: 5954 - protein, 10 aa, Artificial Sequence
  anti-HIV_CDR
REGSQGAFDI

SEQ ID NO: 5955 - protein, 10 aa, Artificial Sequence
  anti-HIV_CDR
GDSGPTGFDY

SEQ ID NO: 5956 - protein, 10 aa, Artificial Sequence
  anti-HIV_CDR
VRRGSSYPDY

SEQ ID NO: 5957 - protein, 10 aa, Artificial Sequence
  anti-HIV_CDR
SAYYRNWFDS

SEQ ID NO: 5958 - protein, 10 aa, Artificial Sequence
  anti-HIV_CDR
QSYDSSVSVV

SEQ ID NO: 5959 - protein, 10 aa, Artificial Sequence
  anti-HIV_CDR
SSYTSSLTLV

SEQ ID NO: 5960 - protein, 10 aa, Artificial Sequence
  anti-HIV_CDR
YEGKRSGMDV

SEQ ID NO: 5961 - protein, 10 aa, Artificial Sequence
  anti-HIV_CDR
QQYGSSPEYT

SEQ ID NO: 5962 - protein, 10 aa, Artificial Sequence
  anti-HIV_CDR
QYYDHRPAIA

SEQ ID NO: 5963 - protein, 10 aa, Artificial Sequence
  anti-HIV_CDR
QQYDNLPRVT

SEQ ID NO: 5964 - protein, 10 aa, Artificial Sequence
  anti-HIV_CDR
GAYTTTSTLV

SEQ ID NO: 5965 - protein, 10 aa, Artificial Sequence
  anti-HIV_CDR
QQYKSYSPLT

SEQ ID NO: 5966 - protein, 10 aa, Artificial Sequence
  anti-HIV_CDR
QQSYNTRPLT

SEQ ID NO: 5967 - protein, 10 aa, Artificial Sequence
  anti-HIV_CDR
QQYGGSPPDT

SEQ ID NO: 5968 - protein, 10 aa, Artificial Sequence
  anti-HIV_CDR
CSYTSSATVV

SEQ ID NO: 5969 - protein, 10 aa, Artificial Sequence
  anti-HIV_CDR
CSHTSSDTLV

SEQ ID NO: 5970 - protein, 10 aa, Artificial Sequence
  anti-HIV_CDR
QHYGNSPRVT

SEQ ID NO: 5971 - protein, 10 aa, Artificial Sequence
  anti-HIV_CDR
DAFVSSAMDV

SEQ ID NO: 5972 - protein, 10 aa, Artificial Sequence
  anti-HIV_CDR
LRATTPGFDY

SEQ ID NO: 5973 - protein, 10 aa, Artificial Sequence
  anti-HIV_CDR
LRATIPGFDY

SEQ ID NO: 5974 - protein, 10 aa, Artificial Sequence
  anti-HIV_CDR
LRATIAGFDY

SEQ ID NO: 5975 - protein, 10 aa, Artificial Sequence
  anti-HIV_CDR
CSYAGSYIWV

SEQ ID NO: 5976 - protein, 10 aa, Artificial Sequence
  anti-HIV_CDR
CSYAGTYSYV

SEQ ID NO: 5977 - protein, 10 aa, Artificial Sequence
  anti-HIV_CDR
SSYAGSNNFV

SEQ ID NO: 5978 - protein, 10 aa, Artificial Sequence
  anti-HIV_CDR
GSFTTSLTLV

SEQ ID NO: 5979 - protein, 10 aa, Artificial Sequence
  anti-HIV_CDR
QQYATSSLYT

SEQ ID NO: 5980 - protein, 10 aa, Artificial Sequence
  anti-HIV_CDR
QWYGTLHPRT

SEQ ID NO: 5981 - protein, 10 aa, Artificial Sequence
  anti-HIV_CDR
SSYSSTNTYV

SEQ ID NO: 5982 - protein, 10 aa, Artificial Sequence
  anti-HIV_CDR
TFITASWFDS

SEQ ID NO: 5983 - protein, 10 aa, Artificial Sequence
  anti-HIV_CDR
TGGLLRFPEV

SEQ ID NO: 5984 - protein, 10 aa, Artificial Sequence
  anti-HIV_CDR
CSYAGSYTYV

SEQ ID NO: 5985 - protein, 10 aa, Artificial Sequence
  anti-HIV_CDR
QQRYSWPSLT

SEQ ID NO: 5986 - protein, 10 aa, Artificial Sequence
  anti-HIV_CDR
LQCGSSPPYT

SEQ ID NO: 5987 - protein, 10 aa, Artificial Sequence
  anti-HIV_CDR
SSYAGTNHWV

SEQ ID NO: 5988 - protein, 10 aa, Artificial Sequence
  anti-HIV_CDR
SSYAATNHWV

SEQ ID NO: 5989 - protein, 10 aa, Artificial Sequence
  anti-HIV_CDR
QYYGTSPPST

SEQ ID NO: 5990 - protein, 10 aa, Artificial Sequence
  anti-HIV_CDR
QYYGSSPPST

SEQ ID NO: 5991 - protein, 10 aa, Artificial Sequence
  anti-HIV_CDR
QEFGRAPPYP

SEQ ID NO: 5992 - protein, 10 aa, Artificial Sequence
  anti-HIV_CDR
QEYGRSPPYP

SEQ ID NO: 5993 - protein, 10 aa, Artificial Sequence
  anti-HIV_CDR
QEYGRAPPYP

SEQ ID NO: 5994 - protein, 10 aa, Artificial Sequence
  anti-HIV_CDR
HIAVGGSEEH

SEQ ID NO: 5995 - protein, 10 aa, Artificial Sequence
  anti-HIV_CDR
HIAVGGSEDH

SEQ ID NO: 5996 - protein, 10 aa, Artificial Sequence
  anti-HIV_CDR
HIAVGGREEE

SEQ ID NO: 5997 - protein, 11 aa, Artificial Sequence
  anti-HIV_CDR
GEKSRGSRAVQ

SEQ ID NO: 5998 - protein, 11 aa, Artificial Sequence
  anti-HIV_CDR
GEKSFASRAVQ

SEQ ID NO: 5999 - protein, 11 aa, Artificial Sequence
  anti-HIV_CDR
GRQALGSRAVQ

SEQ ID NO: 6000 - protein, 11 aa, Artificial Sequence
  anti-HIV_CDR
GEESLGSRSVI

SEQ ID NO: 6001 - protein, 11 aa, Artificial Sequence
  anti-HIV_CDR
GEKSLGSRAVQ

SEQ ID NO: 6002 - protein, 11 aa, Artificial Sequence
  anti-HIV_CDR
GKESIGSRAVQ

SEQ ID NO: 6003 - protein, 11 aa, Artificial Sequence
  anti-HIV_CDR
GGNNIGSKSVH

SEQ ID NO: 6004 - protein, 11 aa, Artificial Sequence
  anti-HIV_CDR
GEKSIGSRAVQ

SEQ ID NO: 6005 - protein, 11 aa, Artificial Sequence
  anti-HIV_CDR
KASQDVSTAVA

SEQ ID NO: 6006 - protein, 11 aa, Artificial Sequence
  anti-HIV_CDR
GSRNLSHRLLS

SEQ ID NO: 6007 - protein, 11 aa, Artificial Sequence
  anti-HIV_CDR
GTYDSQGSTRL

SEQ ID NO: 6008 - protein, 11 aa, Artificial Sequence
  anti-HIV_CDR
QQRTIWPPGCS

SEQ ID NO: 6009 - protein, 11 aa, Artificial Sequence
  anti-HIV_CDR
GTWDSSLSAVL

SEQ ID NO: 6010 - protein, 11 aa, Artificial Sequence
  anti-HIV_CDR
ASWDNSLSGPV

SEQ ID NO: 6011 - protein, 11 aa, Artificial Sequence
  anti-HIV_CDR
ASWDDSLSGWV

SEQ ID NO: 6012 - protein, 11 aa, Artificial Sequence
  anti-HIV_CDR
LLLPYYGGPWI

SEQ ID NO: 6013 - protein, 11 aa, Artificial Sequence
  anti-HIV_CDR
QHRTNWPPSIT

SEQ ID NO: 6014 - protein, 11 aa, Artificial Sequence
  anti-HIV_CDR
QSYDRSLRGSV

SEQ ID NO: 6015 - protein, 11 aa, Artificial Sequence
  anti-HIV_CDR
SSGNYDFAFDI

SEQ ID NO: 6016 - protein, 11 aa, Artificial Sequence
  anti-HIV_CDR
SSGNYDFAYDI

SEQ ID NO: 6017 - protein, 11 aa, Artificial Sequence
  anti-HIV_CDR
SSGNFEFAFEI

SEQ ID NO: 6018 - protein, 11 aa, Artificial Sequence
  anti-HIV_CDR
ATYDSHGSIRL

SEQ ID NO: 6019 - protein, 11 aa, Artificial Sequence
  anti-HIV_CDR
GTYDTSLSLRL

SEQ ID NO: 6020 - protein, 11 aa, Artificial Sequence
  anti-HIV_CDR
AAFDSALSLPL

SEQ ID NO: 6021 - protein, 11 aa, Artificial Sequence
  anti-HIV_CDR
ATYDSDGSIRL

SEQ ID NO: 6022 - protein, 11 aa, Artificial Sequence
  anti-HIV_CDR
ATYDSGWSIRL

SEQ ID NO: 6023 - protein, 11 aa, Artificial Sequence
  anti-HIV_CDR
ATYDTGLSLRL

SEQ ID NO: 6024 - protein, 11 aa, Artificial Sequence
  anti-HIV_CDR
AAYDSTLSLRL

SEQ ID NO: 6025 - protein, 11 aa, Artificial Sequence
  anti-HIV_CDR
AAYDSAVSLPV

SEQ ID NO: 6026 - protein, 11 aa, Artificial Sequence
  anti-HIV_CDR
ATYDTDLSLRL

SEQ ID NO: 6027 - protein, 11 aa, Artificial Sequence
  anti-HIV_CDR
AAYDSSLSLRL

SEQ ID NO: 6028 - protein, 11 aa, Artificial Sequence
  anti-HIV_CDR
AAYDSTFSLPV

SEQ ID NO: 6029 - protein, 11 aa, Artificial Sequence
  anti-HIV_CDR
ATYDSQGSTRL

SEQ ID NO: 6030 - protein, 11 aa, Artificial Sequence
  anti-HIV_CDR
ATYDSQRSIRL

SEQ ID NO: 6031 - protein, 11 aa, Artificial Sequence
  anti-HIV_CDR
AVYDSSLSLGL

SEQ ID NO: 6032 - protein, 11 aa, Artificial Sequence
  anti-HIV_CDR
QHRSIWPLMCT

SEQ ID NO: 6033 - protein, 11 aa, Artificial Sequence
  anti-HIV_CDR
LQPVYIFRGTW

SEQ ID NO: 6034 - protein, 11 aa, Artificial Sequence
  anti-HIV_CDR
CEVDADETVTC

SEQ ID NO: 6035 - protein, 11 aa, Artificial Sequence
  anti-HIV_CDR
CEVDAEVTMTV

SEQ ID NO: 6036 - protein, 11 aa, Artificial Sequence
  anti-HIV_CDR
SSYADTNDFGV

SEQ ID NO: 6037 - protein, 11 aa, Artificial Sequence
  anti-HIV_CDR
CSFTYVNPTYL

SEQ ID NO: 6038 - protein, 11 aa, Artificial Sequence
  anti-HIV_CDR
GTWDGSLTTGV

SEQ ID NO: 6039 - protein, 11 aa, Artificial Sequence
  anti-HIV_CDR
QSYDNSLSGWV

SEQ ID NO: 6040 - protein, 11 aa, Artificial Sequence
  anti-HIV_CDR
QQYYSIPPWTF

SEQ ID NO: 6041 - protein, 11 aa, Artificial Sequence
  anti-HIV_CDR
MQGTYWPPSIT

SEQ ID NO: 6042 - protein, 11 aa, Artificial Sequence
  anti-HIV_CDR
QSYDSSLGVEV

SEQ ID NO: 6043 - protein, 11 aa, Artificial Sequence
  anti-HIV_CDR
QVWDSGRDSWV

SEQ ID NO: 6044 - protein, 11 aa, Artificial Sequence
  anti-HIV_CDR
QSYDSSLSGWV

SEQ ID NO: 6045 - protein, 11 aa, Artificial Sequence
  anti-HIV_CDR
GSWDGSLNAGV

SEQ ID NO: 6046 - protein, 11 aa, Artificial Sequence
  anti-HIV_CDR
LSADSSSTYQV

SEQ ID NO: 6047 - protein, 11 aa, Artificial Sequence
  anti-HIV_CDR
CSYAGRDTSWV

SEQ ID NO: 6048 - protein, 11 aa, Artificial Sequence
  anti-HIV_CDR
QQRSNWPPGLT

SEQ ID NO: 6049 - protein, 11 aa, Artificial Sequence
  anti-HIV_CDR
KGRGYGYWFDS

SEQ ID NO: 6050 - protein, 11 aa, Artificial Sequence
  anti-HIV_CDR
EMAATSDAFDI

SEQ ID NO: 6051 - protein, 11 aa, Artificial Sequence
  anti-HIV_CDR
SIYSTGPAPVY

SEQ ID NO: 6052 - protein, 11 aa, Artificial Sequence
  anti-HIV_CDR
RGSLLIKYFDY

SEQ ID NO: 6053 - protein, 11 aa, Artificial Sequence
  anti-HIV_CDR
QQYDNLPPRVT

SEQ ID NO: 6054 - protein, 11 aa, Artificial Sequence
  anti-HIV_CDR
DVRLVAVPGAD

SEQ ID NO: 6055 - protein, 11 aa, Artificial Sequence
  anti-HIV_CDR
QQRTTWPPEYT

SEQ ID NO: 6056 - protein, 11 aa, Artificial Sequence
  anti-HIV_CDR
AAWDDSLNGWV

SEQ ID NO: 6057 - protein, 11 aa, Artificial Sequence
  anti-HIV_CDR
RRRSAWSPFDS

SEQ ID NO: 6058 - protein, 11 aa, Artificial Sequence
  anti-HIV_CDR
ATWDSSLRTAL

SEQ ID NO: 6059 - protein, 11 aa, Artificial Sequence
  anti-HIV_CDR
GTWDSSLRAAL

SEQ ID NO: 6060 - protein, 11 aa, Artificial Sequence
  anti-HIV_CDR
QQRSIWPPSLT

SEQ ID NO: 6061 - protein, 11 aa, Artificial Sequence
  anti-HIV_CDR
EFQTSGVVREG

SEQ ID NO: 6062 - protein, 11 aa, Artificial Sequence
  anti-HIV_CDR
HIGAGGPYSEY

SEQ ID NO: 6063 - protein, 11 aa, Artificial Sequence
  anti-HIV_CDR
RGHSFTSPFDS

SEQ ID NO: 6064 - protein, 11 aa, Artificial Sequence
  anti-HIV_CDR
QHLNSYPRMYT

SEQ ID NO: 6065 - protein, 11 aa, Artificial Sequence
  anti-HIV_CDR
QQRSNWPPKIT

SEQ ID NO: 6066 - protein, 11 aa, Artificial Sequence
  anti-HIV_CDR
AAWDDSLGGVV

SEQ ID NO: 6067 - protein, 11 aa, Artificial Sequence
  anti-HIV_CDR
GTWDSSLSAVV

SEQ ID NO: 6068 - protein, 11 aa, Artificial Sequence
  anti-HIV_CDR
QQRANWPPGGT

SEQ ID NO: 6069 - protein, 11 aa, Artificial Sequence
  anti-HIV_CDR
GGGYPRGNMDV

SEQ ID NO: 6070 - protein, 11 aa, Artificial Sequence
  anti-HIV_CDR
LLLLYYGGPWI

SEQ ID NO: 6071 - protein, 11 aa, Artificial Sequence
  anti-HIV_CDR
QQRGIWPLQIT

SEQ ID NO: 6072 - protein, 11 aa, Artificial Sequence
  anti-HIV_CDR
RSPGGGYAFDI

SEQ ID NO: 6073 - protein, 11 aa, Artificial Sequence
  anti-HIV_CDR
SGPGLLRGFDY

SEQ ID NO: 6074 - protein, 11 aa, Artificial Sequence
  anti-HIV_CDR
QQRTTRPPEYT

SEQ ID NO: 6075 - protein, 11 aa, Artificial Sequence
  anti-HIV_CDR
QQRTTRPPDYT

SEQ ID NO: 6076 - protein, 11 aa, Artificial Sequence
  anti-HIV_CDR
QGRTTRPPDYT

SEQ ID NO: 6077 - protein, 11 aa, Artificial Sequence
  anti-HIV_CDR
QQRSTTPPEYT

SEQ ID NO: 6078 - protein, 11 aa, Artificial Sequence
  anti-HIV_CDR
QQRTSWPLALS

SEQ ID NO: 6079 - protein, 11 aa, Artificial Sequence
  anti-HIV_CDR
RGHSFSLPFDS

SEQ ID NO: 6080 - protein, 12 aa, Artificial Sequence
  anti-HIV_CDR
HYWDSRSPISWV

SEQ ID NO: 6081 - protein, 12 aa, Artificial Sequence
  anti-HIV_CDR
HKWDSRSPLSWV

SEQ ID NO: 6082 - protein, 12 aa, Artificial Sequence
  anti-HIV_CDR
HMWDSRSGFSWS

SEQ ID NO: 6083 - protein, 12 aa, Artificial Sequence
  anti-HIV_CDR
HIWDSRVPTKWV

SEQ ID NO: 6084 - protein, 12 aa, Artificial Sequence
  anti-HIV_CDR
QVWDSSSDHPWV

SEQ ID NO: 6085 - protein, 12 aa, Artificial Sequence
  anti-HIV_CDR
HIYDARRPTNWV

SEQ ID NO: 6086 - protein, 12 aa, Artificial Sequence
  anti-HIV_CDR
LDGEAFRYYLDL

SEQ ID NO: 6087 - protein, 12 aa, Artificial Sequence
  anti-HIV_CDR
PQYNLGRDPLDV

SEQ ID NO: 6088 - protein, 12 aa, Artificial Sequence
  anti-HIV_CDR
PEPSSIVAPLYY

SEQ ID NO: 6089 - protein, 12 aa, Artificial Sequence
  anti-HIV_CDR
GGGDGRNWHLHP

SEQ ID NO: 6090 - protein, 12 aa, Artificial Sequence
  anti-HIV_CDR
PKSGRDYWSFDL

SEQ ID NO: 6091 - protein, 12 aa, Artificial Sequence
  anti-HIV_CDR
PRGGRDNWSFHV

SEQ ID NO: 6092 - protein, 12 aa, Artificial Sequence
  anti-HIV_CDR
PHSPDDAWSLDV

SEQ ID NO: 6093 - protein, 12 aa, Artificial Sequence
  anti-HIV_CDR
PLRGGDTWHYHS

SEQ ID NO: 6094 - protein, 12 aa, Artificial Sequence
  anti-HIV_CDR
LQPVYILRSICH

SEQ ID NO: 6095 - protein, 12 aa, Artificial Sequence
  anti-HIV_CDR
LQPVYILKCNWC

SEQ ID NO: 6096 - protein, 12 aa, Artificial Sequence
  anti-HIV_CDR
EYRFDDWGPLDH

SEQ ID NO: 6097 - protein, 12 aa, Artificial Sequence
  anti-HIV_CDR
AAWDDSLNGHGV

SEQ ID NO: 6098 - protein, 12 aa, Artificial Sequence
  anti-HIV_CDR
LYFDWAPHAFDI

SEQ ID NO: 6099 - protein, 12 aa, Artificial Sequence
  anti-HIV_CDR
GLYDSSGYYFGY

SEQ ID NO: 6100 - protein, 12 aa, Artificial Sequence
  anti-HIV_CDR
LGCSGGSCYEDS

SEQ ID NO: 6101 - protein, 12 aa, Artificial Sequence
  anti-HIV_CDR
ASGSYILGTMDV

SEQ ID NO: 6102 - protein, 12 aa, Artificial Sequence
  anti-HIV_CDR
YSTDNSGKQHWV

SEQ ID NO: 6103 - protein, 12 aa, Artificial Sequence
  anti-HIV_CDR
VKQFLEWLYLDY

SEQ ID NO: 6104 - protein, 12 aa, Artificial Sequence
  anti-HIV_CDR
GVRSIVGAHFDY

SEQ ID NO: 6105 - protein, 12 aa, Artificial Sequence
  anti-HIV_CDR
GVGTRYYVYFDS

SEQ ID NO: 6106 - protein, 12 aa, Artificial Sequence
  anti-HIV_CDR
APYISSSHLDYW

SEQ ID NO: 6107 - protein, 12 aa, Artificial Sequence
  anti-HIV_CDR
RGIAAAGFYFQH

SEQ ID NO: 6108 - protein, 12 aa, Artificial Sequence
  anti-HIV_CDR
RGIAAAAFYFQT

SEQ ID NO: 6109 - protein, 12 aa, Artificial Sequence
  anti-HIV_CDR
RGIAAAGFYFQN

SEQ ID NO: 6110 - protein, 12 aa, Artificial Sequence
  anti-HIV_CDR
QSYDTSLTDTGV

SEQ ID NO: 6111 - protein, 12 aa, Artificial Sequence
  anti-HIV_CDR
QSYDTSLSDTGV

SEQ ID NO: 6112 - protein, 12 aa, Artificial Sequence
  anti-HIV_CDR
RTTLVNFGVFDL

SEQ ID NO: 6113 - protein, 12 aa, Artificial Sequence
  anti-HIV_CDR
PVVNTILPYCDV

SEQ ID NO: 6114 - protein, 12 aa, Artificial Sequence
  anti-HIV_CDR
CYSGRSRYFFDS

SEQ ID NO: 6115 - protein, 12 aa, Artificial Sequence
  anti-HIV_CDR
AAWDDSLDGFWV

SEQ ID NO: 6116 - protein, 12 aa, Artificial Sequence
  anti-HIV_CDR
LRRGYYDSGEDY

SEQ ID NO: 6117 - protein, 12 aa, Artificial Sequence
  anti-HIV_CDR
LRRGYFDSGGDH

SEQ ID NO: 6118 - protein, 12 aa, Artificial Sequence
  anti-HIV_CDR
SSYTSSSTLGVV

SEQ ID NO: 6119 - protein, 12 aa, Artificial Sequence
  anti-HIV_CDR
LDGEAFRYYFDS

SEQ ID NO: 6120 - protein, 12 aa, Artificial Sequence
  anti-HIV_CDR
RRGQRLLAYFDY

SEQ ID NO: 6121 - protein, 12 aa, Artificial Sequence
  anti-HIV_CDR
PQYNLGREPLNV

SEQ ID NO: 6122 - protein, 12 aa, Artificial Sequence
  anti-HIV_CDR
AHHDFWRAPVDV

SEQ ID NO: 6123 - protein, 12 aa, Artificial Sequence
  anti-HIV_CDR
GRREGLNFLLDY

SEQ ID NO: 6124 - protein, 12 aa, Artificial Sequence
  anti-HIV_CDR
PEPSSIVGALYY

SEQ ID NO: 6125 - protein, 12 aa, Artificial Sequence
  anti-HIV_CDR
GPDDFWSGYPKY

SEQ ID NO: 6126 - protein, 12 aa, Artificial Sequence
  anti-HIV_CDR
DYSAAGRHLFDS

SEQ ID NO: 6127 - protein, 12 aa, Artificial Sequence
  anti-HIV_CDR
DYTARGRHFFDY

SEQ ID NO: 6128 - protein, 12 aa, Artificial Sequence
  anti-HIV_CDR
DYTASGRHFFDY

SEQ ID NO: 6129 - protein, 12 aa, Artificial Sequence
  anti-HIV_CDR
QSYDSSLSGSWV

SEQ ID NO: 6130 - protein, 12 aa, Artificial Sequence
  anti-HIV_CDR
PAQAGVGPRFDY

SEQ ID NO: 6131 - protein, 12 aa, Artificial Sequence
  anti-HIV_CDR
GAINSSPLYFDS

SEQ ID NO: 6132 - protein, 12 aa, Artificial Sequence
  anti-HIV_CDR
GDITSSPLYFDF

SEQ ID NO: 6133 - protein, 12 aa, Artificial Sequence
  anti-HIV_CDR
GAINSSPSYFDS

SEQ ID NO: 6134 - protein, 12 aa, Artificial Sequence
  anti-HIV_CDR
WVVTAAEEYFDY

SEQ ID NO: 6135 - protein, 13 aa, Artificial Sequence
  anti-HIV_CDR
DPQVEVRGNAFDI

SEQ ID NO: 6136 - protein, 13 aa, Artificial Sequence
  anti-HIV_CDR
DHGDPRTGYYFDY

SEQ ID NO: 6137 - protein, 13 aa, Artificial Sequence
  anti-HIV_CDR
DESGYDLNWHLDS

SEQ ID NO: 6138 - protein, 13 aa, Artificial Sequence
  anti-HIV_CDR
DGSGDDRNWHLDP

SEQ ID NO: 6139 - protein, 13 aa, Artificial Sequence
  anti-HIV_CDR
DRRDDGLDWLLDP

SEQ ID NO: 6140 - protein, 13 aa, Artificial Sequence
  anti-HIV_CDR
DGGGDDRTWLLDA

SEQ ID NO: 6141 - protein, 13 aa, Artificial Sequence
  anti-HIV_CDR
DGSGDARDWHLHP

SEQ ID NO: 6142 - protein, 13 aa, Artificial Sequence
  anti-HIV_CDR
DGSGDDTSWYLDP

SEQ ID NO: 6143 - protein, 13 aa, Artificial Sequence
  anti-HIV_CDR
DGSGDDTSWHLDP

SEQ ID NO: 6144 - protein, 13 aa, Artificial Sequence
  anti-HIV_CDR
DRRDDDRAWLLDP

SEQ ID NO: 6145 - protein, 13 aa, Artificial Sequence
  anti-HIV_CDR
DGSGDARDWHLDP

SEQ ID NO: 6146 - protein, 13 aa, Artificial Sequence
  anti-HIV_CDR
DGSGDATSWHLHP

SEQ ID NO: 6147 - protein, 13 aa, Artificial Sequence
  anti-HIV_CDR
DESGDDLKWHLHP

SEQ ID NO: 6148 - protein, 13 aa, Artificial Sequence
  anti-HIV_CDR
DGSGDDTSWHLHP

SEQ ID NO: 6149 - protein, 13 aa, Artificial Sequence
  anti-HIV_CDR
AQGDILTEGYFDY

SEQ ID NO: 6150 - protein, 13 aa, Artificial Sequence
  anti-HIV_CDR
DRMFWQQLAKYDS

SEQ ID NO: 6151 - protein, 13 aa, Artificial Sequence
  anti-HIV_CDR
STWDYSLSAHEDV

SEQ ID NO: 6152 - protein, 13 aa, Artificial Sequence
  anti-HIV_CDR
AAWDDSLSGLNWV

SEQ ID NO: 6153 - protein, 13 aa, Artificial Sequence
  anti-HIV_CDR
LSSDRIVVVGPDY

SEQ ID NO: 6154 - protein, 13 aa, Artificial Sequence
  anti-HIV_CDR
EAGSVTATGPFDS

SEQ ID NO: 6155 - protein, 13 aa, Artificial Sequence
  anti-HIV_CDR
DFGRAYAIGYFEY

SEQ ID NO: 6156 - protein, 13 aa, Artificial Sequence
  anti-HIV_CDR
DRAPYGAFEPFDF

SEQ ID NO: 6157 - protein, 13 aa, Artificial Sequence
  anti-HIV_CDR
NGHSSLGGGYFPH

SEQ ID NO: 6158 - protein, 13 aa, Artificial Sequence
  anti-HIV_CDR
NGHSALGGEYFQH

SEQ ID NO: 6159 - protein, 13 aa, Artificial Sequence
  anti-HIV_CDR
AARRAFYYYYMDV

SEQ ID NO: 6160 - protein, 13 aa, Artificial Sequence
  anti-HIV_CDR
ANYYDSSGYGLDI

SEQ ID NO: 6161 - protein, 13 aa, Artificial Sequence
  anti-HIV_CDR
HSRPGAPPHYFDY

SEQ ID NO: 6162 - protein, 13 aa, Artificial Sequence
  anti-HIV_CDR
GLTVATLYDAFDV

SEQ ID NO: 6163 - protein, 13 aa, Artificial Sequence
  anti-HIV_CDR
RDRYNWKYYYLDV

SEQ ID NO: 6164 - protein, 13 aa, Artificial Sequence
  anti-HIV_CDR
DRGSSGWYGWLDP

SEQ ID NO: 6165 - protein, 13 aa, Artificial Sequence
  anti-HIV_CDR
DRLSSFWSGGIDQ

SEQ ID NO: 6166 - protein, 13 aa, Artificial Sequence
  anti-HIV_CDR
DVIVGALLGAFDI

SEQ ID NO: 6167 - protein, 13 aa, Artificial Sequence
  anti-HIV_CDR
HLIAPTAGNYFYP

SEQ ID NO: 6168 - protein, 13 aa, Artificial Sequence
  anti-HIV_CDR
DSRPQALVAALDV

SEQ ID NO: 6169 - protein, 13 aa, Artificial Sequence
  anti-HIV_CDR
DEIVGALLGAFDI

SEQ ID NO: 6170 - protein, 13 aa, Artificial Sequence
  anti-HIV_CDR
SDPAIAAAGSLDL

SEQ ID NO: 6171 - protein, 13 aa, Artificial Sequence
  anti-HIV_CDR
PYVQTVATTTFDF

SEQ ID NO: 6172 - protein, 13 aa, Artificial Sequence
  anti-HIV_CDR
GPKSVASLSYFDK

SEQ ID NO: 6173 - protein, 13 aa, Artificial Sequence
  anti-HIV_CDR
GALWFGQLRGLDP

SEQ ID NO: 6174 - protein, 13 aa, Artificial Sequence
  anti-HIV_CDR
DLRPMRGNWAMHV

SEQ ID NO: 6175 - protein, 13 aa, Artificial Sequence
  anti-HIV_CDR
DPQVNRRGNCFDH

SEQ ID NO: 6176 - protein, 13 aa, Artificial Sequence
  anti-HIV_CDR
DPQIEIRGNAFDI

SEQ ID NO: 6177 - protein, 13 aa, Artificial Sequence
  anti-HIV_CDR
VPRTTATRNAFDI

SEQ ID NO: 6178 - protein, 13 aa, Artificial Sequence
  anti-HIV_CDR
HKSVLLWFRELDY

SEQ ID NO: 6179 - protein, 13 aa, Artificial Sequence
  anti-HIV_CDR
DSEDYVDYYYMDV

SEQ ID NO: 6180 - protein, 13 aa, Artificial Sequence
  anti-HIV_CDR
LPRTTGIRNAFDI

SEQ ID NO: 6181 - protein, 13 aa, Artificial Sequence
  anti-HIV_CDR
LPRTTGIRNAFDF

SEQ ID NO: 6182 - protein, 14 aa, Artificial Sequence
  anti-HIV_CDR
GTLWFGESGLRLDH

SEQ ID NO: 6183 - protein, 14 aa, Artificial Sequence
  anti-HIV_CDR
VAYVHVVTTRSLDN

SEQ ID NO: 6184 - protein, 14 aa, Artificial Sequence
  anti-HIV_CDR
ADYDLLTSSYHFDS

SEQ ID NO: 6185 - protein, 14 aa, Artificial Sequence
  anti-HIV_CDR
TRCFGANCFNFMDV

SEQ ID NO: 6186 - protein, 14 aa, Artificial Sequence
  anti-HIV_CDR
GGLYCSSISCIMDV

SEQ ID NO: 6187 - protein, 14 aa, Artificial Sequence
  anti-HIV_CDR
NEPQYHSLPGMFDY

SEQ ID NO: 6188 - protein, 14 aa, Artificial Sequence
  anti-HIV_CDR
EPREMGTLTAGFEY

SEQ ID NO: 6189 - protein, 14 aa, Artificial Sequence
  anti-HIV_CDR
ATGYSYGYLDAFDI

SEQ ID NO: 6190 - protein, 14 aa, Artificial Sequence
  anti-HIV_CDR
GSLWFGESGLRLDH

SEQ ID NO: 6191 - protein, 14 aa, Artificial Sequence
  anti-HIV_CDR
DNTISGVVPRWFDY

SEQ ID NO: 6192 - protein, 14 aa, Artificial Sequence
  anti-HIV_CDR
IYDGRGYYSYFFDL

SEQ ID NO: 6193 - protein, 14 aa, Artificial Sequence
  anti-HIV_CDR
DRFNWNDGGYFFDS

SEQ ID NO: 6194 - protein, 14 aa, Artificial Sequence
  anti-HIV_CDR
GHSSSWTKFNWFGP

SEQ ID NO: 6195 - protein, 14 aa, Artificial Sequence
  anti-HIV_CDR
SIAADDYYYYYMDV

SEQ ID NO: 6196 - protein, 14 aa, Artificial Sequence
  anti-HIV_CDR
SFYDNGGYYLGLDY

SEQ ID NO: 6197 - protein, 14 aa, Artificial Sequence
  anti-HIV_CDR
DKDASIYGYRILNH

SEQ ID NO: 6198 - protein, 14 aa, Artificial Sequence
  anti-HIV_CDR
VLTDLDQGNPRMDV

SEQ ID NO: 6199 - protein, 14 aa, Artificial Sequence
  anti-HIV_CDR
REIKFGELSFYFDS

SEQ ID NO: 6200 - protein, 14 aa, Artificial Sequence
  anti-HIV_CDR
REIRFGELSFYFDY

SEQ ID NO: 6201 - protein, 14 aa, Artificial Sequence
  anti-HIV_CDR
PHSPTNIPSRPLDY

SEQ ID NO: 6202 - protein, 14 aa, Artificial Sequence
  anti-HIV_CDR
GDYDILTSSYQFDY

SEQ ID NO: 6203 - protein, 14 aa, Artificial Sequence
  anti-HIV_CDR
STPLVWPPANGLDV

SEQ ID NO: 6204 - protein, 14 aa, Artificial Sequence
  anti-HIV_CDR
TRNTGNSLPYWFDL

SEQ ID NO: 6205 - protein, 15 aa, Artificial Sequence
  anti-HIV_CDR
EKGQWLTVPPYYFDS

SEQ ID NO: 6206 - protein, 15 aa, Artificial Sequence
  anti-HIV_CDR
GSGRWTIGARIYFDN

SEQ ID NO: 6207 - protein, 15 aa, Artificial Sequence
  anti-HIV_CDR
LEADGADYSPKMFDF

SEQ ID NO: 6208 - protein, 15 aa, Artificial Sequence
  anti-HIV_CDR
LEADGGDYSPKMFDY

SEQ ID NO: 6209 - protein, 15 aa, Artificial Sequence
  anti-HIV_CDR
LEADGDNYSPKMVDY

SEQ ID NO: 6210 - protein, 15 aa, Artificial Sequence
  anti-HIV_CDR
LEADGDDYSPKMFDY

SEQ ID NO: 6211 - protein, 15 aa, Artificial Sequence
  anti-HIV_CDR
LEADGSDYSPKMFDF

SEQ ID NO: 6212 - protein, 15 aa, Artificial Sequence
  anti-HIV_CDR
LEADGDDYSPKMFDH

SEQ ID NO: 6213 - protein, 15 aa, Artificial Sequence
  anti-HIV_CDR
LEADGDDYSPKMVDY

SEQ ID NO: 6214 - protein, 15 aa, Artificial Sequence
  anti-HIV_CDR
APRLDLGELSSGFHF

SEQ ID NO: 6215 - protein, 15 aa, Artificial Sequence
  anti-HIV_CDR
APRLELGELSSGFHY

SEQ ID NO: 6216 - protein, 15 aa, Artificial Sequence
  anti-HIV_CDR
GRLLMQWPPRGGFDP

SEQ ID NO: 6217 - protein, 15 aa, Artificial Sequence
  anti-HIV_CDR
GRLFMQWPPRGGFDP

SEQ ID NO: 6218 - protein, 15 aa, Artificial Sequence
  anti-HIV_CDR
GRLFVQWPPQGGFDP

SEQ ID NO: 6219 - protein, 15 aa, Artificial Sequence
  anti-HIV_CDR
GRLFMQWPPQGGFDP

SEQ ID NO: 6220 - protein, 15 aa, Artificial Sequence
  anti-HIV_CDR
GRLFVQWPPQGGFDT

SEQ ID NO: 6221 - protein, 15 aa, Artificial Sequence
  anti-HIV_CDR
NNNTRKSINIGPGRA

SEQ ID NO: 6222 - protein, 15 aa, Artificial Sequence
  anti-HIV_CDR
PGYCNNNICTHWFDT

SEQ ID NO: 6223 - protein, 15 aa, Artificial Sequence
  anti-HIV_CDR
DLLPDYPVSSAPEDF

SEQ ID NO: 6224 - protein, 15 aa, Artificial Sequence
  anti-HIV_CDR
ESWLYSNGDYYYMDV

SEQ ID NO: 6225 - protein, 15 aa, Artificial Sequence
  anti-HIV_CDR
RYCSSTTCYRGHFDY

SEQ ID NO: 6226 - protein, 15 aa, Artificial Sequence
  anti-HIV_CDR
QTTDEGRQWLVGFQH

SEQ ID NO: 6227 - protein, 15 aa, Artificial Sequence
  anti-HIV_CDR
PSYGGYDDQGWYFEY

SEQ ID NO: 6228 - protein, 15 aa, Artificial Sequence
  anti-HIV_CDR
AAIPIGDSKYSYFDS

SEQ ID NO: 6229 - protein, 15 aa, Artificial Sequence
  anti-HIV_CDR
APPPGSTEWAYYFDY

SEQ ID NO: 6230 - protein, 15 aa, Artificial Sequence
  anti-HIV_CDR
AQFHNSGYYYSGLDY

SEQ ID NO: 6231 - protein, 15 aa, Artificial Sequence
  anti-HIV_CDR
GGYDYGDHYYYYMDV

SEQ ID NO: 6232 - protein, 15 aa, Artificial Sequence
  anti-HIV_CDR
GTQSYSAVAPGWFDP

SEQ ID NO: 6233 - protein, 15 aa, Artificial Sequence
  anti-HIV_CDR
IKGPPRGNFGVAFYF

SEQ ID NO: 6234 - protein, 15 aa, Artificial Sequence
  anti-HIV_CDR
KVYSDGWSPPTGFVY

SEQ ID NO: 6235 - protein, 15 aa, Artificial Sequence
  anti-HIV_CDR
RYKYLPGDQHMPWDN

SEQ ID NO: 6236 - protein, 15 aa, Artificial Sequence
  anti-HIV_CDR
RYKYLPGDQHMPWDY

SEQ ID NO: 6237 - protein, 15 aa, Artificial Sequence
  anti-HIV_CDR
GGGYAVVGPKYGLDV

SEQ ID NO: 6238 - protein, 15 aa, Artificial Sequence
  anti-HIV_CDR
LDSSSGWEEVGYFDR

SEQ ID NO: 6239 - protein, 15 aa, Artificial Sequence
  anti-HIV_CDR
ENYSDGWEEVGHFDY

SEQ ID NO: 6240 - protein, 15 aa, Artificial Sequence
  anti-HIV_CDR
ENYSDGWEEVGHFDS

SEQ ID NO: 6241 - protein, 15 aa, Artificial Sequence
  anti-HIV_CDR
ENYSDGWNEVGHFDF

SEQ ID NO: 6242 - protein, 15 aa, Artificial Sequence
  anti-HIV_CDR
ENYSDGWYEVGHFDL

SEQ ID NO: 6243 - protein, 15 aa, Artificial Sequence
  anti-HIV_CDR
DRRRFLEWSLYGMDV

SEQ ID NO: 6244 - protein, 15 aa, Artificial Sequence
  anti-HIV_CDR
GPRVFFESSGYYFRD

SEQ ID NO: 6245 - protein, 15 aa, Artificial Sequence
  anti-HIV_CDR
GPRVLFESSGHYLRD

SEQ ID NO: 6246 - protein, 15 aa, Artificial Sequence
  anti-HIV_CDR
GPRVFFESSGYYFRN

SEQ ID NO: 6247 - protein, 15 aa, Artificial Sequence
  anti-HIV_CDR
EGGSLWFGGANWLDP

SEQ ID NO: 6248 - protein, 15 aa, Artificial Sequence
  anti-HIV_CDR
ADYDNIWDSRGGFDL

SEQ ID NO: 6249 - protein, 15 aa, Artificial Sequence
  anti-HIV_CDR
VGGTVWSGYSNYLDY

SEQ ID NO: 6250 - protein, 15 aa, Artificial Sequence
  anti-HIV_CDR
DNRDQWLVLRSWFDP

SEQ ID NO: 6251 - protein, 15 aa, Artificial Sequence
  anti-HIV_CDR
EKGQWVTLPPYYFDS

SEQ ID NO: 6252 - protein, 16 aa, Artificial Sequence
  anti-HIV_CDR
YFSDTDRSEYSPSLRS

SEQ ID NO: 6253 - protein, 16 aa, Artificial Sequence
  anti-HIV_CDR
YISDRESATYNPSLNS

SEQ ID NO: 6254 - protein, 16 aa, Artificial Sequence
  anti-HIV_CDR
YFSDTEKSNYNPSLRS

SEQ ID NO: 6255 - protein, 16 aa, Artificial Sequence
  anti-HIV_CDR
YISDRASATYNPSLNS

SEQ ID NO: 6256 - protein, 16 aa, Artificial Sequence
  anti-HIV_CDR
YVHHSGDTNYNPSLKR

SEQ ID NO: 6257 - protein, 16 aa, Artificial Sequence
  anti-HIV_CDR
YVHKSGDTNYSPSLKS

SEQ ID NO: 6258 - protein, 16 aa, Artificial Sequence
  anti-HIV_CDR
YVHDSGDTNYNPSLKS

SEQ ID NO: 6259 - protein, 16 aa, Artificial Sequence
  anti-HIV_CDR
YISKSESANYNPSLNS

SEQ ID NO: 6260 - protein, 16 aa, Artificial Sequence
  anti-HIV_CDR
YIYYSGSTNYNPSLKS

SEQ ID NO: 6261 - protein, 16 aa, Artificial Sequence
  anti-HIV_CDR
YVHDSGDINYNPSLKN

SEQ ID NO: 6262 - protein, 16 aa, Artificial Sequence
  anti-HIV_CDR
SYYDFSIGDGNDAFDV

SEQ ID NO: 6263 - protein, 16 aa, Artificial Sequence
  anti-HIV_CDR
GFRGSPFSSGSLYFDS

SEQ ID NO: 6264 - protein, 16 aa, Artificial Sequence
  anti-HIV_CDR
VISGRITIFYYNYIDV

SEQ ID NO: 6265 - protein, 16 aa, Artificial Sequence
  anti-HIV_CDR
DGLGEVAPDYRYGIDV

SEQ ID NO: 6266 - protein, 16 aa, Artificial Sequence
  anti-HIV_CDR
DGLGELAPAYQYGIDV

SEQ ID NO: 6267 - protein, 16 aa, Artificial Sequence
  anti-HIV_CDR
DGLGELAPAYHYGIDV

SEQ ID NO: 6268 - protein, 16 aa, Artificial Sequence
  anti-HIV_CDR
DGLGEVAPAYLYGIDA

SEQ ID NO: 6269 - protein, 16 aa, Artificial Sequence
  anti-HIV_CDR
AVKGFWFDEVYNWFGP

SEQ ID NO: 6270 - protein, 16 aa, Artificial Sequence
  anti-HIV_CDR
AVKGFWFDDPYTWFGP

SEQ ID NO: 6271 - protein, 16 aa, Artificial Sequence
  anti-HIV_CDR
AVKGFWFDEPSTWFGP

SEQ ID NO: 6272 - protein, 16 aa, Artificial Sequence
  anti-HIV_CDR
AVKGLWFDETYTWFGP

SEQ ID NO: 6273 - protein, 16 aa, Artificial Sequence
  anti-HIV_CDR
AVAGLWFEDAYNWFGP

SEQ ID NO: 6274 - protein, 16 aa, Artificial Sequence
  anti-HIV_CDR
AEAESQSHSRPIMFDY

SEQ ID NO: 6275 - protein, 16 aa, Artificial Sequence
  anti-HIV_CDR
AEAASDSHSRPIMFDH

SEQ ID NO: 6276 - protein, 16 aa, Artificial Sequence
  anti-HIV_CDR
LEAESDSHSRPIMFDH

SEQ ID NO: 6277 - protein, 16 aa, Artificial Sequence
  anti-HIV_CDR
AEAESQSHSRPIMFDS

SEQ ID NO: 6278 - protein, 16 aa, Artificial Sequence
  anti-HIV_CDR
AEAESQSHSRPIMFDF

SEQ ID NO: 6279 - protein, 16 aa, Artificial Sequence
  anti-HIV_CDR
DNPLLQSGEFSSSLEN

SEQ ID NO: 6280 - protein, 16 aa, Artificial Sequence
  anti-HIV_CDR
DNPLLQSGEFSSSLDN

SEQ ID NO: 6281 - protein, 16 aa, Artificial Sequence
  anti-HIV_CDR
GRDYNFWGGGGKINFP

SEQ ID NO: 6282 - protein, 16 aa, Artificial Sequence
  anti-HIV_CDR
TNWANDFVTGYYRFDF

SEQ ID NO: 6283 - protein, 16 aa, Artificial Sequence
  anti-HIV_CDR
AGHCSSTSSVYCPFDM

SEQ ID NO: 6284 - protein, 16 aa, Artificial Sequence
  anti-HIV_CDR
QVSSYSSSGYRREFDY

SEQ ID NO: 6285 - protein, 16 aa, Artificial Sequence
  anti-HIV_CDR
RMATLTGGYYYYYMDV

SEQ ID NO: 6286 - protein, 16 aa, Artificial Sequence
  anti-HIV_CDR
EGGYSDFWSGYSGFDY

SEQ ID NO: 6287 - protein, 16 aa, Artificial Sequence
  anti-HIV_CDR
LYYNFGSGYDTGIGDH

SEQ ID NO: 6288 - protein, 16 aa, Artificial Sequence
  anti-HIV_CDR
AREGRWFSDNYYAMDV

SEQ ID NO: 6289 - protein, 16 aa, Artificial Sequence
  anti-HIV_CDR
DRVGRRLGELSAGFDY

SEQ ID NO: 6290 - protein, 16 aa, Artificial Sequence
  anti-HIV_CDR
ARPRSPWDSTGWSVGY

SEQ ID NO: 6291 - protein, 16 aa, Artificial Sequence
  anti-HIV_CDR
SYYDFRSDSGNDAFDI

SEQ ID NO: 6292 - protein, 16 aa, Artificial Sequence
  anti-HIV_CDR
SYYDFQTDSGNDAFDV

SEQ ID NO: 6293 - protein, 16 aa, Artificial Sequence
  anti-HIV_CDR
DNPVLQLGELSSSLDY

SEQ ID NO: 6294 - protein, 16 aa, Artificial Sequence
  anti-HIV_CDR
GFRGSPFSSGSMYFDS

SEQ ID NO: 6295 - protein, 16 aa, Artificial Sequence
  anti-HIV_CDR
GFRGSPLSSGSLYFDS

SEQ ID NO: 6296 - protein, 16 aa, Artificial Sequence
  anti-HIV_CDR
GFRGNVFSTGWFYLDF

SEQ ID NO: 6297 - protein, 16 aa, Artificial Sequence
  anti-HIV_CDR
DRLSFSVQVEQGVLDY

SEQ ID NO: 6298 - protein, 16 aa, Artificial Sequence
  anti-HIV_CDR
DRLSFSVQVEQGVLQF

SEQ ID NO: 6299 - protein, 16 aa, Artificial Sequence
  anti-HIV_CDR
VLSGRITIFYYYYMDV

SEQ ID NO: 6300 - protein, 17 aa, Artificial Sequence
  anti-HIV_CDR
YISSGSSTLHYADTVKG

SEQ ID NO: 6301 - protein, 17 aa, Artificial Sequence
  anti-HIV_CDR
RYLDWSPIGRDTYGTDV

SEQ ID NO: 6302 - protein, 17 aa, Artificial Sequence
  anti-HIV_CDR
RYFDWSPFRRDTYGTDV

SEQ ID NO: 6303 - protein, 17 aa, Artificial Sequence
  anti-HIV_CDR
GRDYNFWSGGGRYYFDF

SEQ ID NO: 6304 - protein, 17 aa, Artificial Sequence
  anti-HIV_CDR
GIQEDYDFWREYRELDY

SEQ ID NO: 6305 - protein, 17 aa, Artificial Sequence
  anti-HIV_CDR
VLNNNTRKSINIGPGRA

SEQ ID NO: 6306 - protein, 17 aa, Artificial Sequence
  anti-HIV_CDR
DLNFGVVTPYYYYYLDV

SEQ ID NO: 6307 - protein, 17 aa, Artificial Sequence
  anti-HIV_CDR
HGRTVFGVVRNYYYMDV

SEQ ID NO: 6308 - protein, 17 aa, Artificial Sequence
  anti-HIV_CDR
HYYGSGLTKDYYEYIDV

SEQ ID NO: 6309 - protein, 17 aa, Artificial Sequence
  anti-HIV_CDR
TYYNFWSDQSQGLDFDY

SEQ ID NO: 6310 - protein, 17 aa, Artificial Sequence
  anti-HIV_CDR
GVWEAPDGSSYYYYMAD

SEQ ID NO: 6311 - protein, 17 aa, Artificial Sequence
  anti-HIV_CDR
DQGGYPVSPVGPKWFDP

SEQ ID NO: 6312 - protein, 17 aa, Artificial Sequence
  anti-HIV_CDR
RDKYQYIDSSGDYPFDR

SEQ ID NO: 6313 - protein, 17 aa, Artificial Sequence
  anti-HIV_CDR
QLRAPTTRFRHGGYFEN

SEQ ID NO: 6314 - protein, 17 aa, Artificial Sequence
  anti-HIV_CDR
QVRAPTLRFRHGGYFET

SEQ ID NO: 6315 - protein, 17 aa, Artificial Sequence
  anti-HIV_CDR
VSITYAGLIVVPGAFDV

SEQ ID NO: 6316 - protein, 17 aa, Artificial Sequence
  anti-HIV_CDR
VAISYAGLIVVPGPFDV

SEQ ID NO: 6317 - protein, 17 aa, Artificial Sequence
  anti-HIV_CDR
SLTGRLHLGELSSGIGP

SEQ ID NO: 6318 - protein, 17 aa, Artificial Sequence
  anti-HIV_CDR
GGSALITIFGVDPKFDP

SEQ ID NO: 6319 - protein, 17 aa, Artificial Sequence
  anti-HIV_CDR
MALTSGPYDVSGYYFDY

SEQ ID NO: 6320 - protein, 17 aa, Artificial Sequence
  anti-HIV_CDR
MALASGPYDVSGYYFDY

SEQ ID NO: 6321 - protein, 17 aa, Artificial Sequence
  anti-HIV_CDR
MALPSGPLDRSGYYFDD

SEQ ID NO: 6322 - protein, 18 aa, Artificial Sequence
  anti-HIV_CDR
VVPMFSIFGVVKANYFDY

SEQ ID NO: 6323 - protein, 18 aa, Artificial Sequence
  anti-HIV_CDR
NRRVAMPEAMILSFYMDV

SEQ ID NO: 6324 - protein, 18 aa, Artificial Sequence
  anti-HIV_CDR
GLCRGGNCRLGPSGWLDP

SEQ ID NO: 6325 - protein, 18 aa, Artificial Sequence
  anti-HIV_CDR
TPPHYDVLTGYPSSVLEF

SEQ ID NO: 6326 - protein, 18 aa, Artificial Sequence
  anti-HIV_CDR
IPYHSESYYKVVIGGFDV

SEQ ID NO: 6327 - protein, 18 aa, Artificial Sequence
  anti-HIV_CDR
ADPFKVAQDEGLFVIFDY

SEQ ID NO: 6328 - protein, 18 aa, Artificial Sequence
  anti-HIV_CDR
ADPFKVAQDEGLYVIFDY

SEQ ID NO: 6329 - protein, 18 aa, Artificial Sequence
  anti-HIV_CDR
ADRFKVAQDEGLFVIFDY

SEQ ID NO: 6330 - protein, 18 aa, Artificial Sequence
  anti-HIV_CDR
GRQTFRAIWSGPPAVFDI

SEQ ID NO: 6331 - protein, 18 aa, Artificial Sequence
  anti-HIV_CDR
GRQTFRAIWSGPPVVFDI

SEQ ID NO: 6332 - protein, 18 aa, Artificial Sequence
  anti-HIV_CDR
SRGDYNFWSGYPEYHFDR

SEQ ID NO: 6333 - protein, 18 aa, Artificial Sequence
  anti-HIV_CDR
LPKSRMVGGDHLPFYPDF

SEQ ID NO: 6334 - protein, 18 aa, Artificial Sequence
  anti-HIV_CDR
LTGPSGYCDSSGCYWFDP

SEQ ID NO: 6335 - protein, 18 aa, Artificial Sequence
  anti-HIV_CDR
GGSMIRGVPSPFYYGMDV

SEQ ID NO: 6336 - protein, 18 aa, Artificial Sequence
  anti-HIV_CDR
LFGAKRLGVAPSGYYMDV

SEQ ID NO: 6337 - protein, 18 aa, Artificial Sequence
  anti-HIV_CDR
DRYEAAWFGADKVYGMDV

SEQ ID NO: 6338 - protein, 18 aa, Artificial Sequence
  anti-HIV_CDR
EHRLPPPTGRRTRNWFDP

SEQ ID NO: 6339 - protein, 18 aa, Artificial Sequence
  anti-HIV_CDR
GRGSFQGFQQYEYYGMDV

SEQ ID NO: 6340 - protein, 18 aa, Artificial Sequence
  anti-HIV_CDR
GRGYSHGFQQYNYYGMDV

SEQ ID NO: 6341 - protein, 18 aa, Artificial Sequence
  anti-HIV_CDR
GRGSFTGFDQYHYYGMDV

SEQ ID NO: 6342 - protein, 18 aa, Artificial Sequence
  anti-HIV_CDR
GRGSTFPSAQFSYFGLDV

SEQ ID NO: 6343 - protein, 18 aa, Artificial Sequence
  anti-HIV_CDR
DLARYGVTSIVPEFGFDF

SEQ ID NO: 6344 - protein, 18 aa, Artificial Sequence
  anti-HIV_CDR
RGRLNIPSPSAILTAFDV

SEQ ID NO: 6345 - protein, 18 aa, Artificial Sequence
  anti-HIV_CDR
GPGSMVRGLIVTSYGMDV

SEQ ID NO: 6346 - protein, 18 aa, Artificial Sequence
  anti-HIV_CDR
KRVTIFGVVDTPRGYFDY

SEQ ID NO: 6347 - protein, 18 aa, Artificial Sequence
  anti-HIV_CDR
GQRNVLHFLERKNDAFDI

SEQ ID NO: 6348 - protein, 18 aa, Artificial Sequence
  anti-HIV_CDR
EQKDYDFWNGLYKYGMDV

SEQ ID NO: 6349 - protein, 19 aa, Artificial Sequence
  anti-HIV_CDR
DTTTFTTFGGGPNMGGFDP

SEQ ID NO: 6350 - protein, 19 aa, Artificial Sequence
  anti-HIV_CDR
AGLDYNFWNGKGRKGAFDV

SEQ ID NO: 6351 - protein, 19 aa, Artificial Sequence
  anti-HIV_CDR
NEADYHDGNGHSLRGMFDY

SEQ ID NO: 6352 - protein, 19 aa, Artificial Sequence
  anti-HIV_CDR
NEPQYHDGNGHSLPGMFDS

SEQ ID NO: 6353 - protein, 19 aa, Artificial Sequence
  anti-HIV_CDR
NEPQYHDDNGHSLPGMIDY

SEQ ID NO: 6354 - protein, 19 aa, Artificial Sequence
  anti-HIV_CDR
NEPQYHDGNGHSLPGMFDF

SEQ ID NO: 6355 - protein, 19 aa, Artificial Sequence
  anti-HIV_CDR
NEPQYFDGSGHSLPGMFDY

SEQ ID NO: 6356 - protein, 19 aa, Artificial Sequence
  anti-HIV_CDR
READYHDGNGHTLPGMFDF

SEQ ID NO: 6357 - protein, 19 aa, Artificial Sequence
  anti-HIV_CDR
NEPQYYDGSGHSLPGMFDY

SEQ ID NO: 6358 - protein, 19 aa, Artificial Sequence
  anti-HIV_CDR
NEPQYHDGNGHSLPGMFDY

SEQ ID NO: 6359 - protein, 19 aa, Artificial Sequence
  anti-HIV_CDR
QDSDFHDGHGHTLRGMFDS

SEQ ID NO: 6360 - protein, 19 aa, Artificial Sequence
  anti-HIV_CDR
LDWVRGVMNLVENHYAMDV

SEQ ID NO: 6361 - protein, 19 aa, Artificial Sequence
  anti-HIV_CDR
TNGTEIFRPGGGDMRDNWR

SEQ ID NO: 6362 - protein, 19 aa, Artificial Sequence
  anti-HIV_CDR
DGRYSGDDQYYYHYYYMDV

SEQ ID NO: 6363 - protein, 19 aa, Artificial Sequence
  anti-HIV_CDR
LTKNPSQDFWGSYLYYFED

SEQ ID NO: 6364 - protein, 19 aa, Artificial Sequence
  anti-HIV_CDR
GATYYYDSSGHQSRRAFDI

SEQ ID NO: 6365 - protein, 19 aa, Artificial Sequence
  anti-HIV_CDR
AFQASMVRGVIVDPYGMDV

SEQ ID NO: 6366 - protein, 19 aa, Artificial Sequence
  anti-HIV_CDR
HRADYDFWNGSNLRGYFDP

SEQ ID NO: 6367 - protein, 19 aa, Artificial Sequence
  anti-HIV_CDR
HRANYDFWGGSNLRGYFDP

SEQ ID NO: 6368 - protein, 19 aa, Artificial Sequence
  anti-HIV_CDR
GFHFWSGTGTRPRNWYFDL

SEQ ID NO: 6369 - protein, 19 aa, Artificial Sequence
  anti-HIV_CDR
NYLIESRYDEKDYYYAMDV

SEQ ID NO: 6370 - protein, 19 aa, Artificial Sequence
  anti-HIV_CDR
SRGYAYDSGGHYFPTWFDP

SEQ ID NO: 6371 - protein, 19 aa, Artificial Sequence
  anti-HIV_CDR
DTTTFGAFGGSPNMGGLDP

SEQ ID NO: 6372 - protein, 19 aa, Artificial Sequence
  anti-HIV_CDR
HLVVAVAAGPDYFSYGMDV

SEQ ID NO: 6373 - protein, 19 aa, Artificial Sequence
  anti-HIV_CDR
DTTTFSSFGSPPNMGGLDP

SEQ ID NO: 6374 - protein, 19 aa, Artificial Sequence
  anti-HIV_CDR
DTTTFGAFGGGANMGGLDP

SEQ ID NO: 6375 - protein, 19 aa, Artificial Sequence
  anti-HIV_CDR
DTTTFTSFGSPPRMGGLDP

SEQ ID NO: 6376 - protein, 19 aa, Artificial Sequence
  anti-HIV_CDR
DTTTFSSFGSPPHMGGLDP

SEQ ID NO: 6377 - protein, 19 aa, Artificial Sequence
  anti-HIV_CDR
DRVSDYDFWSGKRGYGMDV

SEQ ID NO: 6378 - protein, 19 aa, Artificial Sequence
  anti-HIV_CDR
ELSGEYHFWSGTYRYGVDV

SEQ ID NO: 6379 - protein, 19 aa, Artificial Sequence
  anti-HIV_CDR
HGASENYGPGSYSAEHFQH

SEQ ID NO: 6380 - protein, 19 aa, Artificial Sequence
  anti-HIV_CDR
HGASANYGPGSYSAEHFQH

SEQ ID NO: 6381 - protein, 20 aa, Artificial Sequence
  anti-HIV_CDR
HEAPRYSYAFRRYYHYGLDV

SEQ ID NO: 6382 - protein, 20 aa, Artificial Sequence
  anti-HIV_CDR
TSTYDQWSGLHHDGVMAFSS

SEQ ID NO: 6383 - protein, 20 aa, Artificial Sequence
  anti-HIV_CDR
GEFDSSGFDYESWYPYYMDV

SEQ ID NO: 6384 - protein, 20 aa, Artificial Sequence
  anti-HIV_CDR
GQTDLNDDFWSEYSTPGFDY

SEQ ID NO: 6385 - protein, 20 aa, Artificial Sequence
  anti-HIV_CDR
GQTDLNDDLWSDYSTPGFDY

SEQ ID NO: 6386 - protein, 20 aa, Artificial Sequence
  anti-HIV_CDR
NLIEESQTQQEINERDLLAL

SEQ ID NO: 6387 - protein, 20 aa, Artificial Sequence
  anti-HIV_CDR
NLIEESQIQQEKNEKELLEL

SEQ ID NO: 6388 - protein, 20 aa, Artificial Sequence
  anti-HIV_CDR
SLIENSQIQQEKNEQDLLQL

SEQ ID NO: 6389 - protein, 20 aa, Artificial Sequence
  anti-HIV_CDR
SLIEESQIQQEKNEKELLEL

SEQ ID NO: 6390 - protein, 20 aa, Artificial Sequence
  anti-HIV_CDR
RLIEESQTQQEKNEQELLEL

SEQ ID NO: 6391 - protein, 20 aa, Artificial Sequence
  anti-HIV_CDR
SLIEESQTQQEKNEKELLEL

SEQ ID NO: 6392 - protein, 20 aa, Artificial Sequence
  anti-HIV_CDR
NLLEESQNQQEKNEQELLEL

SEQ ID NO: 6393 - protein, 20 aa, Artificial Sequence
  anti-HIV_CDR
TLIEESQNQQEKNELELLEL

SEQ ID NO: 6394 - protein, 20 aa, Artificial Sequence
  anti-HIV_CDR
TLQEESQNQQEKNEQELLEL

SEQ ID NO: 6395 - protein, 20 aa, Artificial Sequence
  anti-HIV_CDR
SLLEESQNQQEKNEQELLEL

SEQ ID NO: 6396 - protein, 20 aa, Artificial Sequence
  anti-HIV_CDR
TLIEESQNQQEKNQQELLQL

SEQ ID NO: 6397 - protein, 20 aa, Artificial Sequence
  anti-HIV_CDR
TLIEESQNQQEKNEQELLGL

SEQ ID NO: 6398 - protein, 20 aa, Artificial Sequence
  anti-HIV_CDR
TLIEESQNQQEKNEQELLEL

SEQ ID NO: 6399 - protein, 20 aa, Artificial Sequence
  anti-HIV_CDR
SLIEDSQIQQEKNEKELLEL

SEQ ID NO: 6400 - protein, 20 aa, Artificial Sequence
  anti-HIV_CDR
SLLEKSQTQQEKNEQELLEL

SEQ ID NO: 6401 - protein, 20 aa, Artificial Sequence
  anti-HIV_CDR
SLIEESQNQQEKNEQELLEL

SEQ ID NO: 6402 - protein, 20 aa, Artificial Sequence
  anti-HIV_CDR
GDLLGYTDSWYEFDYYYMDV

SEQ ID NO: 6403 - protein, 20 aa, Artificial Sequence
  anti-HIV_CDR
DTNGTEIFRPGGGDMRDNWR

SEQ ID NO: 6404 - protein, 20 aa, Artificial Sequence
  anti-HIV_CDR
DVVERPGFGDFRYDYYGMDV

SEQ ID NO: 6405 - protein, 20 aa, Artificial Sequence
  anti-HIV_CDR
DQRDCSTNRCFGVFGYYMDV

SEQ ID NO: 6406 - protein, 20 aa, Artificial Sequence
  anti-HIV_CDR
DRWVRPQFPSMDFQYNGLDV

SEQ ID NO: 6407 - protein, 20 aa, Artificial Sequence
  anti-HIV_CDR
DSGFDLDYYDTNELYFGFDY

SEQ ID NO: 6408 - protein, 20 aa, Artificial Sequence
  anti-HIV_CDR
KYPAYYDILTANYRSYYFDY

SEQ ID NO: 6409 - protein, 20 aa, Artificial Sequence
  anti-HIV_CDR
KYPAYYDILTGYYRNYYFDY

SEQ ID NO: 6410 - protein, 20 aa, Artificial Sequence
  anti-HIV_CDR
RVKFPLWFGETTYYYYGMDV

SEQ ID NO: 6411 - protein, 20 aa, Artificial Sequence
  anti-HIV_CDR
ERSTKYSFWSAVMRPDAFDL

SEQ ID NO: 6412 - protein, 20 aa, Artificial Sequence
  anti-HIV_CDR
HEAPRYSYAFRNYYHYGLDV

SEQ ID NO: 6413 - protein, 20 aa, Artificial Sequence
  anti-HIV_CDR
ENVLMESDDYNDYYYYYMDV

SEQ ID NO: 6414 - protein, 20 aa, Artificial Sequence
  anti-HIV_CDR
ERVLVFPDQDADYYYYFFDV

SEQ ID NO: 6415 - protein, 20 aa, Artificial Sequence
  anti-HIV_CDR
ERVLVVPDQDADYYYYFFDV

SEQ ID NO: 6416 - protein, 21 aa, Artificial Sequence
  anti-HIV_CDR
DRSSAIGYCSSISCYKGSFDI

SEQ ID NO: 6417 - protein, 21 aa, Artificial Sequence
  anti-HIV_CDR
VVKIEPLGVAPTKAKRVAREK

SEQ ID NO: 6418 - protein, 21 aa, Artificial Sequence
  anti-HIV_CDR
VVRIEPLGVAPTKAKRVEREK

SEQ ID NO: 6419 - protein, 21 aa, Artificial Sequence
  anti-HIV_CDR
VVRIEPLGIAPTRAKRVEREK

SEQ ID NO: 6420 - protein, 21 aa, Artificial Sequence
  anti-HIV_CDR
VVKIEPIGVAPTKARRVEREK

SEQ ID NO: 6421 - protein, 21 aa, Artificial Sequence
  anti-HIV_CDR
VVKIEPLGVAPTRAKRVEREK

SEQ ID NO: 6422 - protein, 21 aa, Artificial Sequence
  anti-HIV_CDR
VVQIEPLGVAPTRAKRVEREK

SEQ ID NO: 6423 - protein, 21 aa, Artificial Sequence
  anti-HIV_CDR
VVRIEPLGVAPTKAKRVQREK

SEQ ID NO: 6424 - protein, 21 aa, Artificial Sequence
  anti-HIV_CDR
VVKIEPLGVAPTKAKRVQRKK

SEQ ID NO: 6425 - protein, 21 aa, Artificial Sequence
  anti-HIV_CDR
VIKIEPLIVAPTKAKRVQREK

SEQ ID NO: 6426 - protein, 21 aa, Artificial Sequence
  anti-HIV_CDR
VVKIEPLGVAPTKARRVQREK

SEQ ID NO: 6427 - protein, 21 aa, Artificial Sequence
  anti-HIV_CDR
VVKIELLGVAPTKAKRVQREK

SEQ ID NO: 6428 - protein, 21 aa, Artificial Sequence
  anti-HIV_CDR
VVTIEPLGVAPTKAKRVQREK

SEQ ID NO: 6429 - protein, 21 aa, Artificial Sequence
  anti-HIV_CDR
VVKIEPLGVAPTKAKRVQREK

SEQ ID NO: 6430 - protein, 21 aa, Artificial Sequence
  anti-HIV_CDR
DLVSVSPPYGNYGPDNNWFDF

SEQ ID NO: 6431 - protein, 21 aa, Artificial Sequence
  anti-HIV_CDR
MNPPWFRGGSNNPYSYYYMDV

SEQ ID NO: 6432 - protein, 21 aa, Artificial Sequence
  anti-HIV_CDR
DWIGYDYDGSGSHLRDESFDI

SEQ ID NO: 6433 - protein, 21 aa, Artificial Sequence
  anti-HIV_CDR
CSIVGNGDFLEEDSHYPAMDV

SEQ ID NO: 6434 - protein, 21 aa, Artificial Sequence
  anti-HIV_CDR
DFVSIYGVAYFTGGGPSSPDI

SEQ ID NO: 6435 - protein, 22 aa, Artificial Sequence
  anti-HIV_CDR
KAKDYYYESSDYSPYYYYYMDV

SEQ ID NO: 6436 - protein, 22 aa, Artificial Sequence
  anti-HIV_CDR
DHGIKPDNYYDISGYNLDYFDY

SEQ ID NO: 6437 - protein, 22 aa, Artificial Sequence
  anti-HIV_CDR
GSLYDYRDNADLKPSYYYAMDV

SEQ ID NO: 6438 - protein, 22 aa, Artificial Sequence
  anti-HIV_CDR
DEASWVEAADEWDEHLFREMAV

SEQ ID NO: 6439 - protein, 22 aa, Artificial Sequence
  anti-HIV_CDR
DEVSWVEAADEWDEHLFREMAV

SEQ ID NO: 6440 - protein, 22 aa, Artificial Sequence
  anti-HIV_CDR
DEGSWVEAADEWDEHLFREMAV

SEQ ID NO: 6441 - protein, 22 aa, Artificial Sequence
  anti-HIV_CDR
DQRGRYSFGFVTGQTKVSAISD

SEQ ID NO: 6442 - protein, 22 aa, Artificial Sequence
  anti-HIV_CDR
DQLGRYSFGFVTGQNKVSAISD

SEQ ID NO: 6443 - protein, 22 aa, Artificial Sequence
  anti-HIV_CDR
DQVGRYSFGFATGQQRVSAISD

SEQ ID NO: 6444 - protein, 23 aa, Artificial Sequence
  anti-HIV_CDR
VVKIEPLGVAPTKAKRRVVQREK

SEQ ID NO: 6445 - protein, 23 aa, Artificial Sequence
  anti-HIV_CDR
RISSSSWYMVDNSHTLHFYYMDV

SEQ ID NO: 6446 - protein, 23 aa, Artificial Sequence
  anti-HIV_CDR
DKPAYDEYAEETIAPHNYHAMDL

SEQ ID NO: 6447 - protein, 23 aa, Artificial Sequence
  anti-HIV_CDR
QNIAARAAEKLYENDYYFYGMDV

SEQ ID NO: 6448 - protein, 23 aa, Artificial Sequence
  anti-HIV_CDR
QNIAARTAERLYENDYYFYGMDV

SEQ ID NO: 6449 - protein, 24 aa, Artificial Sequence
  anti-HIV_CDR
AQQGKRIYGIVSFGEFFYYYYMDA

SEQ ID NO: 6450 - protein, 24 aa, Artificial Sequence
  anti-HIV_CDR
TQQGKRIYGVVSFGEFFHYYYMDA

SEQ ID NO: 6451 - protein, 24 aa, Artificial Sequence
  anti-HIV_CDR
ARRGQRIYGVVSFGEFFYYYSMDV

SEQ ID NO: 6452 - protein, 24 aa, Artificial Sequence
  anti-HIV_CDR
TLHGRRIYGIVAFNEWFTYFYMDV

SEQ ID NO: 6453 - protein, 24 aa, Artificial Sequence
  anti-HIV_CDR
TKHGRRIYGIVAFNEWFTYFYMDV

SEQ ID NO: 6454 - protein, 24 aa, Artificial Sequence
  anti-HIV_CDR
ARHGQRIYGVVSFGEFFTYYSMDV

SEQ ID NO: 6455 - protein, 24 aa, Artificial Sequence
  anti-HIV_CDR
TQQGKRIYGVVSFGDYYYYYYMDV

SEQ ID NO: 6456 - protein, 24 aa, Artificial Sequence
  anti-HIV_CDR
TKHGRRIYGVVAFGEWFTYFYMDV

SEQ ID NO: 6457 - protein, 24 aa, Artificial Sequence
  anti-HIV_CDR
AVITDLHTFGDYELEDPSYYYMDV

SEQ ID NO: 6458 - protein, 24 aa, Artificial Sequence
  anti-HIV_CDR
DRGDTRLLDYGDYEDERYYYGMDV

SEQ ID NO: 6459 - protein, 24 aa, Artificial Sequence
  anti-HIV_CDR
GTRYDFWSGFSNRDGRALAGYFDY

SEQ ID NO: 6460 - protein, 24 aa, Artificial Sequence
  anti-HIV_CDR
DGKGKAYYDFWSGYRNQKYYGLDV

SEQ ID NO: 6461 - protein, 24 aa, Artificial Sequence
  anti-HIV_CDR
AVITDLHTFADYELGDPSYFYMDV

SEQ ID NO: 6462 - protein, 24 aa, Artificial Sequence
  anti-HIV_CDR
SVITDLHTFGDYESGDPSYYYMDV

SEQ ID NO: 6463 - protein, 27 aa, Artificial Sequence
  anti-HIV_CDR
DFPRFHRLVGNYDFWRGTLDRFSYMDL

SEQ ID NO: 6464 - protein, 35 aa, Artificial Sequence
  anti-HIV_CDR
RILAVERYLKDQQLLGIWGCSGKIICPTMVPWNSS

SEQ ID NO: 6465 - protein, 35 aa, Artificial Sequence
  anti-HIV_CDR
RVLAVERYLQDQRLLGMWGCSGKHICTTFVPWNSS

SEQ ID NO: 6466 - protein, 35 aa, Artificial Sequence
  anti-HIV_CDR
RVLAVESYLKDQQLLGIWGCSGKHICTTTVPWNSS

SEQ ID NO: 6467 - protein, 35 aa, Artificial Sequence
  anti-HIV_CDR
RVLAVERYLRDQQLLGIWGCSGRHICTTNVPWNSS

SEQ ID NO: 6468 - protein, 35 aa, Artificial Sequence
  anti-HIV_CDR
RILAVERYLKDQQLLGIWGCSGKLICTTTVPWNSS

SEQ ID NO: 6469 - protein, 35 aa, Artificial Sequence
  anti-HIV_CDR
RILAVERYLKDQQLLGIWGCSGKHICTTNVPWNSS

SEQ ID NO: 6470 - protein, 35 aa, Artificial Sequence
  anti-HIV_CDR
RVLAVERYLRDQQLLGIWGCSGKLICTTTVPWNAS

SEQ ID NO: 6471 - protein, 35 aa, Artificial Sequence
  anti-HIV_CDR
RVLAVERYLRDQQLLGIWGCSGKLICTTAVPWNAS

SEQ ID NO: 6472 - protein, 35 aa, Artificial Sequence
  anti-HIV_CDR
RVLAVERYLKDQQLLGIWGCSGKLICTTTVPWNAS

SEQ ID NO: 6473 - protein, 35 aa, Artificial Sequence
  anti-HIV_CDR
RILAVERYLKDQQLLGFWGCSGKLICTTAVPWNAS

SEQ ID NO: 6474 - protein, 35 aa, Artificial Sequence
  anti-HIV_CDR
RVLAVERYLRDQQLLGIWGCSGKLICTTTVPWNTS

SEQ ID NO: 6475 - protein, 35 aa, Artificial Sequence
  anti-HIV_CDR
RVLAVERYLKDQQLLGIWGCSGKLICTTAVPWNAS

SEQ ID NO: 6476 - protein, 35 aa, Artificial Sequence
  anti-HIV_CDR
RVLAVERYLKDQQLLGFWGCSGKLICTTTVPWNAS

SEQ ID NO: 6477 - protein, 35 aa, Artificial Sequence
  anti-HIV_CDR
RILAVERYLKDQQLLGIWGCSGKLICTTAVPWNAS

SEQ ID NO: 6478-6503 - skipped (26 entries)

SEQ ID NO: 6504 - protein, 4 aa, Artificial Sequence
  anti-influenza_CDR
DVPD

SEQ ID NO: 6505 - protein, 4 aa, Artificial Sequence
  anti-influenza_CDR
RLSG

SEQ ID NO: 6506 - protein, 4 aa, Artificial Sequence
  anti-influenza_CDR
FWDL

SEQ ID NO: 6507 - protein, 5 aa, Artificial Sequence
  anti-influenza_CDR
TGLRN

SEQ ID NO: 6508 - protein, 5 aa, Artificial Sequence
  anti-influenza_CDR
QQSRT

SEQ ID NO: 6509 - protein, 5 aa, Artificial Sequence
  anti-influenza_CDR
QLSRT

SEQ ID NO: 6510 - protein, 5 aa, Artificial Sequence
  anti-influenza_CDR
SNYIT

SEQ ID NO: 6511 - protein, 5 aa, Artificial Sequence
  anti-influenza_CDR
DYSWN

SEQ ID NO: 6512 - protein, 5 aa, Artificial Sequence
  anti-influenza_CDR
NYAFS

SEQ ID NO: 6513 - protein, 5 aa, Artificial Sequence
  anti-influenza_CDR
KNAIS

SEQ ID NO: 6514 - protein, 5 aa, Artificial Sequence
  anti-influenza_CDR
SHWMT

SEQ ID NO: 6515 - protein, 5 aa, Artificial Sequence
  anti-influenza_CDR
NYDIN

SEQ ID NO: 6516 - protein, 5 aa, Artificial Sequence
  anti-influenza_CDR
DYGVT

SEQ ID NO: 6517 - protein, 5 aa, Artificial Sequence
  anti-influenza_CDR
NYGIN

SEQ ID NO: 6518 - protein, 5 aa, Artificial Sequence
  anti-influenza_CDR
GYTIT

SEQ ID NO: 6519 - protein, 5 aa, Artificial Sequence
  anti-influenza_CDR
NYGIS

SEQ ID NO: 6520 - protein, 5 aa, Artificial Sequence
  anti-influenza_CDR
DDYWT

SEQ ID NO: 6521 - protein, 5 aa, Artificial Sequence
  anti-influenza_CDR
TYAMH

SEQ ID NO: 6522 - protein, 5 aa, Artificial Sequence
  anti-influenza_CDR
SYAMH

SEQ ID NO: 6523 - protein, 5 aa, Artificial Sequence
  anti-influenza_CDR
SYYWN

SEQ ID NO: 6524 - protein, 5 aa, Artificial Sequence
  anti-influenza_CDR
TYPVA

SEQ ID NO: 6525 - protein, 5 aa, Artificial Sequence
  anti-influenza_CDR
HYFWS

SEQ ID NO: 6526 - protein, 5 aa, Artificial Sequence
  anti-influenza_CDR
DYYWT

SEQ ID NO: 6527 - protein, 5 aa, Artificial Sequence
  anti-influenza_CDR
DYYWS

SEQ ID NO: 6528 - protein, 5 aa, Artificial Sequence
  anti-influenza_CDR
GYYMH

SEQ ID NO: 6529 - protein, 5 aa, Artificial Sequence
  anti-influenza_CDR
SHYWS

SEQ ID NO: 6530 - protein, 5 aa, Artificial Sequence
  anti-influenza_CDR
NYWIG

SEQ ID NO: 6531 - protein, 5 aa, Artificial Sequence
  anti-influenza_CDR
NYAII

SEQ ID NO: 6532 - protein, 5 aa, Artificial Sequence
  anti-influenza_CDR
DYYIH

SEQ ID NO: 6533 - protein, 5 aa, Artificial Sequence
  anti-influenza_CDR
GYDMH

SEQ ID NO: 6534 - protein, 5 aa, Artificial Sequence
  anti-influenza_CDR
GYYIH

SEQ ID NO: 6535 - protein, 5 aa, Artificial Sequence
  anti-influenza_CDR
GYYVH

SEQ ID NO: 6536 - protein, 5 aa, Artificial Sequence
  anti-influenza_CDR
NYWMS

SEQ ID NO: 6537 - protein, 5 aa, Artificial Sequence
  anti-influenza_CDR
GESTL

SEQ ID NO: 6538 - protein, 5 aa, Artificial Sequence
  anti-influenza_CDR
NYYWS

SEQ ID NO: 6539 - protein, 5 aa, Artificial Sequence
  anti-influenza_CDR
SNYMS

SEQ ID NO: 6540 - protein, 5 aa, Artificial Sequence
  anti-influenza_CDR
SDYWS

SEQ ID NO: 6541 - protein, 5 aa, Artificial Sequence
  anti-influenza_CDR
SYNWI

SEQ ID NO: 6542 - protein, 5 aa, Artificial Sequence
  anti-influenza_CDR
STYMN

SEQ ID NO: 6543 - protein, 5 aa, Artificial Sequence
  anti-influenza_CDR
NYAMS

SEQ ID NO: 6544 - protein, 5 aa, Artificial Sequence
  anti-influenza_CDR
SDFWS

SEQ ID NO: 6545 - protein, 5 aa, Artificial Sequence
  anti-influenza_CDR
YYAMS

SEQ ID NO: 6546 - protein, 5 aa, Artificial Sequence
  anti-influenza_CDR
GYYVY

SEQ ID NO: 6547 - protein, 5 aa, Artificial Sequence
  anti-influenza_CDR
SYAIS

SEQ ID NO: 6548 - protein, 5 aa, Artificial Sequence
  anti-influenza_CDR
SYSWS

SEQ ID NO: 6549 - protein, 5 aa, Artificial Sequence
  anti-influenza_CDR
NSFWG

SEQ ID NO: 6550 - protein, 5 aa, Artificial Sequence
  anti-influenza_CDR
AYHWS

SEQ ID NO: 6551 - protein, 5 aa, Artificial Sequence
  anti-influenza_CDR
DNYIN

SEQ ID NO: 6552 - protein, 5 aa, Artificial Sequence
  anti-influenza_CDR
SGFSV

SEQ ID NO: 6553 - protein, 5 aa, Artificial Sequence
  anti-influenza_CDR
AYAFT

SEQ ID NO: 6554 - protein, 5 aa, Artificial Sequence
  anti-influenza_CDR
GSAIS

SEQ ID NO: 6555 - protein, 5 aa, Artificial Sequence
  anti-influenza_CDR
SYAIT

SEQ ID NO: 6556 - protein, 5 aa, Artificial Sequence
  anti-influenza_CDR
SYYMH

SEQ ID NO: 6557 - protein, 5 aa, Artificial Sequence
  anti-influenza_CDR
IYAMS

SEQ ID NO: 6558 - protein, 5 aa, Artificial Sequence
  anti-influenza_CDR
SYSMN

SEQ ID NO: 6559 - protein, 5 aa, Artificial Sequence
  anti-influenza_CDR
SYGIS

SEQ ID NO: 6560 - protein, 5 aa, Artificial Sequence
  anti-influenza_CDR
FYSMS

SEQ ID NO: 6561 - protein, 5 aa, Artificial Sequence
  anti-influenza_CDR
THAIS

SEQ ID NO: 6562 - protein, 5 aa, Artificial Sequence
  anti-influenza_CDR
GYAIS

SEQ ID NO: 6563 - protein, 5 aa, Artificial Sequence
  anti-influenza_CDR
SNSIS

SEQ ID NO: 6564 - protein, 5 aa, Artificial Sequence
  anti-influenza_CDR
NFAIN

SEQ ID NO: 6565 - protein, 5 aa, Artificial Sequence
  anti-influenza_CDR
SNAVS

SEQ ID NO: 6566 - protein, 5 aa, Artificial Sequence
  anti-influenza_CDR
DNAIS

SEQ ID NO: 6567 - protein, 5 aa, Artificial Sequence
  anti-influenza_CDR
FSEVE

SEQ ID NO: 6568 - protein, 5 aa, Artificial Sequence
  anti-influenza_CDR
AHHMH

SEQ ID NO: 6569 - protein, 5 aa, Artificial Sequence
  anti-influenza_CDR
SQWIG

SEQ ID NO: 6570 - protein, 5 aa, Artificial Sequence
  anti-influenza_CDR
DYAMN

SEQ ID NO: 6571 - protein, 5 aa, Artificial Sequence
  anti-influenza_CDR
NAWMS

SEQ ID NO: 6572 - protein, 5 aa, Artificial Sequence
  anti-influenza_CDR
DYAIN

SEQ ID NO: 6573 - protein, 5 aa, Artificial Sequence
  anti-influenza_CDR
RHGIS

SEQ ID NO: 6574 - protein, 5 aa, Artificial Sequence
  anti-influenza_CDR
ELSIH

SEQ ID NO: 6575 - protein, 5 aa, Artificial Sequence
  anti-influenza_CDR
SSNYY

SEQ ID NO: 6576 - protein, 5 aa, Artificial Sequence
  anti-influenza_CDR
TYAMS

SEQ ID NO: 6577 - protein, 5 aa, Artificial Sequence
  anti-influenza_CDR
NYAIS

SEQ ID NO: 6578 - protein, 6 aa, Artificial Sequence
  anti-influenza_CDR
FGAIAG

SEQ ID NO: 6579 - protein, 6 aa, Artificial Sequence
  anti-influenza_CDR
QDISRY

SEQ ID NO: 6580 - protein, 6 aa, Artificial Sequence
  anti-influenza_CDR
QNIGPW

SEQ ID NO: 6581 - protein, 6 aa, Artificial Sequence
  anti-influenza_CDR
QSVNRR

SEQ ID NO: 6582 - protein, 6 aa, Artificial Sequence
  anti-influenza_CDR
QSISTY

SEQ ID NO: 6583 - protein, 6 aa, Artificial Sequence
  anti-influenza_CDR
QGIITY

SEQ ID NO: 6584 - protein, 6 aa, Artificial Sequence
  anti-influenza_CDR
QGISSY

SEQ ID NO: 6585 - protein, 6 aa, Artificial Sequence
  anti-influenza_CDR
QDVSTW

SEQ ID NO: 6586 - protein, 6 aa, Artificial Sequence
  anti-influenza_CDR
QDIYIY

SEQ ID NO: 6587 - protein, 6 aa, Artificial Sequence
  anti-influenza_CDR
ENIWNN

SEQ ID NO: 6588 - protein, 6 aa, Artificial Sequence
  anti-influenza_CDR
GFTVTS

SEQ ID NO: 6589 - protein, 6 aa, Artificial Sequence
  anti-influenza_CDR
QDISGH

SEQ ID NO: 6590 - protein, 6 aa, Artificial Sequence
  anti-influenza_CDR
SLLTEV

SEQ ID NO: 6591 - protein, 6 aa, Artificial Sequence
  anti-influenza_CDR
GSSISN

SEQ ID NO: 6592 - protein, 6 aa, Artificial Sequence
  anti-influenza_CDR
GGSITS

SEQ ID NO: 6593 - protein, 6 aa, Artificial Sequence
  anti-influenza_CDR
GGSISS

SEQ ID NO: 6594 - protein, 6 aa, Artificial Sequence
  anti-influenza_CDR
GLSVSS

SEQ ID NO: 6595 - protein, 6 aa, Artificial Sequence
  anti-influenza_CDR
GASISS

SEQ ID NO: 6596 - protein, 6 aa, Artificial Sequence
  anti-influenza_CDR
GDSISS

SEQ ID NO: 6597 - protein, 6 aa, Artificial Sequence
  anti-influenza_CDR
GGSISN

SEQ ID NO: 6598 - protein, 6 aa, Artificial Sequence
  anti-influenza_CDR
GGSISA

SEQ ID NO: 6599 - protein, 6 aa, Artificial Sequence
  anti-influenza_CDR
GFSVSD

SEQ ID NO: 6600 - protein, 6 aa, Artificial Sequence
  anti-influenza_CDR
SRSLDV

SEQ ID NO: 6601 - protein, 6 aa, Artificial Sequence
  anti-influenza_CDR
RSQQTV

SEQ ID NO: 6602 - protein, 6 aa, Artificial Sequence
  anti-influenza_CDR
QTINNY

SEQ ID NO: 6603 - protein, 6 aa, Artificial Sequence
  anti-influenza_CDR
NMGPTS

SEQ ID NO: 6604 - protein, 6 aa, Artificial Sequence
  anti-influenza_CDR
QVVGTN

SEQ ID NO: 6605 - protein, 6 aa, Artificial Sequence
  anti-influenza_CDR
QGINTH

SEQ ID NO: 6606 - protein, 6 aa, Artificial Sequence
  anti-influenza_CDR
QDIRNR

SEQ ID NO: 6607 - protein, 6 aa, Artificial Sequence
  anti-influenza_CDR
QGIGSN

SEQ ID NO: 6608 - protein, 6 aa, Artificial Sequence
  anti-influenza_CDR
QTIYRW

SEQ ID NO: 6609 - protein, 6 aa, Artificial Sequence
  anti-influenza_CDR
QTITRF

SEQ ID NO: 6610 - protein, 6 aa, Artificial Sequence
  anti-influenza_CDR
RLGEKF

SEQ ID NO: 6611 - protein, 6 aa, Artificial Sequence
  anti-influenza_CDR
KLGDKF

SEQ ID NO: 6612 - protein, 6 aa, Artificial Sequence
  anti-influenza_CDR
QGLGSN

SEQ ID NO: 6613 - protein, 6 aa, Artificial Sequence
  anti-influenza_CDR
YIGSKS

SEQ ID NO: 6614 - protein, 6 aa, Artificial Sequence
  anti-influenza_CDR
QLISSY

SEQ ID NO: 6615 - protein, 6 aa, Artificial Sequence
  anti-influenza_CDR
QSVSSN

SEQ ID NO: 6616 - protein, 6 aa, Artificial Sequence
  anti-influenza_CDR
QVISSY

SEQ ID NO: 6617 - protein, 6 aa, Artificial Sequence
  anti-influenza_CDR
QSVNRN

SEQ ID NO: 6618 - protein, 6 aa, Artificial Sequence
  anti-influenza_CDR
DIGSKS

SEQ ID NO: 6619 - protein, 6 aa, Artificial Sequence
  anti-influenza_CDR
QSVSTN

SEQ ID NO: 6620 - protein, 6 aa, Artificial Sequence
  anti-influenza_CDR
MIAGWH

SEQ ID NO: 6621 - protein, 6 aa, Artificial Sequence
  anti-influenza_CDR
QDISTW

SEQ ID NO: 6622 - protein, 6 aa, Artificial Sequence
  anti-influenza_CDR
EKIYSN

SEQ ID NO: 6623 - protein, 7 aa, Artificial Sequence
  anti-influenza_CDR
IYYNYNI

SEQ ID NO: 6624 - protein, 7 aa, Artificial Sequence
  anti-influenza_CDR
QSISSGY

SEQ ID NO: 6625 - protein, 7 aa, Artificial Sequence
  anti-influenza_CDR
QSVSSSY

SEQ ID NO: 6626 - protein, 7 aa, Artificial Sequence
  anti-influenza_CDR
QTVSSSY

SEQ ID NO: 6627 - protein, 7 aa, Artificial Sequence
  anti-influenza_CDR
SNNAVWN

SEQ ID NO: 6628 - protein, 7 aa, Artificial Sequence
  anti-influenza_CDR
SNSAVWN

SEQ ID NO: 6629 - protein, 7 aa, Artificial Sequence
  anti-influenza_CDR
AATTLQS

SEQ ID NO: 6630 - protein, 7 aa, Artificial Sequence
  anti-influenza_CDR
SNRATWN

SEQ ID NO: 6631 - protein, 7 aa, Artificial Sequence
  anti-influenza_CDR
ATSTLQS

SEQ ID NO: 6632 - protein, 7 aa, Artificial Sequence
  anti-influenza_CDR
SNSATWN

SEQ ID NO: 6633 - protein, 7 aa, Artificial Sequence
  anti-influenza_CDR
ASSTLQS

SEQ ID NO: 6634 - protein, 7 aa, Artificial Sequence
  anti-influenza_CDR
SYNAVWN

SEQ ID NO: 6635 - protein, 7 aa, Artificial Sequence
  anti-influenza_CDR
AASSRLS

SEQ ID NO: 6636 - protein, 7 aa, Artificial Sequence
  anti-influenza_CDR
AASSRGS

SEQ ID NO: 6637 - protein, 7 aa, Artificial Sequence
  anti-influenza_CDR
IYHSGSA

SEQ ID NO: 6638 - protein, 7 aa, Artificial Sequence
  anti-influenza_CDR
IYYSGVT

SEQ ID NO: 6639 - protein, 7 aa, Artificial Sequence
  anti-influenza_CDR
SSYLAWY

SEQ ID NO: 6640 - protein, 7 aa, Artificial Sequence
  anti-influenza_CDR
QSLSSSS

SEQ ID NO: 6641 - protein, 7 aa, Artificial Sequence
  anti-influenza_CDR
QSVSISY

SEQ ID NO: 6642 - protein, 7 aa, Artificial Sequence
  anti-influenza_CDR
DVTERPS

SEQ ID NO: 6643 - protein, 7 aa, Artificial Sequence
  anti-influenza_CDR
AASTLLD

SEQ ID NO: 6644 - protein, 7 aa, Artificial Sequence
  anti-influenza_CDR
AASTLHS

SEQ ID NO: 6645 - protein, 7 aa, Artificial Sequence
  anti-influenza_CDR
GASSLQG

SEQ ID NO: 6646 - protein, 7 aa, Artificial Sequence
  anti-influenza_CDR
TNGVNVG

SEQ ID NO: 6647 - protein, 7 aa, Artificial Sequence
  anti-influenza_CDR
DASTRAT

SEQ ID NO: 6648 - protein, 7 aa, Artificial Sequence
  anti-influenza_CDR
SETYYWS

SEQ ID NO: 6649 - protein, 7 aa, Artificial Sequence
  anti-influenza_CDR
EAVNLES

SEQ ID NO: 6650 - protein, 7 aa, Artificial Sequence
  anti-influenza_CDR
GASTRAT

SEQ ID NO: 6651 - protein, 7 aa, Artificial Sequence
  anti-influenza_CDR
VSGYYWS

SEQ ID NO: 6652 - protein, 7 aa, Artificial Sequence
  anti-influenza_CDR
ITGVRVG

SEQ ID NO: 6653 - protein, 7 aa, Artificial Sequence
  anti-influenza_CDR
DASNRAT

SEQ ID NO: 6654 - protein, 7 aa, Artificial Sequence
  anti-influenza_CDR
EVTNWPS

SEQ ID NO: 6655 - protein, 7 aa, Artificial Sequence
  anti-influenza_CDR
KDSERPS

SEQ ID NO: 6656 - protein, 7 aa, Artificial Sequence
  anti-influenza_CDR
SGNYYWN

SEQ ID NO: 6657 - protein, 7 aa, Artificial Sequence
  anti-influenza_CDR
STTIRHS

SEQ ID NO: 6658 - protein, 7 aa, Artificial Sequence
  anti-influenza_CDR
DDSGRPS

SEQ ID NO: 6659 - protein, 7 aa, Artificial Sequence
  anti-influenza_CDR
RNDLRPS

SEQ ID NO: 6660 - protein, 7 aa, Artificial Sequence
  anti-influenza_CDR
SVDHYWS

SEQ ID NO: 6661 - protein, 7 aa, Artificial Sequence
  anti-influenza_CDR
AVSILQS

SEQ ID NO: 6662 - protein, 7 aa, Artificial Sequence
  anti-influenza_CDR
DDTDRPS

SEQ ID NO: 6663 - protein, 7 aa, Artificial Sequence
  anti-influenza_CDR
ENNKRPS

SEQ ID NO: 6664 - protein, 7 aa, Artificial Sequence
  anti-influenza_CDR
DSSNRAP

SEQ ID NO: 6665 - protein, 7 aa, Artificial Sequence
  anti-influenza_CDR
EVTKRPS

SEQ ID NO: 6666 - protein, 7 aa, Artificial Sequence
  anti-influenza_CDR
ATSNTHS

SEQ ID NO: 6667 - protein, 7 aa, Artificial Sequence
  anti-influenza_CDR
AASNLEN

SEQ ID NO: 6668 - protein, 7 aa, Artificial Sequence
  anti-influenza_CDR
AASGLQS

SEQ ID NO: 6669 - protein, 7 aa, Artificial Sequence
  anti-influenza_CDR
GFTVSSN

SEQ ID NO: 6670 - protein, 7 aa, Artificial Sequence
  anti-influenza_CDR
GGGYSWN

SEQ ID NO: 6671 - protein, 7 aa, Artificial Sequence
  anti-influenza_CDR
GASNLQS

SEQ ID NO: 6672 - protein, 7 aa, Artificial Sequence
  anti-influenza_CDR
GATNLQS

SEQ ID NO: 6673 - protein, 7 aa, Artificial Sequence
  anti-influenza_CDR
GASNLHS

SEQ ID NO: 6674 - protein, 7 aa, Artificial Sequence
  anti-influenza_CDR
GASTLQS

SEQ ID NO: 6675 - protein, 7 aa, Artificial Sequence
  anti-influenza_CDR
DNSDRPS

SEQ ID NO: 6676 - protein, 7 aa, Artificial Sequence
  anti-influenza_CDR
GASSLQS

SEQ ID NO: 6677 - protein, 7 aa, Artificial Sequence
  anti-influenza_CDR
GNSNRPS

SEQ ID NO: 6678 - protein, 7 aa, Artificial Sequence
  anti-influenza_CDR
AASSLQS

SEQ ID NO: 6679 - protein, 7 aa, Artificial Sequence
  anti-influenza_CDR
AASSLHS

SEQ ID NO: 6680 - protein, 7 aa, Artificial Sequence
  anti-influenza_CDR
GASTLQN

SEQ ID NO: 6681 - protein, 7 aa, Artificial Sequence
  anti-influenza_CDR
GATDLQS

SEQ ID NO: 6682 - protein, 7 aa, Artificial Sequence
  anti-influenza_CDR
SGAYYWT

SEQ ID NO: 6683 - protein, 7 aa, Artificial Sequence
  anti-influenza_CDR
VSDNYIN

SEQ ID NO: 6684 - protein, 7 aa, Artificial Sequence
  anti-influenza_CDR
WASTRES

SEQ ID NO: 6685 - protein, 7 aa, Artificial Sequence
  anti-influenza_CDR
SNNQRPS

SEQ ID NO: 6686 - protein, 7 aa, Artificial Sequence
  anti-influenza_CDR
EVSNRPS

SEQ ID NO: 6687 - protein, 7 aa, Artificial Sequence
  anti-influenza_CDR
KNTQRPS

SEQ ID NO: 6688 - protein, 7 aa, Artificial Sequence
  anti-influenza_CDR
DNNKRPS

SEQ ID NO: 6689 - protein, 7 aa, Artificial Sequence
  anti-influenza_CDR
DASTLRS

SEQ ID NO: 6690 - protein, 7 aa, Artificial Sequence
  anti-influenza_CDR
QDNRRPS

SEQ ID NO: 6691 - protein, 7 aa, Artificial Sequence
  anti-influenza_CDR
DVSKRPS

SEQ ID NO: 6692 - protein, 7 aa, Artificial Sequence
  anti-influenza_CDR
DASSRAT

SEQ ID NO: 6693 - protein, 7 aa, Artificial Sequence
  anti-influenza_CDR
LGSNRAS

SEQ ID NO: 6694 - protein, 7 aa, Artificial Sequence
  anti-influenza_CDR
GASTRAA

SEQ ID NO: 6695 - protein, 7 aa, Artificial Sequence
  anti-influenza_CDR
DDSDRPS

SEQ ID NO: 6696 - protein, 7 aa, Artificial Sequence
  anti-influenza_CDR
RDGQRPS

SEQ ID NO: 6697 - protein, 7 aa, Artificial Sequence
  anti-influenza_CDR
GASSRAT

SEQ ID NO: 6698 - protein, 7 aa, Artificial Sequence
  anti-influenza_CDR
GASSRAS

SEQ ID NO: 6699 - protein, 7 aa, Artificial Sequence
  anti-influenza_CDR
AASTLQS

SEQ ID NO: 6700 - protein, 7 aa, Artificial Sequence
  anti-influenza_CDR
LVSKRAS

SEQ ID NO: 6701 - protein, 7 aa, Artificial Sequence
  anti-influenza_CDR
DVTYRPS

SEQ ID NO: 6702 - protein, 7 aa, Artificial Sequence
  anti-influenza_CDR
MQALETP

SEQ ID NO: 6703 - protein, 7 aa, Artificial Sequence
  anti-influenza_CDR
QNYGSPF

SEQ ID NO: 6704 - protein, 7 aa, Artificial Sequence
  anti-influenza_CDR
QQYGSLP

SEQ ID NO: 6705 - protein, 7 aa, Artificial Sequence
  anti-influenza_CDR
WGSYLES

SEQ ID NO: 6706 - protein, 7 aa, Artificial Sequence
  anti-influenza_CDR
SASTRAT

SEQ ID NO: 6707 - protein, 7 aa, Artificial Sequence
  anti-influenza_CDR
GASTRAS

SEQ ID NO: 6708 - protein, 7 aa, Artificial Sequence
  anti-influenza_CDR
GASTRDT

SEQ ID NO: 6709 - protein, 7 aa, Artificial Sequence
  anti-influenza_CDR
KVSTLES

SEQ ID NO: 6710 - protein, 7 aa, Artificial Sequence
  anti-influenza_CDR
SNTERPS

SEQ ID NO: 6711 - protein, 7 aa, Artificial Sequence
  anti-influenza_CDR
KISNRDS

SEQ ID NO: 6712 - protein, 7 aa, Artificial Sequence
  anti-influenza_CDR
SASHRYS

SEQ ID NO: 6713 - protein, 7 aa, Artificial Sequence
  anti-influenza_CDR
QSVRSNN

SEQ ID NO: 6714 - protein, 7 aa, Artificial Sequence
  anti-influenza_CDR
QSVRSGY

SEQ ID NO: 6715 - protein, 7 aa, Artificial Sequence
  anti-influenza_CDR
IYYRGST

SEQ ID NO: 6716 - protein, 7 aa, Artificial Sequence
  anti-influenza_CDR
VYYSGIT

SEQ ID NO: 6717 - protein, 7 aa, Artificial Sequence
  anti-influenza_CDR
SHFANLK

SEQ ID NO: 6718 - protein, 7 aa, Artificial Sequence
  anti-influenza_CDR
LNKSKPY

SEQ ID NO: 6719 - protein, 7 aa, Artificial Sequence
  anti-influenza_CDR
KLANTGT

SEQ ID NO: 6720 - protein, 7 aa, Artificial Sequence
  anti-influenza_CDR
AASTLTS

SEQ ID NO: 6721 - protein, 7 aa, Artificial Sequence
  anti-influenza_CDR
DASKLAS

SEQ ID NO: 6722 - protein, 7 aa, Artificial Sequence
  anti-influenza_CDR
FASRLAS

SEQ ID NO: 6723 - protein, 7 aa, Artificial Sequence
  anti-influenza_CDR
SASTLAS

SEQ ID NO: 6724 - protein, 7 aa, Artificial Sequence
  anti-influenza_CDR
EVSQRPS

SEQ ID NO: 6725 - protein, 7 aa, Artificial Sequence
  anti-influenza_CDR
GGTLNNY

SEQ ID NO: 6726 - protein, 7 aa, Artificial Sequence
  anti-influenza_CDR
DIVMTQS

SEQ ID NO: 6727 - protein, 8 aa, Artificial Sequence
  anti-influenza_CDR
GFTFSNYA

SEQ ID NO: 6728 - protein, 8 aa, Artificial Sequence
  anti-influenza_CDR
GFTFSNYG

SEQ ID NO: 6729 - protein, 8 aa, Artificial Sequence
  anti-influenza_CDR
GFTFSSYA

SEQ ID NO: 6730 - protein, 8 aa, Artificial Sequence
  anti-influenza_CDR
GFTFSTYA

SEQ ID NO: 6731 - protein, 8 aa, Artificial Sequence
  anti-influenza_CDR
GGIFISQA

SEQ ID NO: 6732 - protein, 8 aa, Artificial Sequence
  anti-influenza_CDR
GGIFSPYA

SEQ ID NO: 6733 - protein, 8 aa, Artificial Sequence
  anti-influenza_CDR
GGPFSGFA

SEQ ID NO: 6734 - protein, 8 aa, Artificial Sequence
  anti-influenza_CDR
GGTFNSHA

SEQ ID NO: 6735 - protein, 8 aa, Artificial Sequence
  anti-influenza_CDR
GSNIGSNT

SEQ ID NO: 6736 - protein, 8 aa, Artificial Sequence
  anti-influenza_CDR
GVTFSMYA

SEQ ID NO: 6737 - protein, 8 aa, Artificial Sequence
  anti-influenza_CDR
GVTFSMYT

SEQ ID NO: 6738 - protein, 8 aa, Artificial Sequence
  anti-influenza_CDR
GVTSSNYP

SEQ ID NO: 6739 - protein, 8 aa, Artificial Sequence
  anti-influenza_CDR
IIAIFGTT

SEQ ID NO: 6740 - protein, 8 aa, Artificial Sequence
  anti-influenza_CDR
IIPLFGTA

SEQ ID NO: 6741 - protein, 8 aa, Artificial Sequence
  anti-influenza_CDR
IIPLFGTT

SEQ ID NO: 6742 - protein, 8 aa, Artificial Sequence
  anti-influenza_CDR
IIPMFGAT

SEQ ID NO: 6743 - protein, 8 aa, Artificial Sequence
  anti-influenza_CDR
IIPMFGTT

SEQ ID NO: 6744 - protein, 8 aa, Artificial Sequence
  anti-influenza_CDR
INSGGGAT

SEQ ID NO: 6745 - protein, 8 aa, Artificial Sequence
  anti-influenza_CDR
ISAVFGTA

SEQ ID NO: 6746 - protein, 8 aa, Artificial Sequence
  anti-influenza_CDR
ISYDANYK

SEQ ID NO: 6747 - protein, 8 aa, Artificial Sequence
  anti-influenza_CDR
ISYDGNYK

SEQ ID NO: 6748 - protein, 8 aa, Artificial Sequence
  anti-influenza_CDR
ISYDGSNK

SEQ ID NO: 6749 - protein, 8 aa, Artificial Sequence
  anti-influenza_CDR
ISYDGSNQ

SEQ ID NO: 6750 - protein, 8 aa, Artificial Sequence
  anti-influenza_CDR
QQYYRSPS

SEQ ID NO: 6751 - protein, 8 aa, Artificial Sequence
  anti-influenza_CDR
VLPLFGVT

SEQ ID NO: 6752 - protein, 8 aa, Artificial Sequence
  anti-influenza_CDR
GGTFSSDA

SEQ ID NO: 6753 - protein, 8 aa, Artificial Sequence
  anti-influenza_CDR
IIPVFQTA

SEQ ID NO: 6754 - protein, 8 aa, Artificial Sequence
  anti-influenza_CDR
TSNIGSNA

SEQ ID NO: 6755 - protein, 8 aa, Artificial Sequence
  anti-influenza_CDR
GYSFTSRW

SEQ ID NO: 6756 - protein, 8 aa, Artificial Sequence
  anti-influenza_CDR
IYPSDSDV

SEQ ID NO: 6757 - protein, 8 aa, Artificial Sequence
  anti-influenza_CDR
QQYDNWLS

SEQ ID NO: 6758 - protein, 8 aa, Artificial Sequence
  anti-influenza_CDR
GGTFSNYG

SEQ ID NO: 6759 - protein, 8 aa, Artificial Sequence
  anti-influenza_CDR
GASISSSY

SEQ ID NO: 6760 - protein, 8 aa, Artificial Sequence
  anti-influenza_CDR
GGTFSSYD

SEQ ID NO: 6761 - protein, 8 aa, Artificial Sequence
  anti-influenza_CDR
IIPIYGTA

SEQ ID NO: 6762 - protein, 8 aa, Artificial Sequence
  anti-influenza_CDR
GYTSTTYG

SEQ ID NO: 6763 - protein, 8 aa, Artificial Sequence
  anti-influenza_CDR
INPYNGNP

SEQ ID NO: 6764 - protein, 8 aa, Artificial Sequence
  anti-influenza_CDR
IWYDGDNK

SEQ ID NO: 6765 - protein, 8 aa, Artificial Sequence
  anti-influenza_CDR
GFTFSDFW

SEQ ID NO: 6766 - protein, 8 aa, Artificial Sequence
  anti-influenza_CDR
IDQDGNER

SEQ ID NO: 6767 - protein, 8 aa, Artificial Sequence
  anti-influenza_CDR
SSNIGKNY

SEQ ID NO: 6768 - protein, 8 aa, Artificial Sequence
  anti-influenza_CDR
GYTFTNYW

SEQ ID NO: 6769 - protein, 8 aa, Artificial Sequence
  anti-influenza_CDR
IFPPDSQT

SEQ ID NO: 6770 - protein, 8 aa, Artificial Sequence
  anti-influenza_CDR
GYSFSDYW

SEQ ID NO: 6771 - protein, 8 aa, Artificial Sequence
  anti-influenza_CDR
IYPASSEI

SEQ ID NO: 6772 - protein, 8 aa, Artificial Sequence
  anti-influenza_CDR
SGDSGTWN

SEQ ID NO: 6773 - protein, 8 aa, Artificial Sequence
  anti-influenza_CDR
GGTLNNYA

SEQ ID NO: 6774 - protein, 8 aa, Artificial Sequence
  anti-influenza_CDR
ISPIFGTL

SEQ ID NO: 6775 - protein, 8 aa, Artificial Sequence
  anti-influenza_CDR
GVFFSSHA

SEQ ID NO: 6776 - protein, 8 aa, Artificial Sequence
  anti-influenza_CDR
ISPMFGTT

SEQ ID NO: 6777 - protein, 8 aa, Artificial Sequence
  anti-influenza_CDR
GFTFSRFG

SEQ ID NO: 6778 - protein, 8 aa, Artificial Sequence
  anti-influenza_CDR
IWYDGSNK

SEQ ID NO: 6779 - protein, 8 aa, Artificial Sequence
  anti-influenza_CDR
QTYGGVST

SEQ ID NO: 6780 - protein, 8 aa, Artificial Sequence
  anti-influenza_CDR
DSAGNRHS

SEQ ID NO: 6781 - protein, 8 aa, Artificial Sequence
  anti-influenza_CDR
FRGGNSLS

SEQ ID NO: 6782 - protein, 8 aa, Artificial Sequence
  anti-influenza_CDR
GYTFTTYW

SEQ ID NO: 6783 - protein, 8 aa, Artificial Sequence
  anti-influenza_CDR
IDPYDSET

SEQ ID NO: 6784 - protein, 8 aa, Artificial Sequence
  anti-influenza_CDR
IRKFLNWY

SEQ ID NO: 6785 - protein, 8 aa, Artificial Sequence
  anti-influenza_CDR
QQYDGLPF

SEQ ID NO: 6786 - protein, 8 aa, Artificial Sequence
  anti-influenza_CDR
IRNSLNWY

SEQ ID NO: 6787 - protein, 8 aa, Artificial Sequence
  anti-influenza_CDR
QQANSFPL

SEQ ID NO: 6788 - protein, 8 aa, Artificial Sequence
  anti-influenza_CDR
SLLTEVET

SEQ ID NO: 6789 - protein, 8 aa, Artificial Sequence
  anti-influenza_CDR
QQSYSMPA

SEQ ID NO: 6790 - protein, 8 aa, Artificial Sequence
  anti-influenza_CDR
GGPVSGGG

SEQ ID NO: 6791 - protein, 8 aa, Artificial Sequence
  anti-influenza_CDR
QQSFSVPA

SEQ ID NO: 6792 - protein, 8 aa, Artificial Sequence
  anti-influenza_CDR
QQTYSIPL

SEQ ID NO: 6793 - protein, 8 aa, Artificial Sequence
  anti-influenza_CDR
QQSYSVPA

SEQ ID NO: 6794 - protein, 8 aa, Artificial Sequence
  anti-influenza_CDR
QQTFSIPL

SEQ ID NO: 6795 - protein, 8 aa, Artificial Sequence
  anti-influenza_CDR
GDSITSGA

SEQ ID NO: 6796 - protein, 8 aa, Artificial Sequence
  anti-influenza_CDR
QAWDSSTA

SEQ ID NO: 6797 - protein, 8 aa, Artificial Sequence
  anti-influenza_CDR
QQYGSSLW

SEQ ID NO: 6798 - protein, 8 aa, Artificial Sequence
  anti-influenza_CDR
AYGYTFDP

SEQ ID NO: 6799 - protein, 8 aa, Artificial Sequence
  anti-influenza_CDR
MQALQTPL

SEQ ID NO: 6800 - protein, 8 aa, Artificial Sequence
  anti-influenza_CDR
QQYGSSLT

SEQ ID NO: 6801 - protein, 8 aa, Artificial Sequence
  anti-influenza_CDR
QKYNSAPS

SEQ ID NO: 6802 - protein, 8 aa, Artificial Sequence
  anti-influenza_CDR
QQRSNWLK

SEQ ID NO: 6803 - protein, 8 aa, Artificial Sequence
  anti-influenza_CDR
SSQSRSST

SEQ ID NO: 6804 - protein, 8 aa, Artificial Sequence
  anti-influenza_CDR
PYDVPDYE

SEQ ID NO: 6805 - protein, 8 aa, Artificial Sequence
  anti-influenza_CDR
PYDVPDYA

SEQ ID NO: 6806 - protein, 8 aa, Artificial Sequence
  anti-influenza_CDR
PGDFNDYE

SEQ ID NO: 6807 - protein, 8 aa, Artificial Sequence
  anti-influenza_CDR
PKVRDQES

SEQ ID NO: 6808 - protein, 8 aa, Artificial Sequence
  anti-influenza_CDR
TSYTSSNT

SEQ ID NO: 6809 - protein, 8 aa, Artificial Sequence
  anti-influenza_CDR
GGNFNNYA

SEQ ID NO: 6810 - protein, 8 aa, Artificial Sequence
  anti-influenza_CDR
ISPIFGST

SEQ ID NO: 6811 - protein, 8 aa, Artificial Sequence
  anti-influenza_CDR
SSYTSSNT

SEQ ID NO: 6812 - protein, 8 aa, Artificial Sequence
  anti-influenza_CDR
GGTFNNYA

SEQ ID NO: 6813 - protein, 8 aa, Artificial Sequence
  anti-influenza_CDR
ISPIFGSV

SEQ ID NO: 6814 - protein, 8 aa, Artificial Sequence
  anti-influenza_CDR
SSNIGHNF

SEQ ID NO: 6815 - protein, 8 aa, Artificial Sequence
  anti-influenza_CDR
GTWDSSLS

SEQ ID NO: 6816 - protein, 8 aa, Artificial Sequence
  anti-influenza_CDR
GGIIRKYA

SEQ ID NO: 6817 - protein, 8 aa, Artificial Sequence
  anti-influenza_CDR
IIAIFNTA

SEQ ID NO: 6818 - protein, 8 aa, Artificial Sequence
  anti-influenza_CDR
GYTFTAYT

SEQ ID NO: 6819 - protein, 8 aa, Artificial Sequence
  anti-influenza_CDR
INAGNGHT

SEQ ID NO: 6820 - protein, 8 aa, Artificial Sequence
  anti-influenza_CDR
GGTFINYA

SEQ ID NO: 6821 - protein, 8 aa, Artificial Sequence
  anti-influenza_CDR
IIPVYGTS

SEQ ID NO: 6822 - protein, 8 aa, Artificial Sequence
  anti-influenza_CDR
GFTFRSHA

SEQ ID NO: 6823 - protein, 8 aa, Artificial Sequence
  anti-influenza_CDR
ISYDEVNK

SEQ ID NO: 6824 - protein, 8 aa, Artificial Sequence
  anti-influenza_CDR
GYNFAAYY

SEQ ID NO: 6825 - protein, 8 aa, Artificial Sequence
  anti-influenza_CDR
SNPNTGGA

SEQ ID NO: 6826 - protein, 8 aa, Artificial Sequence
  anti-influenza_CDR
GYTLIDYY

SEQ ID NO: 6827 - protein, 8 aa, Artificial Sequence
  anti-influenza_CDR
INPINGGT

SEQ ID NO: 6828 - protein, 8 aa, Artificial Sequence
  anti-influenza_CDR
GFTFSAYA

SEQ ID NO: 6829 - protein, 8 aa, Artificial Sequence
  anti-influenza_CDR
TSYDGRDS

SEQ ID NO: 6830 - protein, 8 aa, Artificial Sequence
  anti-influenza_CDR
GFTFTNYA

SEQ ID NO: 6831 - protein, 8 aa, Artificial Sequence
  anti-influenza_CDR
ISFDEDNK

SEQ ID NO: 6832 - protein, 8 aa, Artificial Sequence
  anti-influenza_CDR
GFNFSSYG

SEQ ID NO: 6833 - protein, 8 aa, Artificial Sequence
  anti-influenza_CDR
IWSGGSNK

SEQ ID NO: 6834 - protein, 8 aa, Artificial Sequence
  anti-influenza_CDR
GFIFGDFA

SEQ ID NO: 6835 - protein, 8 aa, Artificial Sequence
  anti-influenza_CDR
GFNFDEYV

SEQ ID NO: 6836 - protein, 8 aa, Artificial Sequence
  anti-influenza_CDR
IGADGRGT

SEQ ID NO: 6837 - protein, 8 aa, Artificial Sequence
  anti-influenza_CDR
GGSVSNYY

SEQ ID NO: 6838 - protein, 8 aa, Artificial Sequence
  anti-influenza_CDR
GGTFSYYA

SEQ ID NO: 6839 - protein, 8 aa, Artificial Sequence
  anti-influenza_CDR
IIPIVGTA

SEQ ID NO: 6840 - protein, 8 aa, Artificial Sequence
  anti-influenza_CDR
TSNIGSNT

SEQ ID NO: 6841 - protein, 8 aa, Artificial Sequence
  anti-influenza_CDR
GYNFPKYW

SEQ ID NO: 6842 - protein, 8 aa, Artificial Sequence
  anti-influenza_CDR
IYPGDSDV

SEQ ID NO: 6843 - protein, 8 aa, Artificial Sequence
  anti-influenza_CDR
GHTFISYA

SEQ ID NO: 6844 - protein, 8 aa, Artificial Sequence
  anti-influenza_CDR
IVPIFGTV

SEQ ID NO: 6845 - protein, 8 aa, Artificial Sequence
  anti-influenza_CDR
GFTFRTYG

SEQ ID NO: 6846 - protein, 8 aa, Artificial Sequence
  anti-influenza_CDR
ISYDGTNK

SEQ ID NO: 6847 - protein, 8 aa, Artificial Sequence
  anti-influenza_CDR
GFTFSSYG

SEQ ID NO: 6848 - protein, 8 aa, Artificial Sequence
  anti-influenza_CDR
ISYDEINK

SEQ ID NO: 6849 - protein, 8 aa, Artificial Sequence
  anti-influenza_CDR
GFSLWTSG

SEQ ID NO: 6850 - protein, 8 aa, Artificial Sequence
  anti-influenza_CDR
MSYDETKK

SEQ ID NO: 6851 - protein, 8 aa, Artificial Sequence
  anti-influenza_CDR
GFTFSRYS

SEQ ID NO: 6852 - protein, 8 aa, Artificial Sequence
  anti-influenza_CDR
ISDTSRTI

SEQ ID NO: 6853 - protein, 8 aa, Artificial Sequence
  anti-influenza_CDR
GFTFNSYA

SEQ ID NO: 6854 - protein, 8 aa, Artificial Sequence
  anti-influenza_CDR
IRGSGENT

SEQ ID NO: 6855 - protein, 8 aa, Artificial Sequence
  anti-influenza_CDR
GFTFSRFS

SEQ ID NO: 6856 - protein, 8 aa, Artificial Sequence
  anti-influenza_CDR
ISDTGRTI

SEQ ID NO: 6857 - protein, 8 aa, Artificial Sequence
  anti-influenza_CDR
GDSFTSYW

SEQ ID NO: 6858 - protein, 8 aa, Artificial Sequence
  anti-influenza_CDR
IYPRDSET

SEQ ID NO: 6859 - protein, 8 aa, Artificial Sequence
  anti-influenza_CDR
GYTFTAYH

SEQ ID NO: 6860 - protein, 8 aa, Artificial Sequence
  anti-influenza_CDR
INPNSGAT

SEQ ID NO: 6861 - protein, 8 aa, Artificial Sequence
  anti-influenza_CDR
GFTFSDYW

SEQ ID NO: 6862 - protein, 8 aa, Artificial Sequence
  anti-influenza_CDR
ISSDGSTT

SEQ ID NO: 6863 - protein, 8 aa, Artificial Sequence
  anti-influenza_CDR
GFSFSNAW

SEQ ID NO: 6864 - protein, 8 aa, Artificial Sequence
  anti-influenza_CDR
GLTFSNAW

SEQ ID NO: 6865 - protein, 8 aa, Artificial Sequence
  anti-influenza_CDR
GFTFSNAW

SEQ ID NO: 6866 - protein, 8 aa, Artificial Sequence
  anti-influenza_CDR
GLSFLNAW

SEQ ID NO: 6867 - protein, 8 aa, Artificial Sequence
  anti-influenza_CDR
GFSFLNAW

SEQ ID NO: 6868 - protein, 8 aa, Artificial Sequence
  anti-influenza_CDR
GLTFLNAW

SEQ ID NO: 6869 - protein, 8 aa, Artificial Sequence
  anti-influenza_CDR
GFTFLNAW

SEQ ID NO: 6870 - protein, 8 aa, Artificial Sequence
  anti-influenza_CDR
GYTFTDYY

SEQ ID NO: 6871 - protein, 8 aa, Artificial Sequence
  anti-influenza_CDR
VNPYSGGT

SEQ ID NO: 6872 - protein, 8 aa, Artificial Sequence
  anti-influenza_CDR
GYTFTDYN

SEQ ID NO: 6873 - protein, 8 aa, Artificial Sequence
  anti-influenza_CDR
IYPNNGGT

SEQ ID NO: 6874 - protein, 8 aa, Artificial Sequence
  anti-influenza_CDR
GYTFTGYN

SEQ ID NO: 6875 - protein, 8 aa, Artificial Sequence
  anti-influenza_CDR
IYPNNGVT

SEQ ID NO: 6876 - protein, 8 aa, Artificial Sequence
  anti-influenza_CDR
METDTLLL

SEQ ID NO: 6877 - protein, 9 aa, Artificial Sequence
  anti-influenza_CDR
DGVTNKVNS

SEQ ID NO: 6878 - protein, 9 aa, Artificial Sequence
  anti-influenza_CDR
GSDVGSSNL

SEQ ID NO: 6879 - protein, 9 aa, Artificial Sequence
  anti-influenza_CDR
MQNILLPLT

SEQ ID NO: 6880 - protein, 9 aa, Artificial Sequence
  anti-influenza_CDR
MQSLQLPLT

SEQ ID NO: 6881 - protein, 9 aa, Artificial Sequence
  anti-influenza_CDR
QQHYRTPPT

SEQ ID NO: 6882 - protein, 9 aa, Artificial Sequence
  anti-influenza_CDR
QQYGNSPYT

SEQ ID NO: 6883 - protein, 9 aa, Artificial Sequence
  anti-influenza_CDR
QQYGSSPYT

SEQ ID NO: 6884 - protein, 9 aa, Artificial Sequence
  anti-influenza_CDR
QQYGTSPQT

SEQ ID NO: 6885 - protein, 9 aa, Artificial Sequence
  anti-influenza_CDR
QQYGYLPLT

SEQ ID NO: 6886 - protein, 9 aa, Artificial Sequence
  anti-influenza_CDR
QAWDSSTAV

SEQ ID NO: 6887 - protein, 9 aa, Artificial Sequence
  anti-influenza_CDR
QHYNAYWGT

SEQ ID NO: 6888 - protein, 9 aa, Artificial Sequence
  anti-influenza_CDR
QQTYSSPPT

SEQ ID NO: 6889 - protein, 9 aa, Artificial Sequence
  anti-influenza_CDR
QQYYSFPYT

SEQ ID NO: 6890 - protein, 9 aa, Artificial Sequence
  anti-influenza_CDR
MQALQLPLA

SEQ ID NO: 6891 - protein, 9 aa, Artificial Sequence
  anti-influenza_CDR
QQANSFPFT

SEQ ID NO: 6892 - protein, 9 aa, Artificial Sequence
  anti-influenza_CDR
QQLNGYPLT

SEQ ID NO: 6893 - protein, 9 aa, Artificial Sequence
  anti-influenza_CDR
MQALQTPLT

SEQ ID NO: 6894 - protein, 9 aa, Artificial Sequence
  anti-influenza_CDR
QQNYNWPLT

SEQ ID NO: 6895 - protein, 9 aa, Artificial Sequence
  anti-influenza_CDR
QQYDTSSGL

SEQ ID NO: 6896 - protein, 9 aa, Artificial Sequence
  anti-influenza_CDR
QQYNSWPRT

SEQ ID NO: 6897 - protein, 9 aa, Artificial Sequence
  anti-influenza_CDR
VIYSHGRAY

SEQ ID NO: 6898 - protein, 9 aa, Artificial Sequence
  anti-influenza_CDR
QQYGDSRYT

SEQ ID NO: 6899 - protein, 9 aa, Artificial Sequence
  anti-influenza_CDR
LQHNSYPYT

SEQ ID NO: 6900 - protein, 9 aa, Artificial Sequence
  anti-influenza_CDR
RKMTTAFDS

SEQ ID NO: 6901 - protein, 9 aa, Artificial Sequence
  anti-influenza_CDR
QRNHSPSWT

SEQ ID NO: 6902 - protein, 9 aa, Artificial Sequence
  anti-influenza_CDR
QQSYDNPQT

SEQ ID NO: 6903 - protein, 9 aa, Artificial Sequence
  anti-influenza_CDR
QQSRRLPYT

SEQ ID NO: 6904 - protein, 9 aa, Artificial Sequence
  anti-influenza_CDR
RKMTTAIDY

SEQ ID NO: 6905 - protein, 9 aa, Artificial Sequence
  anti-influenza_CDR
IRYTGQQLL

SEQ ID NO: 6906 - protein, 9 aa, Artificial Sequence
  anti-influenza_CDR
QHYGTISQT

SEQ ID NO: 6907 - protein, 9 aa, Artificial Sequence
  anti-influenza_CDR
QQYSTSPPT

SEQ ID NO: 6908 - protein, 9 aa, Artificial Sequence
  anti-influenza_CDR
QQYGNSPIT

SEQ ID NO: 6909 - protein, 9 aa, Artificial Sequence
  anti-influenza_CDR
QQYYSRPYT

SEQ ID NO: 6910 - protein, 9 aa, Artificial Sequence
  anti-influenza_CDR
QVWDNFGGV

SEQ ID NO: 6911 - protein, 9 aa, Artificial Sequence
  anti-influenza_CDR
QQSYSSPLT

SEQ ID NO: 6912 - protein, 9 aa, Artificial Sequence
  anti-influenza_CDR
QQYFATPRT

SEQ ID NO: 6913 - protein, 9 aa, Artificial Sequence
  anti-influenza_CDR
QQYYFSPLT

SEQ ID NO: 6914 - protein, 9 aa, Artificial Sequence
  anti-influenza_CDR
QHFGTSVFT

SEQ ID NO: 6915 - protein, 9 aa, Artificial Sequence
  anti-influenza_CDR
QQYYNAPLT

SEQ ID NO: 6916 - protein, 9 aa, Artificial Sequence
  anti-influenza_CDR
VLFTSPFDF

SEQ ID NO: 6917 - protein, 9 aa, Artificial Sequence
  anti-influenza_CDR
LLSYSGVWV

SEQ ID NO: 6918 - protein, 9 aa, Artificial Sequence
  anti-influenza_CDR
FLSYSGAWV

SEQ ID NO: 6919 - protein, 9 aa, Artificial Sequence
  anti-influenza_CDR
QQSFSKSWT

SEQ ID NO: 6920 - protein, 9 aa, Artificial Sequence
  anti-influenza_CDR
VQYVQFPWT

SEQ ID NO: 6921 - protein, 9 aa, Artificial Sequence
  anti-influenza_CDR
QQSYSPPLT

SEQ ID NO: 6922 - protein, 9 aa, Artificial Sequence
  anti-influenza_CDR
FIYYGGNTK

SEQ ID NO: 6923 - protein, 9 aa, Artificial Sequence
  anti-influenza_CDR
VIYSGGSTY

SEQ ID NO: 6924 - protein, 9 aa, Artificial Sequence
  anti-influenza_CDR
FMFHSGSPR

SEQ ID NO: 6925 - protein, 9 aa, Artificial Sequence
  anti-influenza_CDR
QQTYSTPIT

SEQ ID NO: 6926 - protein, 9 aa, Artificial Sequence
  anti-influenza_CDR
FFYNGGSTK

SEQ ID NO: 6927 - protein, 9 aa, Artificial Sequence
  anti-influenza_CDR
QQSYNTPLI

SEQ ID NO: 6928 - protein, 9 aa, Artificial Sequence
  anti-influenza_CDR
HIYDYGRTF

SEQ ID NO: 6929 - protein, 9 aa, Artificial Sequence
  anti-influenza_CDR
VFYSETRTY

SEQ ID NO: 6930 - protein, 9 aa, Artificial Sequence
  anti-influenza_CDR
QVWGSSSDH

SEQ ID NO: 6931 - protein, 9 aa, Artificial Sequence
  anti-influenza_CDR
YVYNRGSTK

SEQ ID NO: 6932 - protein, 9 aa, Artificial Sequence
  anti-influenza_CDR
YIYNRGSTK

SEQ ID NO: 6933 - protein, 9 aa, Artificial Sequence
  anti-influenza_CDR
QQSYNTPIT

SEQ ID NO: 6934 - protein, 9 aa, Artificial Sequence
  anti-influenza_CDR
QQYYSSPPT

SEQ ID NO: 6935 - protein, 9 aa, Artificial Sequence
  anti-influenza_CDR
YLYYSGSTK

SEQ ID NO: 6936 - protein, 9 aa, Artificial Sequence
  anti-influenza_CDR
QQSYSPPIT

SEQ ID NO: 6937 - protein, 9 aa, Artificial Sequence
  anti-influenza_CDR
YVYNSGNTK

SEQ ID NO: 6938 - protein, 9 aa, Artificial Sequence
  anti-influenza_CDR
QQSYNTPLT

SEQ ID NO: 6939 - protein, 9 aa, Artificial Sequence
  anti-influenza_CDR
HIFDSGSTY

SEQ ID NO: 6940 - protein, 9 aa, Artificial Sequence
  anti-influenza_CDR
VFYSADRTS

SEQ ID NO: 6941 - protein, 9 aa, Artificial Sequence
  anti-influenza_CDR
QQYYSTPLT

SEQ ID NO: 6942 - protein, 9 aa, Artificial Sequence
  anti-influenza_CDR
YIYYSGNTY

SEQ ID NO: 6943 - protein, 9 aa, Artificial Sequence
  anti-influenza_CDR
QQSYSTPLT

SEQ ID NO: 6944 - protein, 9 aa, Artificial Sequence
  anti-influenza_CDR
QQYGSSSLT

SEQ ID NO: 6945 - protein, 9 aa, Artificial Sequence
  anti-influenza_CDR
SSYTSSSTY

SEQ ID NO: 6946 - protein, 9 aa, Artificial Sequence
  anti-influenza_CDR
QRYNSAPPI

SEQ ID NO: 6947 - protein, 9 aa, Artificial Sequence
  anti-influenza_CDR
QQYGRTPLT

SEQ ID NO: 6948 - protein, 9 aa, Artificial Sequence
  anti-influenza_CDR
QQYGSSPRT

SEQ ID NO: 6949 - protein, 9 aa, Artificial Sequence
  anti-influenza_CDR
QQYGSSPLT

SEQ ID NO: 6950 - protein, 9 aa, Artificial Sequence
  anti-influenza_CDR
QVWDSSSDH

SEQ ID NO: 6951 - protein, 9 aa, Artificial Sequence
  anti-influenza_CDR
KEFSEVEGR

SEQ ID NO: 6952 - protein, 9 aa, Artificial Sequence
  anti-influenza_CDR
KEFNNLEKR

SEQ ID NO: 6953 - protein, 9 aa, Artificial Sequence
  anti-influenza_CDR
QQHYRTPPS

SEQ ID NO: 6954 - protein, 9 aa, Artificial Sequence
  anti-influenza_CDR
MQATHWPLT

SEQ ID NO: 6955 - protein, 9 aa, Artificial Sequence
  anti-influenza_CDR
QQYYSYPYT

SEQ ID NO: 6956 - protein, 9 aa, Artificial Sequence
  anti-influenza_CDR
SSDVGGYNY

SEQ ID NO: 6957 - protein, 9 aa, Artificial Sequence
  anti-influenza_CDR
SSDVGDYNY

SEQ ID NO: 6958 - protein, 9 aa, Artificial Sequence
  anti-influenza_CDR
QQYNNWPLS

SEQ ID NO: 6959 - protein, 9 aa, Artificial Sequence
  anti-influenza_CDR
QQSYNYPRT

SEQ ID NO: 6960 - protein, 9 aa, Artificial Sequence
  anti-influenza_CDR
MQGLQTPYT

SEQ ID NO: 6961 - protein, 9 aa, Artificial Sequence
  anti-influenza_CDR
QQHYSIPLT

SEQ ID NO: 6962 - protein, 9 aa, Artificial Sequence
  anti-influenza_CDR
LQHNSYPWT

SEQ ID NO: 6963 - protein, 9 aa, Artificial Sequence
  anti-influenza_CDR
QQYNTWPLT

SEQ ID NO: 6964 - protein, 9 aa, Artificial Sequence
  anti-influenza_CDR
QQYNSFPYR

SEQ ID NO: 6965 - protein, 9 aa, Artificial Sequence
  anti-influenza_CDR
QQSYSAPFT

SEQ ID NO: 6966 - protein, 9 aa, Artificial Sequence
  anti-influenza_CDR
QAWDSSTVV

SEQ ID NO: 6967 - protein, 9 aa, Artificial Sequence
  anti-influenza_CDR
QAWDSTTVV

SEQ ID NO: 6968 - protein, 9 aa, Artificial Sequence
  anti-influenza_CDR
LQYGSSPRT

SEQ ID NO: 6969 - protein, 9 aa, Artificial Sequence
  anti-influenza_CDR
SSDVGGYDY

SEQ ID NO: 6970 - protein, 9 aa, Artificial Sequence
  anti-influenza_CDR
QQYTYWPLT

SEQ ID NO: 6971 - protein, 9 aa, Artificial Sequence
  anti-influenza_CDR
QQYDKWPPG

SEQ ID NO: 6972 - protein, 9 aa, Artificial Sequence
  anti-influenza_CDR
MQSLQTSIT

SEQ ID NO: 6973 - protein, 9 aa, Artificial Sequence
  anti-influenza_CDR
SQIELAVLL

SEQ ID NO: 6974 - protein, 9 aa, Artificial Sequence
  anti-influenza_CDR
MQALQTPYT

SEQ ID NO: 6975 - protein, 9 aa, Artificial Sequence
  anti-influenza_CDR
QQRSHWPPI

SEQ ID NO: 6976 - protein, 9 aa, Artificial Sequence
  anti-influenza_CDR
QHFWGTPLT

SEQ ID NO: 6977 - protein, 9 aa, Artificial Sequence
  anti-influenza_CDR
QQNYEDPWT

SEQ ID NO: 6978 - protein, 9 aa, Artificial Sequence
  anti-influenza_CDR
QQANSFPPT

SEQ ID NO: 6979 - protein, 9 aa, Artificial Sequence
  anti-influenza_CDR
QQRDHWPPI

SEQ ID NO: 6980 - protein, 9 aa, Artificial Sequence
  anti-influenza_CDR
MDSRLNLVF

SEQ ID NO: 6981 - protein, 9 aa, Artificial Sequence
  anti-influenza_CDR
MKLPVRLLV

SEQ ID NO: 6982 - protein, 10 aa, Artificial Sequence
  anti-influenza_CDR
GDSVTRGGFY

SEQ ID NO: 6983 - protein, 10 aa, Artificial Sequence
  anti-influenza_CDR
QSVTFNNKNY

SEQ ID NO: 6984 - protein, 10 aa, Artificial Sequence
  anti-influenza_CDR
QSVTFNYKNY

SEQ ID NO: 6985 - protein, 10 aa, Artificial Sequence
  anti-influenza_CDR
RAQSLSSYLH

SEQ ID NO: 6986 - protein, 10 aa, Artificial Sequence
  anti-influenza_CDR
SSYTSSSTYV

SEQ ID NO: 6987 - protein, 10 aa, Artificial Sequence
  anti-influenza_CDR
QRYNSAPPIT

SEQ ID NO: 6988 - protein, 10 aa, Artificial Sequence
  anti-influenza_CDR
GGSISSGTYY

SEQ ID NO: 6989 - protein, 10 aa, Artificial Sequence
  anti-influenza_CDR
QQSYSSLMFT

SEQ ID NO: 6990 - protein, 10 aa, Artificial Sequence
  anti-influenza_CDR
LLIYGASTRA

SEQ ID NO: 6991 - protein, 10 aa, Artificial Sequence
  anti-influenza_CDR
CAYGGKYLVV

SEQ ID NO: 6992 - protein, 10 aa, Artificial Sequence
  anti-influenza_CDR
RPDFYGDFEY

SEQ ID NO: 6993 - protein, 10 aa, Artificial Sequence
  anti-influenza_CDR
QHYGYSPRYA

SEQ ID NO: 6994 - protein, 10 aa, Artificial Sequence
  anti-influenza_CDR
QQRSHWPPIT

SEQ ID NO: 6995 - protein, 10 aa, Artificial Sequence
  anti-influenza_CDR
SSYAGSSTWV

SEQ ID NO: 6996 - protein, 10 aa, Artificial Sequence
  anti-influenza_CDR
LLYSGGDPVA

SEQ ID NO: 6997 - protein, 10 aa, Artificial Sequence
  anti-influenza_CDR
QQYGGSPRYT

SEQ ID NO: 6998 - protein, 10 aa, Artificial Sequence
  anti-influenza_CDR
RYGSGYGFDS

SEQ ID NO: 6999 - protein, 10 aa, Artificial Sequence
  anti-influenza_CDR
SSYAGNYNHV

SEQ ID NO: 7000 - protein, 10 aa, Artificial Sequence
  anti-influenza_CDR
QQYINWRPLS

SEQ ID NO: 7001 - protein, 10 aa, Artificial Sequence
  anti-influenza_CDR
IGAGYDVHWY

SEQ ID NO: 7002 - protein, 10 aa, Artificial Sequence
  anti-influenza_CDR
LLIYDNNNRP

SEQ ID NO: 7003 - protein, 10 aa, Artificial Sequence
  anti-influenza_CDR
QSYDNSLSGS

SEQ ID NO: 7004 - protein, 10 aa, Artificial Sequence
  anti-influenza_CDR
LLIYDASNLQ

SEQ ID NO: 7005 - protein, 10 aa, Artificial Sequence
  anti-influenza_CDR
LLIHDASNLE

SEQ ID NO: 7006 - protein, 10 aa, Artificial Sequence
  anti-influenza_CDR
VQRLSYGMDV

SEQ ID NO: 7007 - protein, 10 aa, Artificial Sequence
  anti-influenza_CDR
VQKSYYGMDV

SEQ ID NO: 7008 - protein, 10 aa, Artificial Sequence
  anti-influenza_CDR
SSYTSSSTHV

SEQ ID NO: 7009 - protein, 10 aa, Artificial Sequence
  anti-influenza_CDR
SSYTSSSTLV

SEQ ID NO: 7010 - protein, 10 aa, Artificial Sequence
  anti-influenza_CDR
TKRSQQTVIP

SEQ ID NO: 7011 - protein, 10 aa, Artificial Sequence
  anti-influenza_CDR
TSRSQQTVIP

SEQ ID NO: 7012 - protein, 10 aa, Artificial Sequence
  anti-influenza_CDR
SSNYNRRFTP

SEQ ID NO: 7013 - protein, 10 aa, Artificial Sequence
  anti-influenza_CDR
RPKVRDQESR

SEQ ID NO: 7014 - protein, 10 aa, Artificial Sequence
  anti-influenza_CDR
RPWVRGVSSR

SEQ ID NO: 7015 - protein, 10 aa, Artificial Sequence
  anti-influenza_CDR
RPWVRGLSSR

SEQ ID NO: 7016 - protein, 10 aa, Artificial Sequence
  anti-influenza_CDR
RPKVRGQAGR

SEQ ID NO: 7017 - protein, 10 aa, Artificial Sequence
  anti-influenza_CDR
APAVAAQASA

SEQ ID NO: 7018 - protein, 10 aa, Artificial Sequence
  anti-influenza_CDR
VHHPGTDNDQ

SEQ ID NO: 7019 - protein, 10 aa, Artificial Sequence
  anti-influenza_CDR
FGQGTKVEIK

SEQ ID NO: 7020 - protein, 10 aa, Artificial Sequence
  anti-influenza_CDR
GFAFHNRAMH

SEQ ID NO: 7021 - protein, 10 aa, Artificial Sequence
  anti-influenza_CDR
GLTFSSYAVH

SEQ ID NO: 7022 - protein, 10 aa, Artificial Sequence
  anti-influenza_CDR
GPTFSSYAVH

SEQ ID NO: 7023 - protein, 10 aa, Artificial Sequence
  anti-influenza_CDR
GSIFSNYGIS

SEQ ID NO: 7024 - protein, 10 aa, Artificial Sequence
  anti-influenza_CDR
GYSFNNYGIN

SEQ ID NO: 7025 - protein, 10 aa, Artificial Sequence
  anti-influenza_CDR
GYTFNAYYIH

SEQ ID NO: 7026 - protein, 10 aa, Artificial Sequence
  anti-influenza_CDR
GYTFTSFIMY

SEQ ID NO: 7027 - protein, 10 aa, Artificial Sequence
  anti-influenza_CDR
RGNYGNGFAY

SEQ ID NO: 7028 - protein, 10 aa, Artificial Sequence
  anti-influenza_CDR
QQYGSSPALT

SEQ ID NO: 7029 - protein, 10 aa, Artificial Sequence
  anti-influenza_CDR
QEYNNDSPLT

SEQ ID NO: 7030 - protein, 10 aa, Artificial Sequence
  anti-influenza_CDR
IRSGLNRFET

SEQ ID NO: 7031 - protein, 10 aa, Artificial Sequence
  anti-influenza_CDR
VFYSGSSNYN

SEQ ID NO: 7032 - protein, 10 aa, Artificial Sequence
  anti-influenza_CDR
GASISTGGNY

SEQ ID NO: 7033 - protein, 10 aa, Artificial Sequence
  anti-influenza_CDR
IFYSGTTKYN

SEQ ID NO: 7034 - protein, 10 aa, Artificial Sequence
  anti-influenza_CDR
ASYAGTYIHL

SEQ ID NO: 7035 - protein, 10 aa, Artificial Sequence
  anti-influenza_CDR
QQLNSYPPIT

SEQ ID NO: 7036 - protein, 10 aa, Artificial Sequence
  anti-influenza_CDR
QQFNDWPFLT

SEQ ID NO: 7037 - protein, 10 aa, Artificial Sequence
  anti-influenza_CDR
QQLTTYPPIT

SEQ ID NO: 7038 - protein, 10 aa, Artificial Sequence
  anti-influenza_CDR
GGSISNGGYH

SEQ ID NO: 7039 - protein, 10 aa, Artificial Sequence
  anti-influenza_CDR
GDSVINSAYY

SEQ ID NO: 7040 - protein, 10 aa, Artificial Sequence
  anti-influenza_CDR
QQYDNWLPIT

SEQ ID NO: 7041 - protein, 10 aa, Artificial Sequence
  anti-influenza_CDR
AGDYSGGIYA

SEQ ID NO: 7042 - protein, 10 aa, Artificial Sequence
  anti-influenza_CDR
AGDYSGSNYA

SEQ ID NO: 7043 - protein, 10 aa, Artificial Sequence
  anti-influenza_CDR
AGDYSGANYA

SEQ ID NO: 7044 - protein, 10 aa, Artificial Sequence
  anti-influenza_CDR
GLSLYSNEIN

SEQ ID NO: 7045 - protein, 10 aa, Artificial Sequence
  anti-influenza_CDR
ASYAGNNIYV

SEQ ID NO: 7046 - protein, 10 aa, Artificial Sequence
  anti-influenza_CDR
ASQSVSTFLA

SEQ ID NO: 7047 - protein, 10 aa, Artificial Sequence
  anti-influenza_CDR
IKSNTDGGTT

SEQ ID NO: 7048 - protein, 10 aa, Artificial Sequence
  anti-influenza_CDR
ESVDIYGNSF

SEQ ID NO: 7049 - protein, 10 aa, Artificial Sequence
  anti-influenza_CDR
ESIDIYGNSF

SEQ ID NO: 7050 - protein, 10 aa, Artificial Sequence
  anti-influenza_CDR
AGDYSGVNYA

SEQ ID NO: 7051 - protein, 11 aa, Artificial Sequence
  anti-influenza_CDR
AAWDDSLNGQL

SEQ ID NO: 7052 - protein, 11 aa, Artificial Sequence
  anti-influenza_CDR
CSYAGSSSSRV

SEQ ID NO: 7053 - protein, 11 aa, Artificial Sequence
  anti-influenza_CDR
LVLATGLRNSP

SEQ ID NO: 7054 - protein, 11 aa, Artificial Sequence
  anti-influenza_CDR
QSLLHSDGKTY

SEQ ID NO: 7055 - protein, 11 aa, Artificial Sequence
  anti-influenza_CDR
RTSQSLSSYLH

SEQ ID NO: 7056 - protein, 11 aa, Artificial Sequence
  anti-influenza_CDR
RASQRLNSYLH

SEQ ID NO: 7057 - protein, 11 aa, Artificial Sequence
  anti-influenza_CDR
RTSQSLRSYLH

SEQ ID NO: 7058 - protein, 11 aa, Artificial Sequence
  anti-influenza_CDR
RTSQSLSSYTH

SEQ ID NO: 7059 - protein, 11 aa, Artificial Sequence
  anti-influenza_CDR
RTSQSLSSYDH

SEQ ID NO: 7060 - protein, 11 aa, Artificial Sequence
  anti-influenza_CDR
QVWDSSSDHYV

SEQ ID NO: 7061 - protein, 11 aa, Artificial Sequence
  anti-influenza_CDR
QVWGSSSDHYV

SEQ ID NO: 7062 - protein, 11 aa, Artificial Sequence
  anti-influenza_CDR
GTWDSSLSVGM

SEQ ID NO: 7063 - protein, 11 aa, Artificial Sequence
  anti-influenza_CDR
QSLLHGNGYNY

SEQ ID NO: 7064 - protein, 11 aa, Artificial Sequence
  anti-influenza_CDR
RASQGIRNDLG

SEQ ID NO: 7065 - protein, 11 aa, Artificial Sequence
  anti-influenza_CDR
RASQNIRSYLN

SEQ ID NO: 7066 - protein, 11 aa, Artificial Sequence
  anti-influenza_CDR
RANQDIGIYLN

SEQ ID NO: 7067 - protein, 11 aa, Artificial Sequence
  anti-influenza_CDR
RASQSVSNNLA

SEQ ID NO: 7068 - protein, 11 aa, Artificial Sequence
  anti-influenza_CDR
QQYHNWPPSYS

SEQ ID NO: 7069 - protein, 11 aa, Artificial Sequence
  anti-influenza_CDR
RASQGILNCLA

SEQ ID NO: 7070 - protein, 11 aa, Artificial Sequence
  anti-influenza_CDR
RASQSIASWLA

SEQ ID NO: 7071 - protein, 11 aa, Artificial Sequence
  anti-influenza_CDR
APRVYEYYFDQ

SEQ ID NO: 7072 - protein, 11 aa, Artificial Sequence
  anti-influenza_CDR
RASQSVSSYLA

SEQ ID NO: 7073 - protein, 11 aa, Artificial Sequence
  anti-influenza_CDR
SGDALPKQNAY

SEQ ID NO: 7074 - protein, 11 aa, Artificial Sequence
  anti-influenza_CDR
QSADSSGTSWV

SEQ ID NO: 7075 - protein, 11 aa, Artificial Sequence
  anti-influenza_CDR
GGSNIGGKSVH

SEQ ID NO: 7076 - protein, 11 aa, Artificial Sequence
  anti-influenza_CDR
QHYGSSPRYAF

SEQ ID NO: 7077 - protein, 11 aa, Artificial Sequence
  anti-influenza_CDR
RASQSISSYLN

SEQ ID NO: 7078 - protein, 11 aa, Artificial Sequence
  anti-influenza_CDR
GGNAIGSKKVH

SEQ ID NO: 7079 - protein, 11 aa, Artificial Sequence
  anti-influenza_CDR
QVWDFTIDHVV

SEQ ID NO: 7080 - protein, 11 aa, Artificial Sequence
  anti-influenza_CDR
ATWDGSLSAWV

SEQ ID NO: 7081 - protein, 11 aa, Artificial Sequence
  anti-influenza_CDR
RASQSVGNYLA

SEQ ID NO: 7082 - protein, 11 aa, Artificial Sequence
  anti-influenza_CDR
QQRSKWPPMYS

SEQ ID NO: 7083 - protein, 11 aa, Artificial Sequence
  anti-influenza_CDR
DVSTTWSWFAP

SEQ ID NO: 7084 - protein, 11 aa, Artificial Sequence
  anti-influenza_CDR
RASQNIKRYFN

SEQ ID NO: 7085 - protein, 11 aa, Artificial Sequence
  anti-influenza_CDR
RASQSVGNSLA

SEQ ID NO: 7086 - protein, 11 aa, Artificial Sequence
  anti-influenza_CDR
GESTLSYYAVS

SEQ ID NO: 7087 - protein, 11 aa, Artificial Sequence
  anti-influenza_CDR
RASQNIYKYLN

SEQ ID NO: 7088 - protein, 11 aa, Artificial Sequence
  anti-influenza_CDR
ASCSGGYCILD

SEQ ID NO: 7089 - protein, 11 aa, Artificial Sequence
  anti-influenza_CDR
RTSQSISSYLN

SEQ ID NO: 7090 - protein, 11 aa, Artificial Sequence
  anti-influenza_CDR
RASQSIGAYVN

SEQ ID NO: 7091 - protein, 11 aa, Artificial Sequence
  anti-influenza_CDR
RASQSISTYLN

SEQ ID NO: 7092 - protein, 11 aa, Artificial Sequence
  anti-influenza_CDR
RASQSIDKFLN

SEQ ID NO: 7093 - protein, 11 aa, Artificial Sequence
  anti-influenza_CDR
GGHNIGSNSVH

SEQ ID NO: 7094 - protein, 11 aa, Artificial Sequence
  anti-influenza_CDR
RASQSISTYLH

SEQ ID NO: 7095 - protein, 11 aa, Artificial Sequence
  anti-influenza_CDR
HVGGHTYGIDY

SEQ ID NO: 7096 - protein, 11 aa, Artificial Sequence
  anti-influenza_CDR
RASQSISNYLN

SEQ ID NO: 7097 - protein, 11 aa, Artificial Sequence
  anti-influenza_CDR
HDDASHGYSIS

SEQ ID NO: 7098 - protein, 11 aa, Artificial Sequence
  anti-influenza_CDR
RASQTISTYLN

SEQ ID NO: 7099 - protein, 11 aa, Artificial Sequence
  anti-influenza_CDR
RASQSISRYLN

SEQ ID NO: 7100 - protein, 11 aa, Artificial Sequence
  anti-influenza_CDR
GTWDSSLSAYV

SEQ ID NO: 7101 - protein, 11 aa, Artificial Sequence
  anti-influenza_CDR
SSNYYDSVYDY

SEQ ID NO: 7102 - protein, 11 aa, Artificial Sequence
  anti-influenza_CDR
AAWDDILNVPV

SEQ ID NO: 7103 - protein, 11 aa, Artificial Sequence
  anti-influenza_CDR
VAWDDSVDGYV

SEQ ID NO: 7104 - protein, 11 aa, Artificial Sequence
  anti-influenza_CDR
GPKYYSEYMDV

SEQ ID NO: 7105 - protein, 11 aa, Artificial Sequence
  anti-influenza_CDR
RASQGISSYLA

SEQ ID NO: 7106 - protein, 11 aa, Artificial Sequence
  anti-influenza_CDR
SSGYYPEYFQD

SEQ ID NO: 7107 - protein, 11 aa, Artificial Sequence
  anti-influenza_CDR
SGHKLGDKYVS

SEQ ID NO: 7108 - protein, 11 aa, Artificial Sequence
  anti-influenza_CDR
STGYYPAYLHH

SEQ ID NO: 7109 - protein, 11 aa, Artificial Sequence
  anti-influenza_CDR
RASQRVSSYLA

SEQ ID NO: 7110 - protein, 11 aa, Artificial Sequence
  anti-influenza_CDR
GGNNIGSKSVH

SEQ ID NO: 7111 - protein, 11 aa, Artificial Sequence
  anti-influenza_CDR
QVWDSSSDHAV

SEQ ID NO: 7112 - protein, 11 aa, Artificial Sequence
  anti-influenza_CDR
ATWDDNLSGPV

SEQ ID NO: 7113 - protein, 11 aa, Artificial Sequence
  anti-influenza_CDR
SSGYYPAYLPH

SEQ ID NO: 7114 - protein, 11 aa, Artificial Sequence
  anti-influenza_CDR
GGNNIGSKGVH

SEQ ID NO: 7115 - protein, 11 aa, Artificial Sequence
  anti-influenza_CDR
QVWDSSSDHVV

SEQ ID NO: 7116 - protein, 11 aa, Artificial Sequence
  anti-influenza_CDR
GNYYYESSLDY

SEQ ID NO: 7117 - protein, 11 aa, Artificial Sequence
  anti-influenza_CDR
GPHYYSSYMDV

SEQ ID NO: 7118 - protein, 11 aa, Artificial Sequence
  anti-influenza_CDR
RASQGISTYLA

SEQ ID NO: 7119 - protein, 11 aa, Artificial Sequence
  anti-influenza_CDR
GPTYYYSYMDV

SEQ ID NO: 7120 - protein, 11 aa, Artificial Sequence
  anti-influenza_CDR
GGNNIGRNSVH

SEQ ID NO: 7121 - protein, 11 aa, Artificial Sequence
  anti-influenza_CDR
QVWHSSSDHYV

SEQ ID NO: 7122 - protein, 11 aa, Artificial Sequence
  anti-influenza_CDR
SSGYYPQYFQD

SEQ ID NO: 7123 - protein, 11 aa, Artificial Sequence
  anti-influenza_CDR
RASQSVSRYLA

SEQ ID NO: 7124 - protein, 11 aa, Artificial Sequence
  anti-influenza_CDR
WGQGTTLTVSS

SEQ ID NO: 7125 - protein, 11 aa, Artificial Sequence
  anti-influenza_CDR
RASQSVDSNLA

SEQ ID NO: 7126 - protein, 11 aa, Artificial Sequence
  anti-influenza_CDR
RASQSVSHNLA

SEQ ID NO: 7127 - protein, 11 aa, Artificial Sequence
  anti-influenza_CDR
RASQSVSSNLA

SEQ ID NO: 7128 - protein, 11 aa, Artificial Sequence
  anti-influenza_CDR
RASQSVDHNLA

SEQ ID NO: 7129 - protein, 11 aa, Artificial Sequence
  anti-influenza_CDR
QHYTNWPPRLT

SEQ ID NO: 7130 - protein, 11 aa, Artificial Sequence
  anti-influenza_CDR
QHYTNYPPRLT

SEQ ID NO: 7131 - protein, 11 aa, Artificial Sequence
  anti-influenza_CDR
QHYTNFPPRLT

SEQ ID NO: 7132 - protein, 11 aa, Artificial Sequence
  anti-influenza_CDR
RASQVISHNLA

SEQ ID NO: 7133 - protein, 11 aa, Artificial Sequence
  anti-influenza_CDR
QHYSNWPPRLT

SEQ ID NO: 7134 - protein, 11 aa, Artificial Sequence
  anti-influenza_CDR
QHYSNFPPRLT

SEQ ID NO: 7135 - protein, 11 aa, Artificial Sequence
  anti-influenza_CDR
QHYSNYPPRLT

SEQ ID NO: 7136 - protein, 11 aa, Artificial Sequence
  anti-influenza_CDR
RASQSVANNLA

SEQ ID NO: 7137 - protein, 11 aa, Artificial Sequence
  anti-influenza_CDR
QQYNNWPPMYT

SEQ ID NO: 7138 - protein, 11 aa, Artificial Sequence
  anti-influenza_CDR
RASQSIGNWLA

SEQ ID NO: 7139 - protein, 11 aa, Artificial Sequence
  anti-influenza_CDR
QRYTSNSQGFT

SEQ ID NO: 7140 - protein, 11 aa, Artificial Sequence
  anti-influenza_CDR
AAWDDTLNGPV

SEQ ID NO: 7141 - protein, 11 aa, Artificial Sequence
  anti-influenza_CDR
KASQNVGSNVA

SEQ ID NO: 7142 - protein, 11 aa, Artificial Sequence
  anti-influenza_CDR
QVWDMSSDRRV

SEQ ID NO: 7143 - protein, 11 aa, Artificial Sequence
  anti-influenza_CDR
QSLLHSNGYNY

SEQ ID NO: 7144 - protein, 11 aa, Artificial Sequence
  anti-influenza_CDR
TYLVGAVGFQH

SEQ ID NO: 7145 - protein, 11 aa, Artificial Sequence
  anti-influenza_CDR
AAWDDSLNGWV

SEQ ID NO: 7146 - protein, 11 aa, Artificial Sequence
  anti-influenza_CDR
QSLLDSNGYNY

SEQ ID NO: 7147 - protein, 11 aa, Artificial Sequence
  anti-influenza_CDR
MQALQTPPMYT

SEQ ID NO: 7148 - protein, 11 aa, Artificial Sequence
  anti-influenza_CDR
QSLLHSNGYNH

SEQ ID NO: 7149 - protein, 11 aa, Artificial Sequence
  anti-influenza_CDR
QVWDITSDLVV

SEQ ID NO: 7150 - protein, 11 aa, Artificial Sequence
  anti-influenza_CDR
RASQDISTWLA

SEQ ID NO: 7151 - protein, 11 aa, Artificial Sequence
  anti-influenza_CDR
RASRSITTFLA

SEQ ID NO: 7152 - protein, 11 aa, Artificial Sequence
  anti-influenza_CDR
GWGAVTSPFDF

SEQ ID NO: 7153 - protein, 11 aa, Artificial Sequence
  anti-influenza_CDR
RASQSVSSSYL

SEQ ID NO: 7154 - protein, 12 aa, Artificial Sequence
  anti-influenza_CDR
QSVLYSSNNKNY

SEQ ID NO: 7155 - protein, 12 aa, Artificial Sequence
  anti-influenza_CDR
AAWDDSLSGSWV

SEQ ID NO: 7156 - protein, 12 aa, Artificial Sequence
  anti-influenza_CDR
VFYSADRTSYAD

SEQ ID NO: 7157 - protein, 12 aa, Artificial Sequence
  anti-influenza_CDR
RVGQSVSGSHLA

SEQ ID NO: 7158 - protein, 12 aa, Artificial Sequence
  anti-influenza_CDR
TLSSAYSNYKVD

SEQ ID NO: 7159 - protein, 12 aa, Artificial Sequence
  anti-influenza_CDR
VGTGGIVGSKGD

SEQ ID NO: 7160 - protein, 12 aa, Artificial Sequence
  anti-influenza_CDR
RYSRSSPGTFES

SEQ ID NO: 7161 - protein, 12 aa, Artificial Sequence
  anti-influenza_CDR
QSYDSSLSGFHV

SEQ ID NO: 7162 - protein, 12 aa, Artificial Sequence
  anti-influenza_CDR
RASQSVSSSQLA

SEQ ID NO: 7163 - protein, 12 aa, Artificial Sequence
  anti-influenza_CDR
RASQFVSTRSLA

SEQ ID NO: 7164 - protein, 12 aa, Artificial Sequence
  anti-influenza_CDR
ATWDDSLNGFYV

SEQ ID NO: 7165 - protein, 12 aa, Artificial Sequence
  anti-influenza_CDR
RASHFVNYRSLA

SEQ ID NO: 7166 - protein, 12 aa, Artificial Sequence
  anti-influenza_CDR
RASHFVIGRAVA

SEQ ID NO: 7167 - protein, 12 aa, Artificial Sequence
  anti-influenza_CDR
RIYHGGNSGFDF

SEQ ID NO: 7168 - protein, 12 aa, Artificial Sequence
  anti-influenza_CDR
TLSSGFDNYQVA

SEQ ID NO: 7169 - protein, 12 aa, Artificial Sequence
  anti-influenza_CDR
VGNGGNVASKGD

SEQ ID NO: 7170 - protein, 12 aa, Artificial Sequence
  anti-influenza_CDR
VRGGSTVAYFGV

SEQ ID NO: 7171 - protein, 12 aa, Artificial Sequence
  anti-influenza_CDR
CLSRMRGYGLDV

SEQ ID NO: 7172 - protein, 12 aa, Artificial Sequence
  anti-influenza_CDR
VGQMDKYYAMDV

SEQ ID NO: 7173 - protein, 12 aa, Artificial Sequence
  anti-influenza_CDR
GVTNKVNSIIDK

SEQ ID NO: 7174 - protein, 12 aa, Artificial Sequence
  anti-influenza_CDR
GVTNKVNRIIDK

SEQ ID NO: 7175 - protein, 12 aa, Artificial Sequence
  anti-influenza_CDR
GVTNKENSIIDK

SEQ ID NO: 7176 - protein, 12 aa, Artificial Sequence
  anti-influenza_CDR
PLGILHYYAMDL

SEQ ID NO: 7177 - protein, 12 aa, Artificial Sequence
  anti-influenza_CDR
KITSKVNNIVDK

SEQ ID NO: 7178 - protein, 12 aa, Artificial Sequence
  anti-influenza_CDR
GITNKVNSIIDK

SEQ ID NO: 7179 - protein, 12 aa, Artificial Sequence
  anti-influenza_CDR
NGRSSTSWGIDV

SEQ ID NO: 7180 - protein, 12 aa, Artificial Sequence
  anti-influenza_CDR
GITNKENSVIEK

SEQ ID NO: 7181 - protein, 12 aa, Artificial Sequence
  anti-influenza_CDR
PLGSRYYYGMDV

SEQ ID NO: 7182 - protein, 12 aa, Artificial Sequence
  anti-influenza_CDR
GITNKVNSVIEK

SEQ ID NO: 7183 - protein, 12 aa, Artificial Sequence
  anti-influenza_CDR
GVTNKVNSIINK

SEQ ID NO: 7184 - protein, 12 aa, Artificial Sequence
  anti-influenza_CDR
HMGYQVRETMDV

SEQ ID NO: 7185 - protein, 12 aa, Artificial Sequence
  anti-influenza_CDR
ATWDRRPTAYVV

SEQ ID NO: 7186 - protein, 12 aa, Artificial Sequence
  anti-influenza_CDR
EGKWGPQAAFDI

SEQ ID NO: 7187 - protein, 12 aa, Artificial Sequence
  anti-influenza_CDR
GDKGIYYYYMDV

SEQ ID NO: 7188 - protein, 12 aa, Artificial Sequence
  anti-influenza_CDR
GSGYHISTPFDN

SEQ ID NO: 7189 - protein, 12 aa, Artificial Sequence
  anti-influenza_CDR
RASQSVSSSYLA

SEQ ID NO: 7190 - protein, 12 aa, Artificial Sequence
  anti-influenza_CDR
GSGYTTRNYFDY

SEQ ID NO: 7191 - protein, 12 aa, Artificial Sequence
  anti-influenza_CDR
RASQSVSSNYLG

SEQ ID NO: 7192 - protein, 12 aa, Artificial Sequence
  anti-influenza_CDR
GSTYDFSSGLDY

SEQ ID NO: 7193 - protein, 12 aa, Artificial Sequence
  anti-influenza_CDR
GVHHPGTDNDQI

SEQ ID NO: 7194 - protein, 12 aa, Artificial Sequence
  anti-influenza_CDR
GVHHPSTDSDQT

SEQ ID NO: 7195 - protein, 12 aa, Artificial Sequence
  anti-influenza_CDR
GVHHPSNETEQR

SEQ ID NO: 7196 - protein, 12 aa, Artificial Sequence
  anti-influenza_CDR
QSITFDYKNYLA

SEQ ID NO: 7197 - protein, 12 aa, Artificial Sequence
  anti-influenza_CDR
GGLIGTGSYYWG

SEQ ID NO: 7198 - protein, 12 aa, Artificial Sequence
  anti-influenza_CDR
ARYNWGIRYFDF

SEQ ID NO: 7199 - protein, 12 aa, Artificial Sequence
  anti-influenza_CDR
QSVLSNSKNLNY

SEQ ID NO: 7200 - protein, 12 aa, Artificial Sequence
  anti-influenza_CDR
CQVWETSEDLWV

SEQ ID NO: 7201 - protein, 13 aa, Artificial Sequence
  anti-influenza_CDR
ARGGRYYVDYFDY

SEQ ID NO: 7202 - protein, 13 aa, Artificial Sequence
  anti-influenza_CDR
ARSGDGYNYYFPL

SEQ ID NO: 7203 - protein, 13 aa, Artificial Sequence
  anti-influenza_CDR
ARGCGYNCYYFDG

SEQ ID NO: 7204 - protein, 13 aa, Artificial Sequence
  anti-influenza_CDR
SGSSSNIGSNTVN

SEQ ID NO: 7205 - protein, 13 aa, Artificial Sequence
  anti-influenza_CDR
DSPYSSSWSFFDY

SEQ ID NO: 7206 - protein, 13 aa, Artificial Sequence
  anti-influenza_CDR
SGSDSNIGDYFVC

SEQ ID NO: 7207 - protein, 13 aa, Artificial Sequence
  anti-influenza_CDR
ARMVVVTGDGFDV

SEQ ID NO: 7208 - protein, 13 aa, Artificial Sequence
  anti-influenza_CDR
WLSIINAGGGDID

SEQ ID NO: 7209 - protein, 13 aa, Artificial Sequence
  anti-influenza_CDR
AASSLQSGVPSRF

SEQ ID NO: 7210 - protein, 13 aa, Artificial Sequence
  anti-influenza_CDR
HDAKFSGSYYVAS

SEQ ID NO: 7211 - protein, 13 aa, Artificial Sequence
  anti-influenza_CDR
HDVKFSGSYYVAS

SEQ ID NO: 7212 - protein, 13 aa, Artificial Sequence
  anti-influenza_CDR
TGSESTTGYGMDV

SEQ ID NO: 7213 - protein, 13 aa, Artificial Sequence
  anti-influenza_CDR
AASTSVLGYGMDV

SEQ ID NO: 7214 - protein, 13 aa, Artificial Sequence
  anti-influenza_CDR
SGSTFNIGSNAVD

SEQ ID NO: 7215 - protein, 13 aa, Artificial Sequence
  anti-influenza_CDR
SGSRSNVGDNSVY

SEQ ID NO: 7216 - protein, 13 aa, Artificial Sequence
  anti-influenza_CDR
SGSSSNIGNDYVS

SEQ ID NO: 7217 - protein, 13 aa, Artificial Sequence
  anti-influenza_CDR
GGGSYGAYEGFDY

SEQ ID NO: 7218 - protein, 13 aa, Artificial Sequence
  anti-influenza_CDR
SGSSSNIGSNYVY

SEQ ID NO: 7219 - protein, 13 aa, Artificial Sequence
  anti-influenza_CDR
ARRQQLYKGYYHH

SEQ ID NO: 7220 - protein, 13 aa, Artificial Sequence
  anti-influenza_CDR
SGSTSNIGYNPVS

SEQ ID NO: 7221 - protein, 13 aa, Artificial Sequence
  anti-influenza_CDR
ARGMNYYSDYFDY

SEQ ID NO: 7222 - protein, 13 aa, Artificial Sequence
  anti-influenza_CDR
ARGHSGSYRLFDF

SEQ ID NO: 7223 - protein, 13 aa, Artificial Sequence
  anti-influenza_CDR
AKPLRGSYRYFDL

SEQ ID NO: 7224 - protein, 13 aa, Artificial Sequence
  anti-influenza_CDR
PIWVKTPLKLANG

SEQ ID NO: 7225 - protein, 13 aa, Artificial Sequence
  anti-influenza_CDR
QASQSVYNKNNLA

SEQ ID NO: 7226 - protein, 13 aa, Artificial Sequence
  anti-influenza_CDR
QSSESVYKNNNLA

SEQ ID NO: 7227 - protein, 13 aa, Artificial Sequence
  anti-influenza_CDR
QSSQSVDSNNQLS

SEQ ID NO: 7228 - protein, 13 aa, Artificial Sequence
  anti-influenza_CDR
QSSQSVDNNKDLA

SEQ ID NO: 7229 - protein, 13 aa, Artificial Sequence
  anti-influenza_CDR
QSSQSVYNNNRLS

SEQ ID NO: 7230 - protein, 13 aa, Artificial Sequence
  anti-influenza_CDR
QSSQSVYKNNNLA

SEQ ID NO: 7231 - protein, 13 aa, Artificial Sequence
  anti-influenza_CDR
GGGFGWSQTYFGY

SEQ ID NO: 7232 - protein, 14 aa, Artificial Sequence
  anti-influenza_CDR
WLGRTYYRSKWYND

SEQ ID NO: 7233 - protein, 14 aa, Artificial Sequence
  anti-influenza_CDR
GGLVGGYDEYFFDY

SEQ ID NO: 7234 - protein, 14 aa, Artificial Sequence
  anti-influenza_CDR
HPKYFYGSGSYPDF

SEQ ID NO: 7235 - protein, 14 aa, Artificial Sequence
  anti-influenza_CDR
TGSSSDVGASNSVS

SEQ ID NO: 7236 - protein, 14 aa, Artificial Sequence
  anti-influenza_CDR
GAYYDSSGYPAFYI

SEQ ID NO: 7237 - protein, 14 aa, Artificial Sequence
  anti-influenza_CDR
TGSSSNIGSDYDVH

SEQ ID NO: 7238 - protein, 14 aa, Artificial Sequence
  anti-influenza_CDR
EFETSGYFHGSFDY

SEQ ID NO: 7239 - protein, 14 aa, Artificial Sequence
  anti-influenza_CDR
ASSTGAVTSSYFPN

SEQ ID NO: 7240 - protein, 14 aa, Artificial Sequence
  anti-influenza_CDR
TGGSSDIGASNSVS

SEQ ID NO: 7241 - protein, 14 aa, Artificial Sequence
  anti-influenza_CDR
TGSSSDVGGYDYVS

SEQ ID NO: 7242 - protein, 14 aa, Artificial Sequence
  anti-influenza_CDR
GSSTGAVTRGHYPY

SEQ ID NO: 7243 - protein, 14 aa, Artificial Sequence
  anti-influenza_CDR
GSSTGPVTSGHYPY

SEQ ID NO: 7244 - protein, 14 aa, Artificial Sequence
  anti-influenza_CDR
HYGDSEAINDAFDI

SEQ ID NO: 7245 - protein, 14 aa, Artificial Sequence
  anti-influenza_CDR
TGSSSNIGAGYDVH

SEQ ID NO: 7246 - protein, 14 aa, Artificial Sequence
  anti-influenza_CDR
IPHYNFGSGSYFDY

SEQ ID NO: 7247 - protein, 14 aa, Artificial Sequence
  anti-influenza_CDR
TGTSSDVGGYNYVS

SEQ ID NO: 7248 - protein, 14 aa, Artificial Sequence
  anti-influenza_CDR
TGTSSDVGAYNYVS

SEQ ID NO: 7249 - protein, 14 aa, Artificial Sequence
  anti-influenza_CDR
AERPKVRGQAGRMN

SEQ ID NO: 7250 - protein, 14 aa, Artificial Sequence
  anti-influenza_CDR
GSRPWVRGVSSRIS

SEQ ID NO: 7251 - protein, 14 aa, Artificial Sequence
  anti-influenza_CDR
IWGVAAPGTAAAQI

SEQ ID NO: 7252 - protein, 14 aa, Artificial Sequence
  anti-influenza_CDR
WVRQPPGKGLEWVA

SEQ ID NO: 7253 - protein, 14 aa, Artificial Sequence
  anti-influenza_CDR
ARGPEGVWGRSIDS

SEQ ID NO: 7254 - protein, 14 aa, Artificial Sequence
  anti-influenza_CDR
ARDPDTPFVRAFDS

SEQ ID NO: 7255 - protein, 14 aa, Artificial Sequence
  anti-influenza_CDR
TGSTSDIGSYNYVS

SEQ ID NO: 7256 - protein, 14 aa, Artificial Sequence
  anti-influenza_CDR
WDWNFDLYLGWFDP

SEQ ID NO: 7257 - protein, 14 aa, Artificial Sequence
  anti-influenza_CDR
WAWNFDFFLGWFDP

SEQ ID NO: 7258 - protein, 14 aa, Artificial Sequence
  anti-influenza_CDR
GPGYSGYHYGWFDT

SEQ ID NO: 7259 - protein, 14 aa, Artificial Sequence
  anti-influenza_CDR
ARWDYGVYEGYIDY

SEQ ID NO: 7260 - protein, 15 aa, Artificial Sequence
  anti-influenza_CDR
ARAGTTLTRFNWFDP

SEQ ID NO: 7261 - protein, 15 aa, Artificial Sequence
  anti-influenza_CDR
ARAGTTVTRFNWFDP

SEQ ID NO: 7262 - protein, 15 aa, Artificial Sequence
  anti-influenza_CDR
ARGQRYYYDRDGMDV

SEQ ID NO: 7263 - protein, 15 aa, Artificial Sequence
  anti-influenza_CDR
ARSGGYLPQNNWIDP

SEQ ID NO: 7264 - protein, 15 aa, Artificial Sequence
  anti-influenza_CDR
MENERTLDFHDSNVK

SEQ ID NO: 7265 - protein, 15 aa, Artificial Sequence
  anti-influenza_CDR
GADHGSGSNFVSPYV

SEQ ID NO: 7266 - protein, 15 aa, Artificial Sequence
  anti-influenza_CDR
DTRSSLDNYQYGMDV

SEQ ID NO: 7267 - protein, 15 aa, Artificial Sequence
  anti-influenza_CDR
EDYDILTGAGPGMEV

SEQ ID NO: 7268 - protein, 15 aa, Artificial Sequence
  anti-influenza_CDR
HPYDVLTGSGDWFDP

SEQ ID NO: 7269 - protein, 15 aa, Artificial Sequence
  anti-influenza_CDR
GADHGSGNNFVSPYV

SEQ ID NO: 7270 - protein, 15 aa, Artificial Sequence
  anti-influenza_CDR
VIYSGGSTYYADSVK

SEQ ID NO: 7271 - protein, 15 aa, Artificial Sequence
  anti-influenza_CDR
WYQQKPGKAPKLLIY

SEQ ID NO: 7272 - protein, 15 aa, Artificial Sequence
  anti-influenza_CDR
DPYNDGTKYNEKFEG

SEQ ID NO: 7273 - protein, 15 aa, Artificial Sequence
  anti-influenza_CDR
ARAHTALTRFRWLDP

SEQ ID NO: 7274 - protein, 15 aa, Artificial Sequence
  anti-influenza_CDR
ASLDYDFSYYYHRDV

SEQ ID NO: 7275 - protein, 15 aa, Artificial Sequence
  anti-influenza_CDR
ARVATPYYYESGFDY

SEQ ID NO: 7276 - protein, 15 aa, Artificial Sequence
  anti-influenza_CDR
ARRGGGWQYYYGMDV

SEQ ID NO: 7277 - protein, 16 aa, Artificial Sequence
  anti-influenza_CDR
SGHITVFGVNVDAFDM

SEQ ID NO: 7278 - protein, 16 aa, Artificial Sequence
  anti-influenza_CDR
GGHITVFGLNIDAYDI

SEQ ID NO: 7279 - protein, 16 aa, Artificial Sequence
  anti-influenza_CDR
GGHITEFGLNIDAYDI

SEQ ID NO: 7280 - protein, 16 aa, Artificial Sequence
  anti-influenza_CDR
GGHITVFGVNIDAFDI

SEQ ID NO: 7281 - protein, 16 aa, Artificial Sequence
  anti-influenza_CDR
GGHITVFGVNIDAFDV

SEQ ID NO: 7282 - protein, 16 aa, Artificial Sequence
  anti-influenza_CDR
ARDGWGQQLVPYYFDY

SEQ ID NO: 7283 - protein, 16 aa, Artificial Sequence
  anti-influenza_CDR
DFWVSYYYDSSAPPAI

SEQ ID NO: 7284 - protein, 16 aa, Artificial Sequence
  anti-influenza_CDR
ARAGVKIFGLIVGALD

SEQ ID NO: 7285 - protein, 16 aa, Artificial Sequence
  anti-influenza_CDR
ARDGAGSYYPLNWFDP

SEQ ID NO: 7286 - protein, 16 aa, Artificial Sequence
  anti-influenza_CDR
VIYSHGRAYYSASVNG

SEQ ID NO: 7287 - protein, 16 aa, Artificial Sequence
  anti-influenza_CDR
DTLHNGYTNYNPSLRG

SEQ ID NO: 7288 - protein, 16 aa, Artificial Sequence
  anti-influenza_CDR
YISYNGRPKYNPSLTS

SEQ ID NO: 7289 - protein, 16 aa, Artificial Sequence
  anti-influenza_CDR
ETRFGELLSPYDAFEI

SEQ ID NO: 7290 - protein, 16 aa, Artificial Sequence
  anti-influenza_CDR
LIYWDDDKRYSPSLKR

SEQ ID NO: 7291 - protein, 16 aa, Artificial Sequence
  anti-influenza_CDR
YIYYIGNTDYRPSLKS

SEQ ID NO: 7292 - protein, 16 aa, Artificial Sequence
  anti-influenza_CDR
EISHGGSTNYNPSLKS

SEQ ID NO: 7293 - protein, 16 aa, Artificial Sequence
  anti-influenza_CDR
EINHSGRTNYNPSLKS

SEQ ID NO: 7294 - protein, 16 aa, Artificial Sequence
  anti-influenza_CDR
LISWDDEKHYSPSLQS

SEQ ID NO: 7295 - protein, 16 aa, Artificial Sequence
  anti-influenza_CDR
EGVYFDSGTYRGYFDY

SEQ ID NO: 7296 - protein, 16 aa, Artificial Sequence
  anti-influenza_CDR
YIYHSGSTNYNPSLKS

SEQ ID NO: 7297 - protein, 16 aa, Artificial Sequence
  anti-influenza_CDR
YIYYRGSTFYNPSLKS

SEQ ID NO: 7298 - protein, 16 aa, Artificial Sequence
  anti-influenza_CDR
YISYSGSTKYNPSLRS

SEQ ID NO: 7299 - protein, 16 aa, Artificial Sequence
  anti-influenza_CDR
EIKHSGRTNYNPSLES

SEQ ID NO: 7300 - protein, 16 aa, Artificial Sequence
  anti-influenza_CDR
EINHSGGTNYNPSLKR

SEQ ID NO: 7301 - protein, 16 aa, Artificial Sequence
  anti-influenza_CDR
FMYYSASTYYNPSLKS

SEQ ID NO: 7302 - protein, 16 aa, Artificial Sequence
  anti-influenza_CDR
YVYYSGSTTYNPSLKS

SEQ ID NO: 7303 - protein, 16 aa, Artificial Sequence
  anti-influenza_CDR
NIYYTGITFYNPSLSS

SEQ ID NO: 7304 - protein, 16 aa, Artificial Sequence
  anti-influenza_CDR
FIYYGGNTKYNPSLKS

SEQ ID NO: 7305 - protein, 16 aa, Artificial Sequence
  anti-influenza_CDR
FMFHSGSPRYNPTLKS

SEQ ID NO: 7306 - protein, 16 aa, Artificial Sequence
  anti-influenza_CDR
FFYNGGSTKYNPSLKS

SEQ ID NO: 7307 - protein, 16 aa, Artificial Sequence
  anti-influenza_CDR
HIYDYGRTFYNSSLQS

SEQ ID NO: 7308 - protein, 16 aa, Artificial Sequence
  anti-influenza_CDR
VFYSETRTYYADSVKG

SEQ ID NO: 7309 - protein, 16 aa, Artificial Sequence
  anti-influenza_CDR
YVYNRGSTKYSPSLKS

SEQ ID NO: 7310 - protein, 16 aa, Artificial Sequence
  anti-influenza_CDR
YIYNRGSTKYTPSLKS

SEQ ID NO: 7311 - protein, 16 aa, Artificial Sequence
  anti-influenza_CDR
YLYYSGSTKYNPSLKS

SEQ ID NO: 7312 - protein, 16 aa, Artificial Sequence
  anti-influenza_CDR
YVYNSGNTKYNPSLKS

SEQ ID NO: 7313 - protein, 16 aa, Artificial Sequence
  anti-influenza_CDR
HIFDSGSTYYNPSLKS

SEQ ID NO: 7314 - protein, 16 aa, Artificial Sequence
  anti-influenza_CDR
VFYSADRTSYADSVKG

SEQ ID NO: 7315 - protein, 16 aa, Artificial Sequence
  anti-influenza_CDR
YIYYSGNTYYNPSLKS

SEQ ID NO: 7316 - protein, 16 aa, Artificial Sequence
  anti-influenza_CDR
RSSQSLLHSNGYNYLD

SEQ ID NO: 7317 - protein, 16 aa, Artificial Sequence
  anti-influenza_CDR
TIYHSGSTYYNPSLKS

SEQ ID NO: 7318 - protein, 16 aa, Artificial Sequence
  anti-influenza_CDR
RSSQSLLHSNGHIYFD

SEQ ID NO: 7319 - protein, 16 aa, Artificial Sequence
  anti-influenza_CDR
IWGVAAPSTASAQTSL

SEQ ID NO: 7320 - protein, 16 aa, Artificial Sequence
  anti-influenza_CDR
RSSQSLLYTDGFTYLS

SEQ ID NO: 7321 - protein, 16 aa, Artificial Sequence
  anti-influenza_CDR
AKPRLDYLDYFHAADS

SEQ ID NO: 7322 - protein, 16 aa, Artificial Sequence
  anti-influenza_CDR
ARSPGYSGYLYGWFDP

SEQ ID NO: 7323 - protein, 16 aa, Artificial Sequence
  anti-influenza_CDR
AIAGSGSADYASWAKG

SEQ ID NO: 7324 - protein, 16 aa, Artificial Sequence
  anti-influenza_CDR
AIAGSGSADYASWAKS

SEQ ID NO: 7325 - protein, 16 aa, Artificial Sequence
  anti-influenza_CDR
AIGGGGSADYASWAKS

SEQ ID NO: 7326 - protein, 16 aa, Artificial Sequence
  anti-influenza_CDR
RSSQSLLRSNGYNYLD

SEQ ID NO: 7327 - protein, 16 aa, Artificial Sequence
  anti-influenza_CDR
QGDHIAWLLRGINFDY

SEQ ID NO: 7328 - protein, 17 aa, Artificial Sequence
  anti-influenza_CDR
ARLGSGSYHNGPNWFDP

SEQ ID NO: 7329 - protein, 17 aa, Artificial Sequence
  anti-influenza_CDR
ARAENLLSPYLAEGFDP

SEQ ID NO: 7330 - protein, 17 aa, Artificial Sequence
  anti-influenza_CDR
VISYDGSNKYYADSVKG

SEQ ID NO: 7331 - protein, 17 aa, Artificial Sequence
  anti-influenza_CDR
GTIPLLGTTNYAQKFQG

SEQ ID NO: 7332 - protein, 17 aa, Artificial Sequence
  anti-influenza_CDR
GIIAVFNTANYAQKFQG

SEQ ID NO: 7333 - protein, 17 aa, Artificial Sequence
  anti-influenza_CDR
NIEDDGGDKYYVDSVKG

SEQ ID NO: 7334 - protein, 17 aa, Artificial Sequence
  anti-influenza_CDR
WINPNSGTTGSAQRFQG

SEQ ID NO: 7335 - protein, 17 aa, Artificial Sequence
  anti-influenza_CDR
GINPVFGRPHYAQKFQG

SEQ ID NO: 7336 - protein, 17 aa, Artificial Sequence
  anti-influenza_CDR
GIIPLINAPNYAPKFQG

SEQ ID NO: 7337 - protein, 17 aa, Artificial Sequence
  anti-influenza_CDR
GIIPMMGTVNYAQKLQG

SEQ ID NO: 7338 - protein, 17 aa, Artificial Sequence
  anti-influenza_CDR
GIIPLFGAAKYAQKFQG

SEQ ID NO: 7339 - protein, 17 aa, Artificial Sequence
  anti-influenza_CDR
KSSQRVLYSSNNKNYLA

SEQ ID NO: 7340 - protein, 17 aa, Artificial Sequence
  anti-influenza_CDR
LISDDGSNKFYADSVKG

SEQ ID NO: 7341 - protein, 17 aa, Artificial Sequence
  anti-influenza_CDR
IISYDGNDQYYTDSVKG

SEQ ID NO: 7342 - protein, 17 aa, Artificial Sequence
  anti-influenza_CDR
WISTYNGNTNFAQNFQG

SEQ ID NO: 7343 - protein, 17 aa, Artificial Sequence
  anti-influenza_CDR
VEGSYRDFWNNQNRFDP

SEQ ID NO: 7344 - protein, 17 aa, Artificial Sequence
  anti-influenza_CDR
WINPNSGDTNYAQKFQG

SEQ ID NO: 7345 - protein, 17 aa, Artificial Sequence
  anti-influenza_CDR
KSSQSVLYSSNNKSHLA

SEQ ID NO: 7346 - protein, 17 aa, Artificial Sequence
  anti-influenza_CDR
IIYPGDSDTRYSPSFQG

SEQ ID NO: 7347 - protein, 17 aa, Artificial Sequence
  anti-influenza_CDR
GIIPVFPTPNYAQMFQG

SEQ ID NO: 7348 - protein, 17 aa, Artificial Sequence
  anti-influenza_CDR
GIVPVFGTANYAQKFQG

SEQ ID NO: 7349 - protein, 17 aa, Artificial Sequence
  anti-influenza_CDR
WINPESGDTKYAQKFQG

SEQ ID NO: 7350 - protein, 17 aa, Artificial Sequence
  anti-influenza_CDR
RSSQSIFHNSNNENYLA

SEQ ID NO: 7351 - protein, 17 aa, Artificial Sequence
  anti-influenza_CDR
WINAKRGGTNYAQKFQG

SEQ ID NO: 7352 - protein, 17 aa, Artificial Sequence
  anti-influenza_CDR
WINPDSGATSSAQNFQG

SEQ ID NO: 7353 - protein, 17 aa, Artificial Sequence
  anti-influenza_CDR
WISPDSDATKYAQKFQG

SEQ ID NO: 7354 - protein, 17 aa, Artificial Sequence
  anti-influenza_CDR
NIKQDGREKYYVDSLRG

SEQ ID NO: 7355 - protein, 17 aa, Artificial Sequence
  anti-influenza_CDR
GIIAIFGTPKYAQKFQG

SEQ ID NO: 7356 - protein, 17 aa, Artificial Sequence
  anti-influenza_CDR
KSSQSILNSSNNKNYLA

SEQ ID NO: 7357 - protein, 17 aa, Artificial Sequence
  anti-influenza_CDR
WISAYNGNTNYAQKFQG

SEQ ID NO: 7358 - protein, 17 aa, Artificial Sequence
  anti-influenza_CDR
GVIPIFRTANYAQNFQG

SEQ ID NO: 7359 - protein, 17 aa, Artificial Sequence
  anti-influenza_CDR
GIIAIFHTPKYAQKFQG

SEQ ID NO: 7360 - protein, 17 aa, Artificial Sequence
  anti-influenza_CDR
GISPMFGTTTYAQKFQG

SEQ ID NO: 7361 - protein, 17 aa, Artificial Sequence
  anti-influenza_CDR
KSSQSVLYSSNNKNYLA

SEQ ID NO: 7362 - protein, 17 aa, Artificial Sequence
  anti-influenza_CDR
GIIPIFGTTKYAPKFQG

SEQ ID NO: 7363 - protein, 17 aa, Artificial Sequence
  anti-influenza_CDR
GISPLFGTTNYAQKFQG

SEQ ID NO: 7364 - protein, 17 aa, Artificial Sequence
  anti-influenza_CDR
GIMGMFGTTNYAQKFQG

SEQ ID NO: 7365 - protein, 17 aa, Artificial Sequence
  anti-influenza_CDR
GIIGMFGSTNYAQNFQG

SEQ ID NO: 7366 - protein, 17 aa, Artificial Sequence
  anti-influenza_CDR
WINPNSGGTNYAQKFQG

SEQ ID NO: 7367 - protein, 17 aa, Artificial Sequence
  anti-influenza_CDR
AISSSGDSTYYADSVKG

SEQ ID NO: 7368 - protein, 17 aa, Artificial Sequence
  anti-influenza_CDR
SISSSSSYIYYVDSVKG

SEQ ID NO: 7369 - protein, 17 aa, Artificial Sequence
  anti-influenza_CDR
DIIGMFGSTNYAQNFQG

SEQ ID NO: 7370 - protein, 17 aa, Artificial Sequence
  anti-influenza_CDR
GIIPMFGTTNYAQKFQG

SEQ ID NO: 7371 - protein, 17 aa, Artificial Sequence
  anti-influenza_CDR
GIIAIFGTANYAQKFQG

SEQ ID NO: 7372 - protein, 17 aa, Artificial Sequence
  anti-influenza_CDR
GIIPIFGTTNYAQKFQG

SEQ ID NO: 7373 - protein, 17 aa, Artificial Sequence
  anti-influenza_CDR
GIFALFGTTDYAQKFQG

SEQ ID NO: 7374 - protein, 17 aa, Artificial Sequence
  anti-influenza_CDR
GIIGMFGTANYAQKFQG

SEQ ID NO: 7375 - protein, 17 aa, Artificial Sequence
  anti-influenza_CDR
GIIAVFGTTKYAHKFQG

SEQ ID NO: 7376 - protein, 17 aa, Artificial Sequence
  anti-influenza_CDR
GILGVFGSPSYAQKFQG

SEQ ID NO: 7377 - protein, 17 aa, Artificial Sequence
  anti-influenza_CDR
GIFGMFGTANYAQKFQG

SEQ ID NO: 7378 - protein, 17 aa, Artificial Sequence
  anti-influenza_CDR
WISAYTGDTDYAQKFQG

SEQ ID NO: 7379 - protein, 17 aa, Artificial Sequence
  anti-influenza_CDR
SFDPEDGETIYAQKFQG

SEQ ID NO: 7380 - protein, 17 aa, Artificial Sequence
  anti-influenza_CDR
GISGSGESTYYADSVKG

SEQ ID NO: 7381 - protein, 17 aa, Artificial Sequence
  anti-influenza_CDR
VVSYDGNYKYYADSVQG

SEQ ID NO: 7382 - protein, 17 aa, Artificial Sequence
  anti-influenza_CDR
GSISYSGSTYYHPSLKS

SEQ ID NO: 7383 - protein, 17 aa, Artificial Sequence
  anti-influenza_CDR
TRGRPIGRNWEPRDKDY

SEQ ID NO: 7384 - protein, 17 aa, Artificial Sequence
  anti-influenza_CDR
AREAGYHSSFSGVYFDY

SEQ ID NO: 7385 - protein, 17 aa, Artificial Sequence
  anti-influenza_CDR
RIDPNGSGTTYAQKFQG

SEQ ID NO: 7386 - protein, 17 aa, Artificial Sequence
  anti-influenza_CDR
RIDPNGAGTTYAQKFQG

SEQ ID NO: 7387 - protein, 17 aa, Artificial Sequence
  anti-influenza_CDR
WIDPNNDGTIYAQKFQG

SEQ ID NO: 7388 - protein, 17 aa, Artificial Sequence
  anti-influenza_CDR
MMYPGDSDTIYSPSFQG

SEQ ID NO: 7389 - protein, 17 aa, Artificial Sequence
  anti-influenza_CDR
MMYPGDADAIYSPSFQG

SEQ ID NO: 7390 - protein, 17 aa, Artificial Sequence
  anti-influenza_CDR
MMYPGESETIYSPSFQG

SEQ ID NO: 7391 - protein, 17 aa, Artificial Sequence
  anti-influenza_CDR
MMYPGDADTIYSPSFQG

SEQ ID NO: 7392 - protein, 17 aa, Artificial Sequence
  anti-influenza_CDR
MMYPGSSDTIYSPSFQG

SEQ ID NO: 7393 - protein, 17 aa, Artificial Sequence
  anti-influenza_CDR
MMYPGDSDAIYSPSFQG

SEQ ID NO: 7394 - protein, 17 aa, Artificial Sequence
  anti-influenza_CDR
MMYPGDTDTIYSPSFQG

SEQ ID NO: 7395 - protein, 17 aa, Artificial Sequence
  anti-influenza_CDR
MMYPGESDTIYSPSFQG

SEQ ID NO: 7396 - protein, 17 aa, Artificial Sequence
  anti-influenza_CDR
VISWDSGRIGYADSVKG

SEQ ID NO: 7397 - protein, 17 aa, Artificial Sequence
  anti-influenza_CDR
VRSGAYYFNYLVPYFDY

SEQ ID NO: 7398 - protein, 17 aa, Artificial Sequence
  anti-influenza_CDR
VRSGAYYVNYLVPYFDY

SEQ ID NO: 7399 - protein, 17 aa, Artificial Sequence
  anti-influenza_CDR
IISWDSGRIGYADSVRG

SEQ ID NO: 7400 - protein, 17 aa, Artificial Sequence
  anti-influenza_CDR
HGGVYYYGSASSGWFDP

SEQ ID NO: 7401 - protein, 18 aa, Artificial Sequence
  anti-influenza_CDR
RTYYRSKWYNDYAESVKS

SEQ ID NO: 7402 - protein, 18 aa, Artificial Sequence
  anti-influenza_CDR
RTYYRSKWYYDYAESVKS

SEQ ID NO: 7403 - protein, 18 aa, Artificial Sequence
  anti-influenza_CDR
RTYYRSKWYNDYAVSVKS

SEQ ID NO: 7404 - protein, 18 aa, Artificial Sequence
  anti-influenza_CDR
RTYYRSKWYNDYADFLKR

SEQ ID NO: 7405 - protein, 18 aa, Artificial Sequence
  anti-influenza_CDR
RTYYRSGWYNDYAESVKS

SEQ ID NO: 7406 - protein, 18 aa, Artificial Sequence
  anti-influenza_CDR
ARLGGNKDYGDYLWYFDL

SEQ ID NO: 7407 - protein, 18 aa, Artificial Sequence
  anti-influenza_CDR
AKDTADHGDYVDLGFFDA

SEQ ID NO: 7408 - protein, 18 aa, Artificial Sequence
  anti-influenza_CDR
ARSGIFDWSAPLVEAFDI

SEQ ID NO: 7409 - protein, 18 aa, Artificial Sequence
  anti-influenza_CDR
ARHASCSARSCYWGPVDY

SEQ ID NO: 7410 - protein, 18 aa, Artificial Sequence
  anti-influenza_CDR
DAPPNVEVASMTNWYFDL

SEQ ID NO: 7411 - protein, 18 aa, Artificial Sequence
  anti-influenza_CDR
LRTDYGDPDSVYYYGMDV

SEQ ID NO: 7412 - protein, 18 aa, Artificial Sequence
  anti-influenza_CDR
GTCAGDCSLHYYYYGLDV

SEQ ID NO: 7413 - protein, 18 aa, Artificial Sequence
  anti-influenza_CDR
HVSVSHGGRTKSNPSVMS

SEQ ID NO: 7414 - protein, 18 aa, Artificial Sequence
  anti-influenza_CDR
ALIYFDGSKQYYADSVKG

SEQ ID NO: 7415 - protein, 18 aa, Artificial Sequence
  anti-influenza_CDR
TLISYDGANQYYADSVKG

SEQ ID NO: 7416 - protein, 18 aa, Artificial Sequence
  anti-influenza_CDR
AVPGPVFGIFPPWSYFDN

SEQ ID NO: 7417 - protein, 18 aa, Artificial Sequence
  anti-influenza_CDR
GGIIPIFGAANYAQKFQG

SEQ ID NO: 7418 - protein, 18 aa, Artificial Sequence
  anti-influenza_CDR
GWISAYTGNTHYAKNFEG

SEQ ID NO: 7419 - protein, 18 aa, Artificial Sequence
  anti-influenza_CDR
GWINPNFGGTHYARKFQG

SEQ ID NO: 7420 - protein, 18 aa, Artificial Sequence
  anti-influenza_CDR
VRWRAAAVIMDQFYKMDV

SEQ ID NO: 7421 - protein, 18 aa, Artificial Sequence
  anti-influenza_CDR
AVPGPIFGIFPPWSYFDH

SEQ ID NO: 7422 - protein, 18 aa, Artificial Sequence
  anti-influenza_CDR
AASTATSGTYYAMRPFDF

SEQ ID NO: 7423 - protein, 19 aa, Artificial Sequence
  anti-influenza_CDR
ARGKRPGYCSGGVCSSDYW

SEQ ID NO: 7424 - protein, 19 aa, Artificial Sequence
  anti-influenza_CDR
ARHYPYYDLPTGFYSQFDF

SEQ ID NO: 7425 - protein, 19 aa, Artificial Sequence
  anti-influenza_CDR
GSGGYGGFDYFGKLRTWDF

SEQ ID NO: 7426 - protein, 19 aa, Artificial Sequence
  anti-influenza_CDR
FIRTRPWGGTADTAASVKG

SEQ ID NO: 7427 - protein, 19 aa, Artificial Sequence
  anti-influenza_CDR
LNYHDSGTYYNAPRGWFDP

SEQ ID NO: 7428 - protein, 19 aa, Artificial Sequence
  anti-influenza_CDR
VKDGYCTLTSCPVGWYFDL

SEQ ID NO: 7429 - protein, 19 aa, Artificial Sequence
  anti-influenza_CDR
AVPGPIFGIFPPWSYFDHW

SEQ ID NO: 7430 - protein, 19 aa, Artificial Sequence
  anti-influenza_CDR
ARAMIQGVVTLYLRPGDYW

SEQ ID NO: 7431 - protein, 19 aa, Artificial Sequence
  anti-influenza_CDR
AKVGPYTGYDDYNYYGMDV

SEQ ID NO: 7432 - protein, 19 aa, Artificial Sequence
  anti-influenza_CDR
AKVERSFYDGSGYGDALEI

SEQ ID NO: 7433 - protein, 19 aa, Artificial Sequence
  anti-influenza_CDR
YCARGRVNSGYDWGPNFDS

SEQ ID NO: 7434 - protein, 19 aa, Artificial Sequence
  anti-influenza_CDR
FCARGSPNSGYDWGPHFDY

SEQ ID NO: 7435 - protein, 19 aa, Artificial Sequence
  anti-influenza_CDR
RIKSNTDGGTTDYAAPVKG

SEQ ID NO: 7436 - protein, 19 aa, Artificial Sequence
  anti-influenza_CDR
LRLQGEVVVPPSQSNWFDP

SEQ ID NO: 7437 - protein, 20 aa, Artificial Sequence
  anti-influenza_CDR
AKEGGNTIFGLVTMAYYFDS

SEQ ID NO: 7438 - protein, 20 aa, Artificial Sequence
  anti-influenza_CDR
ARAGGDSSGYYGALGRFFQH

SEQ ID NO: 7439 - protein, 20 aa, Artificial Sequence
  anti-influenza_CDR
AKDSRGYCSSIICFEGGLDN

SEQ ID NO: 7440 - protein, 20 aa, Artificial Sequence
  anti-influenza_CDR
GSGSSDRSDYDPHYYYYLDV

SEQ ID NO: 7441 - protein, 20 aa, Artificial Sequence
  anti-influenza_CDR
GTDPDTEVYCRVGNCAAFDY

SEQ ID NO: 7442 - protein, 20 aa, Artificial Sequence
  anti-influenza_CDR
GTSHVSRYFDWLPPTNWFDP

SEQ ID NO: 7443 - protein, 20 aa, Artificial Sequence
  anti-influenza_CDR
GTDPDTEGYCRSGSCSAFDF

SEQ ID NO: 7444 - protein, 20 aa, Artificial Sequence
  anti-influenza_CDR
GTDPDTEVYCRAGNCAAFDF

SEQ ID NO: 7445 - protein, 20 aa, Artificial Sequence
  anti-influenza_CDR
RGGHSFGYGSGGDTHSEFDS

SEQ ID NO: 7446 - protein, 20 aa, Artificial Sequence
  anti-influenza_CDR
HMSMQQVVSAGWERADLVGD

SEQ ID NO: 7447 - protein, 20 aa, Artificial Sequence
  anti-influenza_CDR
DSRLRSLLYFEWLSQGYFNP

SEQ ID NO: 7448 - protein, 20 aa, Artificial Sequence
  anti-influenza_CDR
ARHLGQQLVSNTYYYYGMDV

SEQ ID NO: 7449 - protein, 21 aa, Artificial Sequence
  anti-influenza_CDR
TTGGTTTCTAAGCGGGCCTCC

SEQ ID NO: 7450 - protein, 21 aa, Artificial Sequence
  anti-influenza_CDR
ARAADESVESLTIKAFRTNYH

SEQ ID NO: 7451 - protein, 21 aa, Artificial Sequence
  anti-influenza_CDR
ARMPLANYDLLTGLYIGAFDL

SEQ ID NO: 7452 - protein, 21 aa, Artificial Sequence
  anti-influenza_CDR
DMLAYYSDNSGKKYNVYGMDV

SEQ ID NO: 7453 - protein, 21 aa, Artificial Sequence
  anti-influenza_CDR
DMLAYYYDGSGIRYNLYGMDV

SEQ ID NO: 7454 - protein, 22 aa, Artificial Sequence
  anti-influenza_CDR
AKDPRLRHLLYFPFTSMIYFDY

SEQ ID NO: 7455 - protein, 22 aa, Artificial Sequence
  anti-influenza_CDR
AKDSQLRSLLYFEWLSQGYFDP

SEQ ID NO: 7456 - protein, 22 aa, Artificial Sequence
  anti-influenza_CDR
AKDSQLRSLLYFEWLSQGYFDY

SEQ ID NO: 7457 - protein, 22 aa, Artificial Sequence
  anti-influenza_CDR
AKDSQLRSLLYFEWLSQGYFEP

SEQ ID NO: 7458 - protein, 22 aa, Artificial Sequence
  anti-influenza_CDR
AKERPLRLLRYFDWLSGGANDY

SEQ ID NO: 7459 - protein, 22 aa, Artificial Sequence
  anti-influenza_CDR
ARDVHNYDFLTGYPLHLYGMDV

SEQ ID NO: 7460 - protein, 22 aa, Artificial Sequence
  anti-influenza_CDR
ARDGREGYFYGSGSFYNLKGLN

SEQ ID NO: 7461 - protein, 22 aa, Artificial Sequence
  anti-influenza_CDR
STDRGHVLRYFGWMLPGDAFDV

SEQ ID NO: 7462 - protein, 22 aa, Artificial Sequence
  anti-influenza_CDR
LNYYDRSGYHSPDGPSNNWFDP

SEQ ID NO: 7463 - protein, 22 aa, Artificial Sequence
  anti-influenza_CDR
ARVPRDRLLTLYYESSTYGFDY

SEQ ID NO: 7464 - protein, 22 aa, Artificial Sequence
  anti-influenza_CDR
ARKWGRMTVFGVATDQLYYFDY

SEQ ID NO: 7465 - protein, 22 aa, Artificial Sequence
  anti-influenza_CDR
ATDIVVERDASLGGFNSYGMDV

SEQ ID NO: 7466 - protein, 23 aa, Artificial Sequence
  anti-influenza_CDR
ARNLPDIAVVTAVQDATPVWFDP

SEQ ID NO: 7467 - protein, 23 aa, Artificial Sequence
  anti-influenza_CDR
DGPYSDDFRSGYAARYRYFGMDV

SEQ ID NO: 7468 - protein, 24 aa, Artificial Sequence
  anti-influenza_CDR
GRELLRLQHFLTDSQSERRDCFDP

SEQ ID NO: 7469 - protein, 24 aa, Artificial Sequence
  anti-influenza_CDR
MSLLTEVETPTRNEWGCRCNDSSD

SEQ ID NO: 7470 - protein, 24 aa, Artificial Sequence
  anti-influenza_CDR
MSLLTEVETPTKNEWECRCNDSSD

SEQ ID NO: 7471 - protein, 24 aa, Artificial Sequence
  anti-influenza_CDR
MSLLTEVETPIRNEWECRCNDSSD

SEQ ID NO: 7472 - protein, 24 aa, Artificial Sequence
  anti-influenza_CDR
MSLLTEVETPIRNGWECKCNDSSD

SEQ ID NO: 7473 - protein, 24 aa, Artificial Sequence
  anti-influenza_CDR
MSLLTEVETPIRSEWGCRCNDSSD

SEQ ID NO: 7474 - protein, 24 aa, Artificial Sequence
  anti-influenza_CDR
MSFLPEVETPIRNEWGCRCNDSSD

SEQ ID NO: 7475 - protein, 24 aa, Artificial Sequence
  anti-influenza_CDR
MSLLTEVETPIRNEWGCRCNDSSN

SEQ ID NO: 7476 - protein, 24 aa, Artificial Sequence
  anti-influenza_CDR
MSLLTEVETPIRKEWGCRCNDSSD

SEQ ID NO: 7477 - protein, 24 aa, Artificial Sequence
  anti-influenza_CDR
MSFLTEVETPIRNEWGCRCNDSSD

SEQ ID NO: 7478 - protein, 24 aa, Artificial Sequence
  anti-influenza_CDR
MSLPTEVETPIRSEWGCRCNDSSD

SEQ ID NO: 7479 - protein, 24 aa, Artificial Sequence
  anti-influenza_CDR
MSLLPEVETPIRNEWGCRCNDSSD

SEQ ID NO: 7480 - protein, 24 aa, Artificial Sequence
  anti-influenza_CDR
MSLLPEVETPIRNGWGCRCNDSSD

SEQ ID NO: 7481 - protein, 24 aa, Artificial Sequence
  anti-influenza_CDR
MSLLTEVETPTRNGWECRCSGSSD

SEQ ID NO: 7482 - protein, 24 aa, Artificial Sequence
  anti-influenza_CDR
MSLLTEVETPIRNEWEYRCNDSSD

SEQ ID NO: 7483 - protein, 24 aa, Artificial Sequence
  anti-influenza_CDR
MSLLTEVETPIRNEWEYRCSDSSD

SEQ ID NO: 7484 - protein, 24 aa, Artificial Sequence
  anti-influenza_CDR
MSLLTEVETPTRNGWECRYSDSSD

SEQ ID NO: 7485 - protein, 24 aa, Artificial Sequence
  anti-influenza_CDR
MSFLTEVETLTRNGWECRCSDSSD

SEQ ID NO: 7486 - protein, 24 aa, Artificial Sequence
  anti-influenza_CDR
MSLLTEVETLTRNGWECKCRDSSD

SEQ ID NO: 7487 - protein, 24 aa, Artificial Sequence
  anti-influenza_CDR
MSLLTEVETPIRNEWGCRCNDSSD

SEQ ID NO: 7488 - protein, 24 aa, Artificial Sequence
  anti-influenza_CDR
MSLLTEVETPIRSEWGCRCNDSGD

SEQ ID NO: 7489 - protein, 24 aa, Artificial Sequence
  anti-influenza_CDR
MSLLTEVETPIRNEWECRCNGSSD

SEQ ID NO: 7490 - protein, 24 aa, Artificial Sequence
  anti-influenza_CDR
MSLPTEVETPIRNEWGCRCNDSSD

SEQ ID NO: 7491 - protein, 24 aa, Artificial Sequence
  anti-influenza_CDR
MSLLTEVETPIRNEWGCRCNGSSD

SEQ ID NO: 7492 - protein, 24 aa, Artificial Sequence
  anti-influenza_CDR
MSLLTEVDTLTRNGWGCRCSDSSD

SEQ ID NO: 7493 - protein, 24 aa, Artificial Sequence
  anti-influenza_CDR
MSLLTEVETLTKNGWGCRCSDSSD

SEQ ID NO: 7494 - protein, 24 aa, Artificial Sequence
  anti-influenza_CDR
MSLLTEVETPTRNGWECKCSDSSD

SEQ ID NO: 7495 - protein, 24 aa, Artificial Sequence
  anti-influenza_CDR
MSLLTEVETHTRNGWECKCSDSSD

SEQ ID NO: 7496 - protein, 24 aa, Artificial Sequence
  anti-influenza_CDR
MSLLTEVKTPTRNGWECKCSDSSD

SEQ ID NO: 7497 - protein, 24 aa, Artificial Sequence
  anti-influenza_CDR
MSLLTEVETLTRNGWGCRCSDSSD

SEQ ID NO: 7498 - protein, 24 aa, Artificial Sequence
  anti-influenza_CDR
MSLLTEVETPTRDGWECKCSDSSD

SEQ ID NO: 7499 - protein, 24 aa, Artificial Sequence
  anti-influenza_CDR
MSLLTEVETPTRNGWGCRCSDSSD

SEQ ID NO: 7500 - protein, 24 aa, Artificial Sequence
  anti-influenza_CDR
MSLLTEVETPTRNGWECKCNDSSD

SEQ ID NO: 7501 - protein, 24 aa, Artificial Sequence
  anti-influenza_CDR
MSLLTEVETLTRNGWECKCSDSSD

SEQ ID NO: 7502 - protein, 24 aa, Artificial Sequence
  anti-influenza_CDR
MSLLTEVETPIRNEWGCKCNDSSD

SEQ ID NO: 7503 - protein, 24 aa, Artificial Sequence
  anti-influenza_CDR
MSFLTEVETPIRNEWGCRCNGSSD

SEQ ID NO: 7504 - protein, 24 aa, Artificial Sequence
  anti-influenza_CDR
MSLLTEVETPTRNGWECRCNDSSD

SEQ ID NO: 7505 - protein, 24 aa, Artificial Sequence
  anti-influenza_CDR
MSLLTEVETPIRKGWECNCSDSSD

SEQ ID NO: 7506 - protein, 24 aa, Artificial Sequence
  anti-influenza_CDR
MSLLTEVETPTRNEWECRCSDSSD

SEQ ID NO: 7507 - protein, 24 aa, Artificial Sequence
  anti-influenza_CDR
MSLLTGVETHTRNGWGCKCSDSSD

SEQ ID NO: 7508 - protein, 24 aa, Artificial Sequence
  anti-influenza_CDR
MSLLPEVETHTRNGWGCRCSDSSD

SEQ ID NO: 7509 - protein, 24 aa, Artificial Sequence
  anti-influenza_CDR
TDGPYSDDFRSGYAARYRYFGMDV

SEQ ID NO: 7510 - protein, 25 aa, Artificial Sequence
  anti-influenza_CDR
AKHMSLQQVVSAGWERADLVGDAFD

SEQ ID NO: 7511 - protein, 25 aa, Artificial Sequence
  anti-influenza_CDR
AKHLSMQQVVSAGWERADLVGDAFD

SEQ ID NO: 7512 - protein, 25 aa, Artificial Sequence
  anti-influenza_CDR
AKHASLQQVVSAGWERADLVGDAFD

SEQ ID NO: 7513 - protein, 25 aa, Artificial Sequence
  anti-influenza_CDR
AKHSSLQQVVSAGWERADLVGDAFD

SEQ ID NO: 7514 - protein, 25 aa, Artificial Sequence
  anti-influenza_CDR
AKHLSLQQVVSAGWERADLVGDAFD

SEQ ID NO: 7515 - protein, 25 aa, Artificial Sequence
  anti-influenza_CDR
AKHMSMQQVVSAGWERADLVGDAFD

SEQ ID NO: 7516 - protein, 25 aa, Artificial Sequence
  anti-influenza_CDR
ARGPETYYYDKTNWLNSHPDEYFQH

SEQ ID NO: 7517 - protein, 25 aa, Artificial Sequence
  anti-influenza_CDR
TTDGPYSDDFRSGYAARYRYFGMDV

SEQ ID NO: 7518 - protein, 25 aa, Artificial Sequence
  anti-influenza_CDR
TDGPYSDDFRSGYAARYRYFGMDVW

SEQ ID NO: 7519 - protein, 26 aa, Artificial Sequence [sequence omitted]

SEQ ID NO: 7520 - protein, 26 aa, Artificial Sequence
  anti-influenza_CDR
ATGRAATGSASCTGGGTYWTYCTCTT

SEQ ID NO: 7521 - protein, 27 aa, Artificial Sequence
  anti-influenza_CDR
GYIPEAPRDGQAYVRKDGEWVLLSTFL

SEQ ID NO: 7522 - protein, 30 aa, Artificial Sequence
  anti-influenza_CDR
QVQLLETGGGLVKPGQSLKLSCAASGFTFT

SEQ ID NO: 7523 - protein, 32 aa, Artificial Sequence
  anti-influenza_CDR
RFTISRDNSKNTLYLQMNSLRAEDTAVYYCAK

SEQ ID NO: 7524 - protein, 32 aa, Artificial Sequence
  anti-influenza_CDR
GVPSRFSGSGSGTDFTLTISSLQPEDFATYYC

SEQ ID NO: 7525 - protein, 5 aa, Artificial Sequence
  anti-OX40_HeavyChain_CDR1
SYSMN

SEQ ID NO: 7526 - protein, 5 aa, Artificial Sequence
  anti-OX40_HeavyChain_CDR1
DYAMH

SEQ ID NO: 7527 - protein, 5 aa, Artificial Sequence
  anti-OX40_HeavyChain_CDR1
DSYMS

SEQ ID NO: 7528 - protein, 5 aa, Artificial Sequence
  anti-OX40_HeavyChain_CDR1
DAYMS

SEQ ID NO: 7529 - protein, 5 aa, Artificial Sequence
  anti-OX40_HeavyChain_CDR1
ESYMS

SEQ ID NO: 7530 - protein, 5 aa, Artificial Sequence
  anti-OX40_HeavyChain_CDR1
SGYWN

SEQ ID NO: 7531 - protein, 7 aa, Artificial Sequence
  anti-OX40_LightChain_CDR2
YTSRLHS

SEQ ID NO: 7532 - protein, 7 aa, Artificial Sequence
  anti-OX40_LightChain_CDR2
AASSLQS

SEQ ID NO: 7533 - protein, 7 aa, Artificial Sequence
  anti-OX40_LightChain_CDR2
DASNRAT

SEQ ID NO: 7534 - protein, 7 aa, Artificial Sequence
  anti-OX40_LightChain_CDR2
YTSRLRS

SEQ ID NO: 7535 - protein, 8 aa, Artificial Sequence
  anti-OX40_LightChain_CDR3
QQRSNWPT

SEQ ID NO: 7536 - protein, 8 aa, Artificial Sequence
  anti-OX40_HeavyChain_CDR3
APRWYFSV

SEQ ID NO: 7537 - protein, 8 aa, Artificial Sequence
  anti-OX40_HeavyChain_CDR3
APRWYFSA

SEQ ID NO: 7538 - protein, 8 aa, Artificial Sequence
  anti-OX40_HeavyChain_CDR3
APRWYFAV

SEQ ID NO: 7539 - protein, 9 aa, Artificial Sequence
  anti-OX40_LightChain_CDR3
QQGNTLPWT

SEQ ID NO: 7540 - protein, 9 aa, Artificial Sequence
  anti-OX40_HeavyChain_CDR3
ESGWYLFDY

SEQ ID NO: 7541 - protein, 9 aa, Artificial Sequence
  anti-OX40_LightChain_CDR3
QQYNSYPPT

SEQ ID NO: 7542 - protein, 9 aa, Artificial Sequence
  anti-OX40_LightChain_CDR3
QQGHTLPPT

SEQ ID NO: 7543 - protein, 9 aa, Artificial Sequence
  anti-OX40_LightChain_CDR3
QQGHTLPAT

SEQ ID NO: 7544 - protein, 9 aa, Artificial Sequence
  anti-OX40_LightChain_CDR3
QQGHTAPPT

SEQ ID NO: 7545 - protein, 9 aa, Artificial Sequence
  anti-OX40_LightChain_CDR3
QQGATLPPT

SEQ ID NO: 7546 - protein, 9 aa, Artificial Sequence
  anti-OX40_LightChain_CDR3
QQGHALPPT

SEQ ID NO: 7547 - protein, 9 aa, Artificial Sequence
  anti-OX40_LightChain_CDR3
QQAHTLPPT

SEQ ID NO: 7548 - protein, 9 aa, Artificial Sequence
  anti-OX40_LightChain_CDR3
QQGHTLAPT

SEQ ID NO: 7549 - protein, 9 aa, Artificial Sequence
  anti-OX40_LightChain_CDR3
QAGHTLPPT

SEQ ID NO: 7550 - protein, 10 aa, Artificial Sequence
  anti-OX40_HeavyChain_CDR1
GYTFTSYVMH

SEQ ID NO: 7551 - protein, 10 aa, Artificial Sequence
  anti-OX40_HeavyChain_CDR3
YYGSSLSMDY

SEQ ID NO: 7552 - protein, 11 aa, Artificial Sequence
  anti-OX40_LightChain_CDR1
RASQDISNYLN

SEQ ID NO: 7553 - protein, 11 aa, Artificial Sequence
  anti-OX40_LightChain_CDR1
RASQGISSWLA

SEQ ID NO: 7554 - protein, 11 aa, Artificial Sequence
  anti-OX40_LightChain_CDR1
RASQSVSSYLA

SEQ ID NO: 7555 - protein, 13 aa, Artificial Sequence
  anti-OX40_HeavyChain_CDR3
YRYDYDGGHAMDY

SEQ ID NO: 7556 - protein, 13 aa, Artificial Sequence
  anti-OX40_HeavyChain_CDR3
YKYDYDAGHAMDY

SEQ ID NO: 7557 - protein, 13 aa, Artificial Sequence
  anti-OX40_HeavyChain_CDR3
YKYDYDGGHAMDY

SEQ ID NO: 7558 - protein, 15 aa, Artificial Sequence
  anti-OX40_HeavyChain_CDR3
DQSTADYYFYYGMDV

SEQ ID NO: 7559 - protein, 16 aa, Artificial Sequence
  anti-OX40_HeavyChain_CDR2
YISYNGITYHNPSLKS

SEQ ID NO: 7560 - protein, 16 aa, Artificial Sequence
  anti-OX40_HeavyChain_CDR2
YISYNAITYHNPSLKS

SEQ ID NO: 7561 - protein, 16 aa, Artificial Sequence
  anti-OX40_HeavyChain_CDR2
YISYSGITYHNPSLKS

SEQ ID NO: 7562 - protein, 17 aa, Artificial Sequence
  anti-OX40_HeavyChain_CDR2
YINPYNDGTKYNEKFKG

SEQ ID NO: 7563 - protein, 17 aa, Artificial Sequence
  anti-OX40_HeavyChain_CDR2
YISSSSSTIDYADSVKG

SEQ ID NO: 7564 - protein, 17 aa, Artificial Sequence
  anti-OX40_HeavyChain_CDR2
GISWNSGSIGYADSVKG

SEQ ID NO: 7565 - protein, 17 aa, Artificial Sequence
  anti-OX40_HeavyChain_CDR2
DMYPDNGDSSYNQKFRE

SEQ ID NO: 7566 - protein, 17 aa, Artificial Sequence
  anti-OX40_HeavyChain_CDR2
DMYPDNADSSYNQKFRE

SEQ ID NO: 7567 - protein, 17 aa, Artificial Sequence
  anti-OX40_HeavyChain_CDR2
DMYPDNADASYNQKFRE

SEQ ID NO: 7568 - protein, 17 aa, Artificial Sequence
  anti-OX40_HeavyChain_CDR2
DMYPDNGDASYNQKFRE

SEQ ID NO: 7569 - protein, 17 aa, Artificial Sequence
  anti-OX40_HeavyChain_CDR2
DMYPDSGDSSYNQKFRE

SEQ ID NO: 7570 - protein, 17 aa, Artificial Sequence
  anti-OX40_HeavyChain_CDR2
DMYPDNGSSSYNQKFRE

SEQ ID NO: 7571 - protein, 103 aa, Artificial Sequence
  Ig_LightChain_kappa_constant_domain
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNR

SEQ ID NO: 7572 - protein, 103 aa, Artificial Sequence
  Ig_LightChain_kappa_constant_domain
TVAAPSVFIFPPSDEQLKSGTASVVCLLNNFYPREAKVQWKVDNALQSGNSQESVTEQDSKDSTYSLSNTLTLSKADYEKHKVYACEVTHQGLSSPVTKSFNR

SEQ ID NO: 7573 - protein, 104 aa, Artificial Sequence
  Ig_LightChain_lambda_constant_domain
PKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7574 - protein, 104 aa, Artificial Sequence
  Ig_LightChain_lambda_constant_domain
PKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPAECS

SEQ ID NO: 7575 - protein, 104 aa, Artificial Sequence
  Ig_LightChain_lambda_constant_domain
PKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 7576 - protein, 104 aa, Artificial Sequence
  Ig_LightChain_lambda_constant_domain
PKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPAECS

SEQ ID NO: 7577 - protein, 94 aa, Artificial Sequence
  IgG1_HeavyChain_CH1_constant_domain
SASTKGPSVFPLAPSSKSTSGGTAALGCLVKDYFPEPVTVSWNSGVHTFPAVLQSSGLYSLSSVVTVPSSSLGTQTYICNVNHKPSNTKVDKKV

SEQ ID NO: 7578 - protein, 90 aa, Artificial Sequence
  IgG1_HeavyChain_CH1_constant_domain
SGPSVFPLAPSSKSTSGGTAALGCLVKDYFPEPVTVSWNSGVHTFPAVLQSSGLYSLSSVVTVPSSSLGTQTYICNVNHKPSNTKVDKKV

SEQ ID NO: 7579 - protein, 90 aa, Artificial Sequence
  IgG1_HeavyChain_CH1_constant_domain
SGPSVFPLAPSSKSTSGGTAALGCLVKDYFPEPVTVSWNSGVHTFPAVLQSSGLYSLSSVVTVPSSSLGTQTYICNVNHKPSNTKVDKKA

SEQ ID NO: 7580 - protein, 90 aa, Artificial Sequence
  IgG1_HeavyChain_CH1_constant_domain
SGPSVFPLAPSSKSTSGGTAALGCLVKDYFPEPVTVSWNSGVHTFPAVLQSSGLYSLSSVVTVPSSSLGTQTYICNVNHKPSNTKVDKRV

SEQ ID NO: 7581 - protein, 90 aa, Artificial Sequence
  IgG1_HeavyChain_CH1_constant_domain
SGPSVFPLAPSSKSTSGGTAALGCLVKDYFPEPVTVSWNSGVHTFPAVLQSSGLYSLSSVVTVPSSSLGTQTYICNVNHKPSNTKVDKRA

SEQ ID NO: 7582 - protein, 90 aa, Artificial Sequence
  IgG1_HeavyChain_CH1_constant_domain
SGPSVLPLAPSSKSTSGGTAALGCLVKDYFPEPVTVSWNSGVHTFPAVLQSSGLYSLSSVVTVPSSSLGTQTYICNVNHKPSNTKVDKKV

SEQ ID NO: 7583 - protein, 90 aa, Artificial Sequence
  IgG1_HeavyChain_CH1_constant_domain
SGPSVLPLAPSSKSTSGGTAALGCLVKDYFPEPVTVSWNSGVHTFPAVLQSSGLYSLSSVVTVPSSSLGTQTYICNVNHKPSNTKVDKKA

SEQ ID NO: 7584 - protein, 90 aa, Artificial Sequence
  IgG1_HeavyChain_CH1_constant_domain
SGPSVLPLAPSSKSTSGGTAALGCLVKDYFPEPVTVSWNSGVHTFPAVLQSSGLYSLSSVVTVPSSSLGTQTYICNVNHKPSNTKVDKRV

SEQ ID NO: 7585 - protein, 90 aa, Artificial Sequence
  IgG1_HeavyChain_CH1_constant_domain
SGPSVLPLAPSSKSTSGGTAALGCLVKDYFPEPVTVSWNSGVHTFPAVLQSSGLYSLSSVVTVPSSSLGTQTYICNVNHKPSNTKVDKRA

SEQ ID NO: 7586 - protein, 94 aa, Artificial Sequence
  IgG1_HeavyChain_CH1_constant_domain
SASTKGPSVFPLAPSSKSTSGGTAALGCLVKDYFPEPVTVSWNSGVHTFPAVLQSSGLYSLSSVVTVPSSSLGTQTYICNVNHKPSNTKVDKKA

SEQ ID NO: 7587 - protein, 94 aa, Artificial Sequence
  IgG1_HeavyChain_CH1_constant_domain
SASTKGPSVFPLAPSSKSTSGGTAALGCLVKDYFPEPVTVSWNSGVHTFPAVLQSSGLYSLSSVVTVPSSSLGTQTYICNVNHKPSNTKVDKRV

SEQ ID NO: 7588 - protein, 94 aa, Artificial Sequence
  IgG1_HeavyChain_CH1_constant_domain
SASTKGPSVFPLAPSSKSTSGGTAALGCLVKDYFPEPVTVSWNSGVHTFPAVLQSSGLYSLSSVVTVPSSSLGTQTYICNVNHKPSNTKVDKRA

SEQ ID NO: 7589 - protein, 94 aa, Artificial Sequence
  IgG1_HeavyChain_CH1_constant_domain
SASTKGPSVLPLAPSSKSTSGGTAALGCLVKDYFPEPVTVSWNSGVHTFPAVLQSSGLYSLSSVVTVPSSSLGTQTYICNVNHKPSNTKVDKKV

SEQ ID NO: 7590 - protein, 94 aa, Artificial Sequence
  IgG1_HeavyChain_CH1_constant_domain
SASTKGPSVLPLAPSSKSTSGGTAALGCLVKDYFPEPVTVSWNSGVHTFPAVLQSSGLYSLSSVVTVPSSSLGTQTYICNVNHKPSNTKVDKKA

SEQ ID NO: 7591 - protein, 94 aa, Artificial Sequence
  IgG1_HeavyChain_CH1_constant_domain
SASTKGPSVLPLAPSSKSTSGGTAALGCLVKDYFPEPVTVSWNSGVHTFPAVLQSSGLYSLSSVVTVPSSSLGTQTYICNVNHKPSNTKVDKRV

SEQ ID NO: 7592 - protein, 94 aa, Artificial Sequence
  IgG1_HeavyChain_CH1_constant_domain
SASTKGPSVLPLAPSSKSTSGGTAALGCLVKDYFPEPVTVSWNSGVHTFPAVLQSSGLYSLSSVVTVPSSSLGTQTYICNVNHKPSNTKVDKRA

SEQ ID NO: 7593 - protein, 110 aa, Artificial Sequence
  IgG1_HeavyChain_CH2_constant_domain
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 7594 - protein, 110 aa, Artificial Sequence
  IgG1_HeavyChain_CH2_constant_domain
APELLGGPSVFLFPPKPKDTLMISRTPEVTCVVVDVSHEDPEVKFNVYVDGVEVHNAKTKPREEQYNSTYRVVSVLTVLHQDWLNGKEYKCKVSNKALPAPIEKTISKAK

SEQ ID NO: 7595 - protein, 110 aa, Artificial Sequence
  IgG1_HeavyChain_CH2_constant_domain
APELLGGPSVFLFPPKPKDTLMISRTPEVTCVVVDVSHEDPEVKFNVYVDGVEVHNAKTKPREEQYASTYRVVSVLTVLHQDWLNGKEYKCKVSNKALPAPIEKTISKAK

SEQ ID NO: 7596 - protein, 110 aa, Artificial Sequence
  IgG1_HeavyChain_CH2_constant_domain
APELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAK

SEQ ID NO: 7597 - protein, 110 aa, Artificial Sequence
  IgG1_HeavyChain_CH2_constant_domain
APELLGAPSVFLFPPKPKDTLMISRTPEVTCVVVDVSHEDPEVKFNVYVDGVEVHNAKTKPREEQYNSTYRVVSVLTVLHQDWLNGKEYKCKVSNKALPAPIEKTISKAK

SEQ ID NO: 7598 - protein, 110 aa, Artificial Sequence
  IgG1_HeavyChain_CH2_constant_domain
APELLGAPSVFLFPPKPKDTLMISRTPEVTCVVVDVSHEDPEVKFNVYVDGVEVHNAKTKPREEQYASTYRVVSVLTVLHQDWLNGKEYKCKVSNKALPAPIEKTISKAK

SEQ ID NO: 7599 - protein, 110 aa, Artificial Sequence
  IgG1_HeavyChain_CH2_constant_domain
APELLGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 7600 - protein, 110 aa, Artificial Sequence
  IgG1_HeavyChain_CH2_constant_domain
APELLGAPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAK

SEQ ID NO: 7601 - protein, 110 aa, Artificial Sequence
  IgG1_HeavyChain_CH2_constant_domain
APELAGGPSVFLFPPKPKDTLMISRTPEVTCVVVDVSHEDPEVKFNVYVDGVEVHNAKTKPREEQYNSTYRVVSVLTVLHQDWLNGKEYKCKVSNKALPAPIEKTISKAK

SEQ ID NO: 7602 - protein, 110 aa, Artificial Sequence
  IgG1_HeavyChain_CH2_constant_domain
APELAGGPSVFLFPPKPKDTLMISRTPEVTCVVVDVSHEDPEVKFNVYVDGVEVHNAKTKPREEQYASTYRVVSVLTVLHQDWLNGKEYKCKVSNKALPAPIEKTISKAK

SEQ ID NO: 7603 - protein, 110 aa, Artificial Sequence
  IgG1_HeavyChain_CH2_constant_domain
APELAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 7604 - protein, 110 aa, Artificial Sequence
  IgG1_HeavyChain_CH2_constant_domain
APELAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAK

SEQ ID NO: 7605 - protein, 110 aa, Artificial Sequence
  IgG1_HeavyChain_CH2_constant_domain
APELAGAPSVFLFPPKPKDTLMISRTPEVTCVVVDVSHEDPEVKFNVYVDGVEVHNAKTKPREEQYNSTYRVVSVLTVLHQDWLNGKEYKCKVSNKALPAPIEKTISKAK

SEQ ID NO: 7606 - protein, 110 aa, Artificial Sequence
  IgG1_HeavyChain_CH2_constant_domain
APELAGAPSVFLFPPKPKDTLMISRTPEVTCVVVDVSHEDPEVKFNVYVDGVEVHNAKTKPREEQYASTYRVVSVLTVLHQDWLNGKEYKCKVSNKALPAPIEKTISKAK

SEQ ID NO: 7607 - protein, 110 aa, Artificial Sequence
  IgG1_HeavyChain_CH2_constant_domain
APELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 7608 - protein, 110 aa, Artificial Sequence
  IgG1_HeavyChain_CH2_constant_domain
APELAGAPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAK

SEQ ID NO: 7609 - protein, 110 aa, Artificial Sequence
  IgG1_HeavyChain_CH2_constant_domain
APEALGGPSVFLFPPKPKDTLMISRTPEVTCVVVDVSHEDPEVKFNVYVDGVEVHNAKTKPREEQYNSTYRVVSVLTVLHQDWLNGKEYKCKVSNKALPAPIEKTISKAK

SEQ ID NO: 7610 - protein, 110 aa, Artificial Sequence
  IgG1_HeavyChain_CH2_constant_domain
APEALGGPSVFLFPPKPKDTLMISRTPEVTCVVVDVSHEDPEVKFNVYVDGVEVHNAKTKPREEQYASTYRVVSVLTVLHQDWLNGKEYKCKVSNKALPAPIEKTISKAK

SEQ ID NO: 7611 - protein, 110 aa, Artificial Sequence
  IgG1_HeavyChain_CH2_constant_domain
APEALGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 7612 - protein, 110 aa, Artificial Sequence
  IgG1_HeavyChain_CH2_constant_domain
APEALGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAK

SEQ ID NO: 7613 - protein, 110 aa, Artificial Sequence
  IgG1_HeavyChain_CH2_constant_domain
APEALGAPSVFLFPPKPKDTLMISRTPEVTCVVVDVSHEDPEVKFNVYVDGVEVHNAKTKPREEQYNSTYRVVSVLTVLHQDWLNGKEYKCKVSNKALPAPIEKTISKAK

SEQ ID NO: 7614 - protein, 110 aa, Artificial Sequence
  IgG1_HeavyChain_CH2_constant_domain
APEALGAPSVFLFPPKPKDTLMISRTPEVTCVVVDVSHEDPEVKFNVYVDGVEVHNAKTKPREEQYASTYRVVSVLTVLHQDWLNGKEYKCKVSNKALPAPIEKTISKAK

SEQ ID NO: 7615 - protein, 110 aa, Artificial Sequence
  IgG1_HeavyChain_CH2_constant_domain
APEALGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 7616 - protein, 110 aa, Artificial Sequence
  IgG1_HeavyChain_CH2_constant_domain
APEALGAPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAK

SEQ ID NO: 7617 - protein, 110 aa, Artificial Sequence
  IgG1_HeavyChain_CH2_constant_domain
APEAAGGPSVFLFPPKPKDTLMISRTPEVTCVVVDVSHEDPEVKFNVYVDGVEVHNAKTKPREEQYNSTYRVVSVLTVLHQDWLNGKEYKCKVSNKALPAPIEKTISKAK

SEQ ID NO: 7618 - protein, 110 aa, Artificial Sequence
  IgG1_HeavyChain_CH2_constant_domain
APEAAGGPSVFLFPPKPKDTLMISRTPEVTCVVVDVSHEDPEVKFNVYVDGVEVHNAKTKPREEQYASTYRVVSVLTVLHQDWLNGKEYKCKVSNKALPAPIEKTISKAK

SEQ ID NO: 7619 - protein, 110 aa, Artificial Sequence
  IgG1_HeavyChain_CH2_constant_domain
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 7620 - protein, 110 aa, Artificial Sequence
  IgG1_HeavyChain_CH2_constant_domain
APEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAK

SEQ ID NO: 7621 - protein, 110 aa, Artificial Sequence
  IgG1_HeavyChain_CH2_constant_domain
APEAAGAPSVFLFPPKPKDTLMISRTPEVTCVVVDVSHEDPEVKFNVYVDGVEVHNAKTKPREEQYNSTYRVVSVLTVLHQDWLNGKEYKCKVSNKALPAPIEKTISKAK

SEQ ID NO: 7622 - protein, 110 aa, Artificial Sequence
  IgG1_HeavyChain_CH2_constant_domain
APEAAGAPSVFLFPPKPKDTLMISRTPEVTCVVVDVSHEDPEVKFNVYVDGVEVHNAKTKPREEQYASTYRVVSVLTVLHQDWLNGKEYKCKVSNKALPAPIEKTISKAK

SEQ ID NO: 7623 - protein, 110 aa, Artificial Sequence
  IgG1_HeavyChain_CH2_constant_domain
APEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 7624 - protein, 110 aa, Artificial Sequence
  IgG1_HeavyChain_CH2_constant_domain
APEAAGAPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAK

SEQ ID NO: 7625 - protein, 106 aa, Artificial Sequence
  IgG1_HeavyChain_CH3_constant_domain
GQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 7626 - protein, 106 aa, Artificial Sequence
  IgG1_HeavyChain_CH3_constant_domain
GQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 7627 - protein, 106 aa, Artificial Sequence
  IgG1_HeavyChain_CH3_constant_domain
GQPREPQVYTLPPSRDEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 7628 - protein, 106 aa, Artificial Sequence [sequence omitted]

SEQ ID NO: 7629 - protein, 99 aa, Artificial Sequence
  IgG2_HeavyChain_CH1_constant_domain
SASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTV

SEQ ID NO: 7630 - protein, 99 aa, Artificial Sequence
  IgG2_HeavyChain_CH1_constant_domain
SASTKGPSVFPLAPCSRSTSESTAALGCLVKDYFPEPVTVSWNSGALTSGVHTFPAVLQSSGLYSLSSVVTVTSSNFGTQTYTCNVDHKPSNTKVDKTV

SEQ ID NO: 7631 - protein, 109 aa, Artificial Sequence
  IgG2_HeavyChain_CH2_constant_domain
APPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTK

SEQ ID NO: 7632 - protein, 109 aa, Artificial Sequence
  IgG2_HeavyChain_CH2_constant_domain
APPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPASIEKTISKTK

SEQ ID NO: 7633 - protein, 109 aa, Artificial Sequence
  IgG2_HeavyChain_CH2_constant_domain
APPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSPIEKTISKTK

SEQ ID NO: 7634 - protein, 109 aa, Artificial Sequence
  IgG2_HeavyChain_CH2_constant_domain
APPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTK

SEQ ID NO: 7635 - protein, 109 aa, Artificial Sequence
  IgG2_HeavyChain_CH2_constant_domain
APPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTK

SEQ ID NO: 7636 - protein, 109 aa, Artificial Sequence
  IgG2_HeavyChain_CH2_constant_domain
APPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPASIEKTISKTK

SEQ ID NO: 7637 - protein, 109 aa, Artificial Sequence
  IgG2_HeavyChain_CH2_constant_domain
APPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPSPIEKTISKTK

SEQ ID NO: 7638 - protein, 109 aa, Artificial Sequence
  IgG2_HeavyChain_CH2_constant_domain
APPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPSSIEKTISKTK

SEQ ID NO: 7639 - protein, 106 aa, Artificial Sequence
  IgG2_HeavyChain_CH3_constant_domain
GQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 7640 - protein, 99 aa, Artificial Sequence
  IgG4_HeavyChain_CH1_constant_domain
SASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRV

SEQ ID NO: 7641 - protein, 110 aa, Artificial Sequence
  IgG4_HeavyChain_CH2_constant_domain
APEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAK

SEQ ID NO: 7642 - protein, 106 aa, Artificial Sequence
  IgG4_HeavyChain_CH3_constant_domain
GQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 7643 - RNA, 1347 nt, Artificial Sequence
  derived and/or modified sequence opt1 from AAB-003_gamma1-Chain
gaggugcagcugcucgagagcggcgggggccugguccagcccgggggcucccugcgccucagcugcgccgccuccggguucaccuucagcaacuacggcauguccugggugcggcaggcgccgggcaaggggcuggaguggguggccagcauccgcuccggcgggggccggaccuacuacagcgacaacgucaaggggcgcuucacgaucucccgggacaacagcaagaacacccuguaccuccagaugaacucccugcgcgccgaggacaccgccguguacuacugcgugcgguacgaccacuacagcggcuccagcgacuacuggggccaggggacccuggucacgguguccagcgccuccaccaagggccccagcguguucccccucgcgcccuccagcaagagcaccuccgggggcaccgccgcccugggcugccuggucaaggacuacuucccggagcccgugacggugagcuggaacuccggggcccucaccagcggcguccacaccuuccccgcggugcugcaguccagcgggcuguacucccucagcuccguggucaccgugcccagcuccagccugggcacgcagaccuacaucugcaacgugaaccacaagccguccaacaccaaggucgacaagaagguggagcccaagagcugcgacaagacccacacgugcccgcccugccccgcccccgaggccgccggggcccccuccguguuccuguucccgcccaagcccaaggacacccucaugaucagccgcacccccgaggugaccugcgucguggucgacgugucccacgaggaccccgaggucaaguucaacugguacguggacggcguggagguccacaacgcgaagacgaagccgcgggaggagcaguacaacagcaccuaccgcgugguguccguccugaccgugcugcaccaggacuggcucaacggcaaggaguacaagugcaaggugagcaacaaggcccugcccgcccccaucgagaagaccaucagcaaggccaaggggcagccccgggagccgcaggucuacacgcugccgcccucccgcgaggagaugaccaagaaccaggugagccugaccugccucgugaagggcuucuaccccuccgacaucgccgucgagugggagagcaacgggcagcccgagaacaacuacaagaccacgccgcccgugcuggacuccgacggcagcuucuuccucuacuccaagcugaccguggacaagagccgguggcagcaggggaacgucuucuccugcagcgugaugcacgaggcgcugcacaaccacuacacccagaagucccucagccugucccccggcaag

SEQ ID NO: 7644 - RNA, 1329 nt, Artificial Sequence
  derived and/or modified sequence opt1 from Abagovomab_HeavyChain
caggugaagcugcaggagagcggcgccgagcucgcccgccccggggcguccgucaagcugagcugcaaggccuccggcuacaccuucaccaacuacuggaugcagugggugaagcagcggccggggcagggccuggacuggaucggggccaucuaccccggcgacggcaacacccgcuacacccacaaguucaaggggaaggccacccucaccgccgacaagagcuccagcacggcguacaugcagcuguccagccuggccuccgaggacagcggcguguacuacugcgcccgcggggagggcaacuacgccugguucgcguacugggggcagggcaccaccgucaccguguccagcgccaagacgaccccgcccuccguguacccccucgcccccggcagcgccgcccagaccaacuccauggucacccuggggugccuggugaagggcuacuuccccgagcccgugacggucaccuggaacagcgggucccucagcuccggcgugcacaccuucccggcggugcugcagagcgaccuguacacccucagcuccagcgucacggugcccuccagcaccuggcccuccgagaccgugaccugcaacgucgcccaccccgccagcuccacgaagguggacaagaagaucgugccgcgggacugcggcugcaagcccugcaucugcaccguccccgaggugagcuccguguucaucuucccgcccaagcccaaggacguccugaccaucacccugacgcccaaggugaccugcguggucguggacaucagcaaggacgaccccgagguccaguucuccugguucguggacgacguggagguccacaccgcccagacccagccgcgggaggagcaguucaacagcacguuccgcuccgugagcgagcuccccaucaugcaccaggacuggcugaacgggaaggaguucaagugccgggugaacuccgccgcguuccccgcccccaucgagaagaccaucagcaagaccaagggccgcccgaaggcgccccaggucuacaccaucccgccgcccaaggagcagauggccaaggacaaggugucccugacgugcaugaucaccgacuucuuccccgaggacaucaccguggaguggcaguggaacgggcagcccgccgagaacuacaagaacacccagcccaucauggacacggacggcagcuacuucgucuacuccaagcucaacgugcagaaguccaacugggaggccgggaacaccuucacgugcagcgugcugcacgagggccugcacaaccaccacaccgagaagucccucagccacagccccggcaag

SEQ ID NO: 7645 - RNA, 642 nt, Artificial Sequence
  derived and/or modified sequence opt1 from Abagovomab_LightChain
gacaucgagcugacccagagccccgccucccucagcgccuccgugggcgagaccgugacgaucacgugccaggcgagcgagaacaucuacuccuaccuggccuggcaccagcagaagcaggggaaguccccgcagcugcucguguacaacgccaagacccuggccggcggggugagcagccgcuucuccggcagcggguccggcacccacuucagccugaagaucaagucccuccagcccgaggacuucggcaucuacuacugccagcaccacuacgggauccugcccaccuucggcgggggcaccaagcuggagaucaagcgggccgacgcggcccccaccgucagcaucuucccgcccuccagcgagcagcucaccuccgggggcgccagcguggugugcuuccugaacaacuucuaccccaaggacaucaacgucaaguggaagaucgacggcuccgagcgccagaacggggugcugaacagcuggacggaccaggacagcaaggacuccaccuacagcauguccagcacccucacccugacgaaggacgaguacgagcggcacaacuccuacacgugcgaggccacccacaagaccagcaccucccccaucgucaagagcuucaaccgcaacgagugc

SEQ ID NO: 7646 - RNA, 1350 nt, Artificial Sequence
  derived and/or modified sequence opt1 from Abciximab_HeavyChain
gaggugcagcugcagcagagcggcgccgagcucgucaagcccggggccuccgugaagcugagcugcaccgcguccggcuucaacaucaaggacaccuacgugcacugggucaagcagcgcccggagcaggggcuggaguggaucggccggaucgaccccgccaacggguacacgaaguacgaccccaaguuccagggcaaggccaccaucaccgccgacaccagcuccaacacggccuaccuccagcugagcucccugaccagcgaggacaccgcgguguacuacugcgugcgcccccucuacgacuacuacgccauggacuacuggggccaggggaccuccgucacggugagcuccgccaagaccaccgccccgagcguguacccccuggcgcccgucugcggcgacaccacgggguccagcgugacccugggcugccucgugaagggguacuuccccgagccggucacccugaccuggaacuccggcagccuguccagcggcgugcacacguuccccgccgugcuccaguccgaccuguacacccugagcagcuccgucaccgugaccagcuccacguggcccagccaguccaucacgugcaacguggcccaccccgccagcuccaccaaggucgacaagaagaucgagccgcggcccaagagcugcgacaagacccacacgugcccgcccugcccggcccccgagcuccucgggggccccuccguguuccuguucccgcccaagcccaaggacacccugaugaucagccgcacccccgaggugaccugcgucgugguggacgucucccacgaggaccccgaggugaaguucaacugguacgucgacgggguggaggugcacaacgcgaagaccaagccgcgggaggagcaguacaacagcaccuaccgcgucguguccgugcugaccguccugcaccaggacuggcucaacggcaaggaguacaagugcaaggugagcaacaaggcccugcccgcccccaucgagaagaccaucuccaaggccaagggccagccccgggagccccagguguacacgcugccgcccagccgcgacgagcucaccaagaaccaggucucccugaccugccuggugaagggguucuaccccagcgacaucgccguggagugggaguccaacggccagcccgagaacaacuacaagaccacgccgcccguccucgacagcgacgggagcuucuuccuguacuccaagcugaccguggacaagagccgguggcagcagggcaacguguucuccugcagcgucaugcacgaggcgcuccacaaccacuacacccagaagucccugagccugucccccgggaag

SEQ ID NO: 7647 - RNA, 642 nt, Artificial Sequence
  derived and/or modified sequence opt1 from Abciximab_LightChain
gacauccugaugacccagagccccuccagcauguccgugagccucggcgacaccgucuccaucacgugccacgccagccaggggaucuccagcaacaucggcuggcugcagcagaagccggggaaguccuucaugggccugaucuacuacgggaccaaccucguggacggcgugcccagccgcuucuccggcagcggguccggcgccgacuacagccugaccaucuccagccuggacuccgaggacuucgcggacuacuacugcguccaguacgcccagcuccccuacaccuucgggggcgggacgaagcuggagaucaagcgggccgacgccgcccccaccgugagcaucuucccgcccuccagcgagcagcugaccagcggcggcgcguccguggucugcuuccucaacaacuucuaccccaaggacaucaacgugaaguggaagaucgacgggagcgagcgccagaacggcgugcugaacuccuggaccgaccaggacagcaaggacuccacguacagcauguccagcacccugacccucaccaaggacgaguacgagcggcacaacuccuacacgugcgaggccacccacaagaccagcaccucccccaucgucaagagcuucaaccgcaacgagugc

SEQ ID NO: 7648 - RNA, 1341 nt, Artificial Sequence
  derived and/or modified sequence opt1 from Abituzumab_HeavyChain1
caggugcagcugcagcagagcggcggggagcucgccaagcccggcgccuccgucaaggugagcugcaaggcguccggguacaccuucagcuccuucuggaugcacugggugcgccaggccccgggccaggggcuggaguggaucggcuacaucaacccccggagcggcuacaccgaguacaacgagaucuuccgcgacaaggccacgaugaccaccgacaccuccacgagcaccgccuacauggagcuguccagccuccgguccgaggacaccgccgucuacuacugcgcgagcuuccuggggcgcggcgccauggacuacugggggcagggcaccacggugaccguguccagcgccuccaccaaggggcccagcgucuucccccuggccccgugcucccggagcaccuccgagagcacggcggcccucggcugccuggugaaggacuacuuccccgagcccgugaccgucagcuggaacuccggcgcccugaccagcggggugcacaccuuccccgccgugcuccaguccagcggccuguacucccugagcuccgucgugacggugccgagcuccaacuucgggacccagaccuacacgugcaacgucgaccacaagcccagcaacaccaagguggacaagaccguggagcccaaguccagcgacaagacccacacgugcccgcccugccccgccccgcccgucgcgggccccuccguguuccucuucccgcccaagcccaaggacacccugaugaucagccgcacccccgaggugaccugcgucgugguggacgucucccacgaggaccccgaggugcaguucaacugguacgucgacggcguggaggugcacaacgccaagaccaagccccgggaggagcaggcccagagcacguuccgcgucguguccgugcugaccgucgugcaccaggacuggcucaacgggaaggaguacaagugcaaggugagcaacaagggccugcccgccccgaucgagaagaccaucuccaagaccaaggggcagccccgggagccccaggucuacacgcugcccccgagccgcgaggagaugaccaagaaccaggugagccugaccugccucgugaagggcuucuaccccuccgacaucgccgucgagugggagagcaacgggcagcccgagaacaacuacaagaccacgccgcccaugcuggacuccgacggcagcuucuuccucuacuccaagcugaccguggacaagagccgguggcagcagggcaacguguucuccugcagcgucaugcacgaggcgcugcacaaccacuacacccagaagucccucagccugucccccgggaag

SEQ ID NO: 7649 - RNA, 642 nt, Artificial Sequence
  derived and/or modified sequence opt1 from Abituzumab_LightChain1
gacauccagaugacccagagccccuccagccuguccgccagcgugggcgaccgggucaccaucacgugccgggccucccaggacaucagcaacuaccucgcgugguaccagcagaagccggggaaggcccccaagcugcugaucuacuacaccuccaagauccacagcggcgugcccucccgcuucagcggguccggcagcgggaccgacuacaccuucacgaucuccagccuccagcccgaggacaucgccaccuacuacugccagcagggcaacaccuucccguacaccuucggccaggggacgaagguggagaucaagcggaccgucgccgcccccuccguguucaucuucccgcccagcgacgagcagcugaaguccggcaccgcgagcguggucugccugcucaacaacuucuacccccgcgaggccaaggugcaguggaagguggacaacgcccugcaguccgggaacagccaggagagcgucaccgagcaggacuccaaggacagcacguacucccugagcuccacccucacccugagcaaggccgacuacgagaagcacaagguguacgcgugcgaggugacccaccagggccuguccagccccgucacgaaguccuucaaccgcggggagugc

SEQ ID NO: 7650 - RNA, 1332 nt, Artificial Sequence
  derived and/or modified sequence opt1 from Abrilumab_HeavyChain1
caggugcagcugguccagagcggcgccgaggugaagaagcccggggccuccgugaaggucagcugcaagguguccggcuacacccucagcgaccuguccauccacugggugcgccaggcgccggggaagggccuggaguggaugggcggguucgacccccaggacggcgagaccaucuacgcccagaaguuccaggggcgggucacgaugaccgaggacaccagcaccgacacggccuacauggagcucuccagccugaaguccgaggacaccgccguguacuacugcgccaccggcagcuccagcuccugguucgaccccugggggcagggcacccuggugacggucagcuccgcgagcaccaaggggcccuccguguucccgcucgcccccugcagccgcuccaccagcgagagcaccgccgcccugggcugccuggugaaggacuacuuccccgagcccgucacgguguccuggaacagcggcgcgcucaccuccggggugcacaccuucccggccguccugcagagcuccggccuguacagccucuccagcguggugaccguccccuccagcaacuucgggacgcagaccuacacgugcaacguggaccacaagcccuccaacaccaagguggacaagaccgucgagcggaagugcugcguggagugcccgcccugccccgccccgcccguggccggccccagcgucuuccuguucccgcccaagcccaaggacacccugaugaucucccgcacccccgaggugaccugcgucgugguggacgucagccacgaggaccccgaggugcaguucaacugguacguggacggcgucgaggugcacaacgccaagacgaagccccgggaggagcaguucaacuccaccuuccgcguggucagcgugcucaccgugguccaccaggacuggcugaacgggaaggaguacaagugcaagguguccaacaagggccugcccgcgccgaucgagaagaccaucagcaagacgaaggggcagccccgggagccccagguguacacccucccgcccucccgcgaggagaugaccaagaaccaggucagccugaccugccuggugaagggcuucuaccccagcgacaucgccguggagugggaguccaacgggcagcccgagaacaacuacaagacgaccccgcccaugcucgacagcgacggcuccuucuuccuguacagcaagcugaccgucgacaagucccgguggcagcagggcaacguguucagcugcuccgugaugcacgaggcccuccacaaccacuacacccagaagucccugagccugagccccgggaag

SEQ ID NO: 7651 - RNA, 642 nt, Artificial Sequence
  derived and/or modified sequence opt1 from Abrilumab_LightChain1
gacauccagaugacccagagccccuccagcguguccgccagcgucggcgaccgcgugaccaucacgugccgggccucccaggggaucagcuccuggcuggcgugguaccagcagaagccgggcaaggcccccaagcuccugaucuacggggccagcaaccuggaguccggcgugcccagccgcuucuccgggagcggcuccggcaccgacuucacccucaccaucagcucccugcagcccgaggacuucgccaacuacuacugccagcaggccaacagcuucccguggacguucgggcagggcaccaaggucgagaucaagcggaccguggcggcccccuccguguucaucuucccgcccagcgacgagcagcugaaguccgggaccgccagcgucgugugccuccugaacaacuucuacccccgcgaggccaaggugcaguggaaggucgacaacgcgcugcagagcggcaacucccaggagagcgugacggagcaggacuccaaggacagcaccuacucccucagcuccacccugacccugagcaaggccgacuacgagaagcacaagguguacgccugcgaggucacgcaccaggggcucuccagccccgugaccaaguccuucaaccggggcgagugc

SEQ ID NO: 7652 - RNA, 639 nt, Artificial Sequence
  derived and/or modified sequence opt1 from Abrilumab_LightChain1_variant2
cagaucgugcugacccagagccccgccaucauguccgccagcccgggcgagaaggugaccaucacgugcuccgcgagcuccagcguguccuacaugaacugguuccagcagaagcccgggaccagccccaagcucuggaucuacuccaccagcaaccuggccuccggcgugcccgcccgcuucagcggguccggcagcgggaccuccuacagccugacgaucucccggauggaggccgaggacgccgcgaccuacuacugccagcagcgcagcuccuacccgaacaccuucggcggcgggaccaagcucgagaucaagcgggccgacgccgcccccacggucagcaucuucccgcccagcuccgagcagcugaccagcggcggggcguccguggugugcuuccugaacaacuucuaccccaaggacaucaacgucaaguggaagaucgacggcagcgagcgccagaacggggugcucaacuccuggaccgaccaggacagcaaggacuccaccuacagcauguccagcacgcugacccugaccaaggacgaguacgagcggcacaacuccuacacgugcgaggccacccacaagaccagcaccucccccaucgucaagagcuucaaccgcaacgagugc

SEQ ID NO: 7653 - RNA, 1347 nt, Artificial Sequence
  derived and/or modified sequence opt1 from Actoxumab_HeavyChain1
gaggugcagcugguccagagcggcgccgaggugaagaaguccggggagagccucaagaucuccugcaagggcagcggguacuccuucaccagcuacuggaucggcugggugcgccagaugcccgggaagggccuggaguggaugggcaucuucuacccgggggacuccagcacccgguacucccccagcuuccagggccaggucacgaucuccgccgacaagagcgugaacaccgcguaccugcagugguccagccucaaggccuccgacaccgccauguacuacugcgcccgccggcgcaacugggggaacgccuucgacaucuggggccaggggaccauggugacggucagcuccgcgagcaccaagggccccuccguguucccccuggccccgagcagcaaguccaccagcggcgggaccgccgcccugggcugccucgugaaggacuacuuccccgagcccgucacgguguccuggaacagcggggcgcugaccuccggcgugcacaccuuccccgccguccugcagagcuccggccucuacagccuguccagcguggugaccgucccguccagcucccuggggacgcagaccuacaucugcaacgugaaccacaagcccagcaacaccaagguggacaagcgggucgagcccaaguccugcgacaagacccacacgugcccgcccugccccgcccccgagcuccugggcgggcccagcguguuccuguucccgcccaagcccaaggacacccucaugaucucccgcacccccgaggugaccugcgucgugguggacgucagccacgaggacccggaggugaaguucaacugguacgucgacggcguggaggugcacaacgccaagacgaagccccgggaggagcaguacaacuccaccuaccgcgucgugagcgugcugaccguccugcaccaggacuggcucaacgggaaggaguacaagugcaaggugagcaacaaggcccugcccgcgcccaucgagaagaccaucuccaaggccaagggccagccgcgggagccccagguguacacgcugccgcccagccgcgaggagaugaccaagaaccaggucucccugaccugccucgugaagggcuucuaccccagcgacaucgccguggagugggaguccaacgggcagcccgagaacaacuacaagaccacgcccccgguccuggacagcgacggcuccuucuuccucuacagcaagcugaccguggacaagucccgguggcagcaggggaacguguucagcugcuccgucaugcacgaggcccugcacaaccacuacacccagaagucccucagccugagccccggcaag

SEQ ID NO: 7654 - RNA, 645 nt, Artificial Sequence
  derived and/or modified sequence opt1 from Actoxumab_LightChain1
gagaucgugcugacccagagccccggcacccucucccugagcccgggggagcgcgccacgcuguccugccgggccagccaguccgucagcuccagcuaccucgcgugguaccagcagaagcccggccaggcgccccgccugcugaucuacggggccuccagccgggccaccggcauccccgaccgcuucuccgggagcggcuccggcaccgacuucacccucacgaucagccggcuggagccggaggacuucgccguguacuacugccagcaguacggguccagcaccuggaccuucggccaggggaccaagguggagaucaagcgcacggucgccgcccccuccguguucaucuucccgcccagcgacgagcagcugaaguccggcaccgccagcguggucugccuccugaacaacuucuacccccgggaggccaaggugcaguggaagguggacaacgcgcugcagagcgggaacucccaggagagcgucaccgagcaggacuccaaggacagcaccuacucccucagcuccacgcugacccugagcaaggccgacuacgagaagcacaagguguacgccugcgaggugacccaccagggccucuccagccccgucaccaaguccuucaaccgcggcgagugc

SEQ ID NO: 7655 - RNA, 672 nt, Artificial Sequence
  derived and/or modified sequence opt1 from Adalimumab_HeavyChain
gaggugcagcuggucgagagcggcgggggccucgugcagcccgggcgcucccugcggcugagcugcgccgccuccggcuucaccuucgacgacuacgcgaugcacugggugcgccaggccccggggaagggccucgagugggucagcgccaucaccuggaacuccggccacaucgacuacgccgacagcguggaggggcgguucacgaucucccgcgacaacgccaagaacagccuguaccugcagaugaacucccuccgggcggaggacaccgccguguacuacugcgccaaggucagcuaccuguccaccgccagcucccuggacuacuggggccaggggacccucgugacggugagcuccgcgagcaccaagggccccuccgucuucccccuggcccccagcuccaagagcaccagcgggggcaccgccgcccugggcugccucgugaaggacuacuucccggagcccgugacggucuccuggaacagcggggcccugaccuccggcgugcacaccuuccccgcggugcugcagagcuccgggcucuacagccuguccagcgucgugaccgugcccuccagcucccugggcacgcagaccuacaucugcaacgucaaccacaagccgagcaacaccaagguggacaagaagguggagcccaaguccugc

SEQ ID NO: 7656 - RNA, 642 nt, Artificial Sequence
  derived and/or modified sequence opt1 from Adalimumab_LightChain
gacauccagaugacccagagccccuccagccuguccgccagcgugggcgaccgcgucaccaucacgugccgggccucccaggggauccgcaacuaccucgcgugguaccagcagaagccgggcaaggcccccaagcugcugaucuacgccgccagcacccuccaguccggggugcccagccgguucuccggcagcggguccggcaccgacuucacccugacgaucagcucccugcagcccgaggacguggccaccuacuacugccagcgcuacaaccgggcgccguacaccuucggccaggggaccaaggucgagaucaagcgcacgguggccgcccccagcguguucaucuucccgcccuccgacgagcagcucaagagcggcaccgccuccgucgugugccugcugaacaacuucuacccccgggaggcgaaggugcaguggaaggucgacaacgcccuccagagcgggaacucccaggagagcgugaccgagcaggacagcaaggacuccaccuacagccuguccagcacgcugacccucuccaaggccgacuacgagaagcacaagguguacgccugcgaggucacccaccagggccugagcucccccgugaccaagagcuucaaccgcggggagugc

SEQ ID NO: 7657 - RNA, 1359 nt, Artificial Sequence
  derived and/or modified sequence opt1 from Aducanumab_HeavyChain1
caggugcagcuggucgagagcggcgggggcguggugcagcccgggcgcucccuccggcugagcugcgccgccuccggcuucgcguucagcuccuacgggaugcacuggguccgccaggccccgggcaagggccuggaguggguggccgugaucugguucgacgggaccaagaaguacuacaccgacagcgucaagggccgguucacgaucucccgcgacaacagcaagaacacccucuaccugcagaugaacacccugcgggccgaggacaccgccguguacuacugcgcgcgcgaccgggggaucggcgcccgccgggggcccuacuacauggacguguggggcaagggcacgaccgucaccguguccagcgccuccaccaaggggcccagcguguucccccucgccccguccagcaaguccacgagcggcgggaccgcggcccugggcugccuggucaaggacuacuuccccgagcccgugaccguguccuggaacagcggcgcccucaccuccgggguccacacguuccccgccgugcugcagagcagcggccuguacucccucagcuccguggucaccgugccgagcuccagccuggggacccagaccuacaucugcaacgugaaccacaagcccuccaacacgaaggucgacaagcgcguggagcccaagagcugcgacaagacccacacgugcccgcccugccccgcccccgagcugcucggcgggcccuccguguuccuguucccgcccaagcccaaggacacccugaugaucagccggacccccgaggugaccugcgucgucguggacgugucccacgaggacccggaggucaaguucaacugguacguggacggcguggagguccacaacgcgaagaccaagccccgcgaggagcaguacaacagcaccuaccgggugguguccguccucacggugcugcaccaggacuggcugaacggcaaggaguacaagugcaaggugagcaacaaggcccuccccgcccccaucgagaagaccaucuccaaggccaaggggcagccgcgcgagccccaggucuacacccugccgcccagccgggaggagaugaccaagaaccaggugucccugacgugccucgugaagggcuucuaccccagcgacaucgccgucgagugggaguccaacgggcagcccgagaacaacuacaagaccacgcccccggugcuggacagcgacggcagcuucuuccuguacuccaagcucaccguggacaagagccgcuggcagcaggggaacgucuucuccugcagcgugaugcacgaggcgcugcacaaccacuacacccagaagucccugagccucucccccggc

SEQ ID NO: 7658 - RNA, 642 nt, Artificial Sequence
  derived and/or modified sequence opt1 from Aducanumab_LightChain1
gacauccagaugacccagagccccuccagccuguccgccagcgugggcgaccgggucaccaucacgugccgggccucccagagcaucuccagcuaccucaacugguaccagcagaagccggggaaggcgcccaagcugcugaucuacgccgccuccagccuccaguccggcgugcccagccgcuucuccgggagcggcuccgggaccgacuucacccugaccaucagcucccugcagcccgaggacuucgccacguacuacugccagcagagcuacuccaccccgcucaccuucggcggcgggaccaagguggagaucaagcggacggucgccgcgcccagcguguucaucuucccgcccagcgacgagcagcugaaguccggcaccgccagcguggucugccugcucaacaacuucuacccccgcgaggccaaggugcaguggaagguggacaacgcccugcaguccgggaacagccaggaguccgucaccgagcaggacagcaaggacuccaccuacagccuguccagcacgcucacccuguccaaggcggacuacgagaagcacaagguguacgccugcgaggugacccaccagggccugagcucccccgucaccaagagcuucaaccgcggggagugc

SEQ ID NO: 7659 - RNA, 1359 nt, Artificial Sequence
  derived and/or modified sequence opt1 from Afasevikumab_HeavyChain1
gaggugcagcuggucgagagcggcgggggccucgugcagcccgggcgcucccugcggcugagcugcgccgccuccggcuucaccuucgacgacuacgcgaugcacugggugcgccaggccccggggaagggccucgagugggucagcggcaucaacugguccagcgggggcaucggguacgccgacuccgugaagggccgguucaccaucagccgcgacaacgccaagaacucccuguaccugcagaugaacagccuccgggccgaggacacggcgcuguacuacugcgcccgcgacaucgggggcuucggcgaguucuacuggaacuucgggcuguggggccgggggacccucgugaccgucuccagcgccuccaccaagggccccagcguguucccccuggcccccuccagcaaguccacgagcggcgggaccgcggcccugggcugccucgugaaggacuacuucccggagcccgucaccguguccuggaacagcggggcccugaccagcggcgugcacacguuccccgccguccugcaguccagcgggcucuacucccugagcuccguggugaccguccccagcuccagccugggcacccagaccuacaucugcaacgugaaccacaagccguccaacacgaagguggacaagcgcgucgagcccaagagcugcgacaagacccacacgugcccgcccugcccggcccccgagcuccugggcgggcccuccguguuccuguucccgcccaagcccaaggacacccucaugaucagccggacccccgaggugaccugcgucgugguggacgucucccacgaggaccccgaggugaaguucaacugguacgucgacggcguggaggugcacaacgcgaagaccaagccgcgcgaggagcaguacaacagcaccuaccgggucguguccgugcugacgguccugcaccaggacuggcucaacgggaaggaguacaagugcaaggugagcaacaaggcccugcccgcccccaucgagaagaccaucuccaaggccaagggccagccccgcgagccccagguguacacccugccgcccagccgggaggagaugaccaagaaccaggucucccucacgugccuggugaagggguucuaccccagcgacaucgccguggagugggagagcaacggccagcccgagaacaacuacaagaccaccccgcccguccuggacuccgacggcagcuucuuccucuacuccaagcugaccguggacaagagccgcuggcagcaggggaacguguucuccugcagcgucaugcacgaggcgcugcacaaccacuacacgcagaagucccucagccugucccccggcaag

SEQ ID NO: 7660 - RNA, 645 nt, Artificial Sequence
  derived and/or modified sequence opt1 from Afasevikumab_LightChain1
gagaucgugcugacccagagccccgccacccucucccugagccccggcgagcgggccacgcuguccugccgggcgagccaguccguccgcagcuaccucgccugguaccagcagaagcccgggcaggcgccccggcugcugaucuacgacgccuccaaccgcgccaccggcauccccgcccgguucagcggguccggcagcgggaccgacuucacccucacgaucuccagccuggagccggaggacuucgccguguacuacugccagcagcgcuccaacuggccgcccgccaccuucggcggcgggaccaagguggagaucaagcggaccgucgccgcgcccagcguguucaucuucccgcccuccgacgagcagcucaagagcggcacggccuccguggucugccugcugaacaacuucuacccccgcgaggccaaggugcaguggaagguggacaacgcccugcagagcgggaacucccaggagagcgucaccgagcaggacagcaaggacuccaccuacagccucuccagcacccugacgcuguccaaggccgacuacgagaagcacaagguguacgcgugcgaggugacccaccagggccucagcucccccgucaccaagagcuucaaccgcggggagugc

SEQ ID NO: 7661 - RNA, 1293 nt, Artificial Sequence
  derived and/or modified sequence opt1 from Aflibercept_Fusion_protein1
agcgacaccggccgccccuucguggagauguacuccgagaucccggagaucauccacaugaccgaggggcgggagcuggucauccccugccgcgugacgagccccaacaucaccgugacccucaagaaguucccccuggacacccugaucccggacggcaagcggaucaucugggacucccgcaagggguucaucaucagcaacgccacguacaaggagaucggccuccugaccugcgaggccaccgucaacgggcaccuguacaagaccaacuaccucacgcaccggcagaccaacaccaucaucgacguggugcugucccccagccacggcaucgagcuguccgucggcgagaagcucgugcugaacugcaccgcgcgcacggagcugaacguggggaucgacuucaacugggaguaccccagcuccaagcaccagcacaagaagcucgucaaccgggaccugaagacccagagcggcuccgagaugaagaaguuccugagcacccucaccaucgacggggugacgcgcuccgaccagggccuguacacgugcgccgccagcuccgggcugaugaccaagaagaacagcaccuucgugcggguccacgagaaggacaagacccacacgugcccgcccugccccgcccccgagcuccugggcggccccuccguguuccuguucccgcccaagcccaaggacacccucaugaucagccgcacccccgaggugaccugcgucgugguggacgucucccacgaggacccggaggugaaguucaacugguacguggacggggucgaggugcacaacgccaagaccaagccccgggaggagcaguacaacagcaccuaccgcguggucagcgugcugaccguccugcaccaggacuggcucaacggcaaggaguacaagugcaagguguccaacaaggcgcugcccgcccccaucgagaagacgaucagcaaggccaaggggcagccgcgggagccccagguguacacccugccgcccucccgcgacgagcucaccaagaaccaggucagccugaccugccuggugaagggcuucuaccccuccgacaucgccguggagugggagagcaacggccagcccgagaacaacuacaagacgaccccgcccguccucgacuccgacgggagcuucuuccuguacuccaagcugaccguggacaagagccgguggcagcagggcaacguguucuccugcagcgucaugcacgaggcgcuccacaaccacuacacccagaagucccugagccugucccccggg

SEQ ID NO: 7662 - RNA, 1332 nt, Artificial Sequence
  derived and/or modified sequence opt1 from Afutuzuab_HeavyChain1
caggugcagcugguccagagcggcgccgaggugaagaagcccggguccagcgugaaggucuccugcaaggccagcggcuacgcguucuccuacagcuggaucaacugggugcgccaggccccggggcagggccucgagugggggcggaucuuccccggcgacggcgacaccgacuacaacgggaaguucaagggccgcgugaccaucaccgccgacaaguccaccagcaccgccuacgagcuguccagccugcgguccgaggacaccgccgucuacuacugcgcgcgcaacguguucgacggguacuggcucguguacuggggccaggggacgcuggucaccgugagcuccgccagcaccaagggccccuccguguucccccuggccccgagcuccaagagcaccuccggcgggacggccgcgcucggcugccuggucaaggacuacuuccccgagcccgugaccgugagcuggaacagcggggcccugaccuccggcguccacaccuuccccgccgugcuccagagcuccggccuguacagccuguccagcguggucacggugccguccagcucccucgggacccagaccuacaucugcaacgugaaccacaagcccagcaacaccaaggucgacaagaagguggagcccaaguccugcgacaagacgcacacgugcccgcccugccccgcccccgagcugcugggcgggcccagcguguuccucuucccgcccaagcccaaggacacccugaucucccggacccccgaggugaccugcgucgucguggacgugagccacgaggacccggaggucaaguucaacugguacguggacggcguggagguccacaacgccaagaccaagccccgcgaggagcaguacaacuccaccuaccggguggugagcguccugaccgugcuccaccaggacuggcugaacgggaaggaguacaagugcaagguguccaacaaggcgcugcccgcccccaucgagaagacgaucagcaaggccaagggccagccgcgcgagccccaggucuacacccucccgcccucccgggacgagcugaccaagaaccaggugagccugaccugccucgugaagggcuucuaccccagcgacaucgccgucgagugggaguccaacgggcagcccgagaacaacuacaagacgacgcccccggugcuggacagcgacggcuccuucuuccuguacagcaagcucaccguggacaagucccgcuggcagcaggggaacgucuucagcugcuccgugcacgaggcccugcacaaccacuacacccagaagucccugagccucagccccggc

SEQ ID NO: 7663 - RNA, 651 nt, Artificial Sequence
  derived and/or modified sequence opt1 from Afutuzuab_LightChain1
gacaucgugacccagacgccccugagccucccggucacccccggcgagcccgccuccaucagcugccgcuccagcaagucccugcugcacagcaacgggaucaccuaccucuacugguaccugcagaagcccggccaguccccgcagcugcucaucuaccagagcaaccugguguccggggugcccgaccgguucagcggcuccgggagcggcaccgacuucacccugaagaucucccgcgucgaggccgaggacgugggcguguacuacugcgcgcagaaccucgagcugcccuacacguucgggggcgggaccaaggucgagaucaagcggaccguggccgcccccagcguguucaucuucccgcccuccgacgagcagcucaagagcggcaccgccuccgucgugugccugcugaacaacuucuacccccgcgaggccaaggugcaguggaaggucgacaacgcgcugcagagcgggaacucccaggagagcgugacggagcaggacagcaaggacuccaccuacagccucuccagcacccugacccuguccaaggccgacuacgagaagcacaagguguacgccugcgaggucacgcaccagggccucagcucccccgugaccaagagcuucaaccggggcgagugc

SEQ ID NO: 7664 - RNA, 1347 nt, Artificial Sequence
  derived and/or modified sequence opt1 from Afutuzumab_HeavyChain1
caggugcagcugguccagagcggcgccgaggugaagaagcccggguccagcgugaaggucuccugcaaggccagcggcuacgcguucuccuacagcuggaucaacugggugcgccaggccccggggcagggccucgaguggauggggcggaucuuccccggcgacggcgacaccgacuacaacgggaaguucaagggccgcgugaccaucaccgccgacaaguccaccagcaccgccuacauggagcuguccagccugcgguccgaggacaccgccgucuacuacugcgcgcgcaacguguucgacggguacuggcucguguacuggggccaggggacgcuggucaccgugagcuccgccagcaccaagggccccuccguguucccccuggccccgagcuccaagagcaccuccggcgggacggccgcgcucggcugccuggucaaggacuacuuccccgagcccgugaccgugagcuggaacagcggggcccugaccuccggcguccacaccuuccccgccgugcuccagagcuccggccuguacagccuguccagcguggucacggugccguccagcucccucgggacccagaccuacaucugcaacgugaaccacaagcccagcaacaccaaggucgacaagaagguggagcccaaguccugcgacaagacgcacacgugcccgcccugccccgcccccgagcugcugggcgggcccagcguguuccucuucccgcccaagcccaaggacacccugaugaucucccggacccccgaggugaccugcgucgucguggacgugagccacgaggacccggaggucaaguucaacugguacguggacggcguggagguccacaacgccaagaccaagccccgcgaggagcaguacaacuccaccuaccggguggugagcguccugaccgugcuccaccaggacuggcugaacgggaaggaguacaagugcaagguguccaacaaggcgcugcccgcccccaucgagaagacgaucagcaaggccaagggccagccgcgcgagccccaggucuacacccucccgcccucccgggacgagcugaccaagaaccaggugagccugaccugccucgugaagggcuucuaccccagcgacaucgccgucgagugggaguccaacgggcagcccgagaacaacuacaagacgacgcccccggugcuggacagcgacggcuccuucuuccuguacagcaagcucaccguggacaagucccgcuggcagcaggggaacgucuucagcugcuccgugaugcacgaggcccugcacaaccacuacacccagaagucccugagccucagccccggcaag

SEQ ID NO: 7665 - RNA, 657 nt, Artificial Sequence
  derived and/or modified sequence opt1 from Afutuzumab_LightChain1
gacaucgugaugacccagacgccccugagccucccggucacccccggcgagcccgccuccaucagcugccgcuccagcaagucccugcugcacagcaacgggaucaccuaccucuacugguaccugcagaagcccggccaguccccgcagcugcucaucuaccagaugagcaaccugguguccggggugcccgaccgguucagcggcuccgggagcggcaccgacuucacccugaagaucucccgcgucgaggccgaggacgugggcguguacuacugcgcgcagaaccucgagcugcccuacacguucgggggcgggaccaaggucgagaucaagcggaccguggccgcccccagcguguucaucuucccgcccuccgacgagcagcucaagagcggcaccgccuccgucgugugccugcugaacaacuucuacccccgcgaggccaaggugcaguggaaggucgacaacgcgcugcagagcgggaacucccaggagagcgugacggagcaggacagcaaggacuccaccuacagccucuccagcacccugacccuguccaaggccgacuacgagaagcacaagguguacgccugcgaggucacgcaccagggccucagcucccccgugaccaagagcuucaaccggggcgagugc

SEQ ID NO: 7666 - RNA, 684 nt, Artificial Sequence
  derived and/or modified sequence opt1 from Alacizumab_pegol_HeavyChain1
gaggugcagcuggucgagagcggcgggggccucgugcagcccgggggcucccugcgccugagcugcgccgccuccggguucaccuucagcuccuacggcaugagcugggugcggcaggcgccgggcaaggggcucgagugggucgccaccaucaccuccggcgggagcuacaccuacuacguggacuccgugaagggccgcuucaccaucagccgggacaacgccaagaacacccuguaccugcagaugaacucccuccgcgccgaggacacggccgucuacuacugcgugcggaucggggaggacgcgcuggacuacuggggccagggcacccuggugaccgucagcuccgccagcaccaaggggcccuccguguucccccucgcccccagcuccaagagcacguccggcgggaccgccgcgcugggcugccuggugaaggacuacuucccggagcccgucaccgugagcuggaacagcggcgcccucaccuccggggugcacacguuccccgccguccugcagagcuccggccuguacagccucuccagcguggugaccguccccuccagcucccuggggacccagaccuacaucugcaacgugaaccacaagccgagcaacacgaagguggacaagaaggucgagcccaaguccugcgacaagacccacacgugcgccgcc

SEQ ID NO: 7667 - RNA, 642 nt, Artificial Sequence
  derived and/or modified sequence opt1 from Alacizumab_pegol_LightChain1
gacauccagaugacccagagccccuccagccuguccgccagcgugggcgaccgggucaccaucacgugccgggccucccaggacaucgcggggagccucaacuggcugcagcagaagccgggcaaggccaucaagcgccugaucuacgccaccuccagccucgacuccggggugcccaagcgguucagcggcucccgcagcggguccgacuacacccugaccaucagcucccugcagcccgaggacuucgccacguacuacugccuccaguacggcagcuucccgcccaccuucggccaggggaccaagguggagaucaagcggaccgucgccgcgcccuccguguucaucuucccgcccagcgacgagcagcugaaguccggcacggccagcguggucugccugcucaacaacuucuacccccgcgaggccaaggugcaguggaagguggacaacgcccugcagagcgggaacucccaggagagcgucaccgagcaggacuccaaggacagcaccuacucccugagcuccacccucacgcugagcaaggcggacuacgagaagcacaagguguacgccugcgaggugacccaccagggccuguccagccccgucaccaaguccuucaaccgcggggagugc

SEQ ID NO: 7668 - RNA, 1353 nt, Artificial Sequence
  derived and/or modified sequence opt1 from Alemtuzumab_HeavyChain
caggugcagcugcaggagagcggccccgggcucguccgcccgucccagacccugagccugaccugcacgguguccggcuucaccuucaccgacuucuacaugaacugggugcggcagccgcccgggcgcggccucgaguggaucggguucauccgggacaaggccaagggcuacaccacggaguacaaccccagcgucaagggccgcgugaccaugcugguggacaccuccaagaaccaguucagccugcggcucuccagcgucaccgccgcggacacggccguguacuacugcgcccgcgaggggcacaccgccgccccguucgacuacuggggccaggggucccuggugaccgucagcuccgcgagcaccaagggccccuccguguucccccuggcccccagcuccaagagcacguccgggggcaccgccgcccucggcugccuggugaaggacuacuucccggagcccgucaccgugagcuggaacuccggggcgcugaccagcggcgugcacacguuccccgccguccuccagagcuccgggcuguacagccuguccagcguggugaccguccccuccagcucccucggcacccagaccuacaucugcaacgugaaccacaagccgagcaacacgaagguggacaagaaggucgagcccaaguccugcgacaagacccacacgugcccgcccugccccgcccccgagcugcugggcgggcccagcguguuccucuucccgcccaagcccaaggacacccugaugaucucccggacccccgaggugaccugcgucguggucgacgugagccacgaggaccccgaggugaaguucaacugguacgucgacggcguggaggugcacaacgccaagaccaagccgcgcgaggagcaguacaacuccaccuaccgggucgugagcgugcugacgguccuccaccaggacuggcugaacgggaaggaguacaagugcaagguguccaacaaggcccugcccgcgcccaucgagaagaccaucagcaaggccaagggccagccccgcgagccccagguguacacccucccgcccucccgggacgagcugaccaagaaccaggucagccugacgugccucgugaagggguucuaccccuccgacaucgccguggagugggagagcaacggccagcccgagaacaacuacaagaccaccccgcccguccuggacagcgacggcuccuucuuccuguacagcaagcucaccguggacaagucccgcuggcagcaggggaacguguucagcugcuccgucaugcacgaggcccugcacaaccacuacacgcagaagucccugagccucagccccggcaag

SEQ ID NO: 7669 - RNA, 657 nt, Artificial Sequence
  derived and/or modified sequence opt1 from Alemtuzumab_HeavyChain_variant_1bey_H
caggugcagcugcaggagagcggccccgggcucguccgcccgucccagacccugagccugaccugcacgguguccggcuucaccuucaccgacuucuacaugaacugggugcggcagccgcccgggcgcggccucgaguggaucggguucauccgggacaaggccaagggcuacaccacggaguacaaccccagcgucaagggccgcgugaccaugcugguggacaccuccaagaaccaguucagccugcggcucuccagcgucaccgccgcggacacggccguguacuacugcgcccgcgaggggcacaccgccgcccccuucgacuacuggggccaggggucccuggugaccgucagcuccgcgagcaccaagggccccuccguguucccccuggcccccagcuccaagagcacguccgggggcaccgccgcccucggcugccuggugaaggacuacuucccggagcccgucaccgugagcuggaacuccggggcgcugaccagcggcgugcacacguuccccgccguccuccagagcuccgggcuguacagccuguccagcguggugaccguccccuccagcucccucggcacccagaccuacaucugcaacgugaaccacaagccgagcaacacgaagguggacaagaagguc

SEQ ID NO: 7670 - RNA, 660 nt, Artificial Sequence
  derived and/or modified sequence opt1 from Alemtuzumab_HeavyChain_variant_1ce1_H
caggugcagcugcaggagagcggccccgggcucguccgcccgucccagacccugagccugaccugcacgguguccggcuucaccuucaccgacuucuacaugaacugggugcggcagccgcccgggcgcggccucgaguggaucggguucauccgggacaaggccaagggcuacaccacggaguacaaccccagcgucaagggccgcgugaccaugcugguggacaccuccaagaaccaguucagccugcggcucuccagcgucaccgccgcggacacggccguguacuacugcgcccgcgaggggcacaccgccgcccccuucgacuacuggggccaggggucccuggugaccgucagcuccgcgagcaccaagggccccuccguguucccccuggcccccagcuccaagagcacguccgggggcaccgccgcccucggcugccuggugaaggacuacuucccggagcccgucaccgugagcuggaacuccggggcgcugaccagcggcgugcacacguuccccgccguccuccagagcuccgggcuguacagccuguccagcguggugaccguccccuccagcucccucggcacccagaccuacaucugcaacgugaaccacaagccgagcaacacgaagguggacaagaaggucgag

SEQ ID NO: 7671 - RNA, 1311 nt, Artificial Sequence
  derived and/or modified sequence opt1 from Alemtuzumab_HeavyChain_variant_8005_H
caggugcagcugcaggagagcggccccgggcucguccgcccgucccagacccugagccugaccugcacgguguccggcuucaccuucaccgacuucuacaugaacugggugcggcagccgcccgggcgcggccucgaguggaucggguucauccgggacaaggccaagggcuacaccacggaguacaaccccagcgucaagggccgcgugaccaugcugguggacaccuccaagaaccaguucagccugcggcucuccagcgucaccgccgcggacacggccguguacuacugcgcccgcgaggggcacaccgccgccccguucgacuacuggggccaggggucccuggugaccgucagcuccgcgagcaccaagggccccuccguguucccccuggcccccagcuccaagagcacguccgggggcaccgccgcccucggcugccuggugaaggacuacuucccggagcccgucaccgugagcuggaacuccggggcgcugaccagcggcgugcacacguuccccgccguccuccagagcuccgggcuguacagccuguccagcguggugaccguccccuccagcucccucggcacccagaccuacaucugcaacgugaaccacaagccgagcaacacgaagguggacaagaaggucgaggcccccgagcugcugggcgggcccuccguguuccucuucccgcccaagcccaaggacacccugaugaucagccggacccccgaggugaccugcgucguggucgacgugucccacgaggaccccgaggugaaguucaacugguacgucgacggcguggaggugcacaacgccaagacgaagccgcgcgaggagcaguacaacagcaccuaccgggucguguccgugcugaccguccuccaccaggacuggcugaacgggaaggaguacaagugcaaggugagcaacaaggcccugcccgcgcccaucgagaagaccaucuccaaggccaagggccagccccgcgagccccagguguacacgcucccgcccagccgggacgagcugaccaagaaccaggucucccugaccugccucgugaagggguucuaccccagcgacaucgccguggagugggaguccaacggccagcccgagaacaacuacaagaccacgccgcccguccuggacagcgacggcagcuucuuccuguacuccaagcucaccguggacaagagccgcuggcagcaggggaacguguucuccugcagcgucaugcacgaggcccugcacaaccacuacacccagaagucccugagccucucccccggcaag

SEQ ID NO: 7672 - RNA, 633 nt, Artificial Sequence
  derived and/or modified sequence opt1 from Alemtuzumab_LightChain
gacauccagaugacccagagccccuccagccuguccgccagcgugggcgaccgcgucaccaucacgugcaaggccucccagaacaucgacaaguaccucaacugguaccagcagaagccggggaaggcgcccaagcugcugaucuacaacaccaacaaccuccagaccggcgugcccagccgguucuccgggagcggcuccgggaccgacuucacguucaccaucagcucccugcagcccgaggacaucgccaccuacuacugccugcagcacaucagccgcccgcggaccuucggccagggcacgaagguggagaucaagcgcaccgucgccgcccccuccguguucaucuucccgcccagcgacgagcagcucaaguccgggaccgccagcguggucugccugcugaacaacuucuacccccgggaggcgaaggugcaguggaagguggacaacgcccuccaguccggcaacagccaggaguccgucaccgagcaggacagcaaggacagcacguacucccugagcuccacccugacccucagcaaggccgacuacgagaagcacaagguguacgccugcgaggugacccaccaggggcuguccagccccgucacgaaguccuucaaccgc

SEQ ID NO: 7673 - RNA, 642 nt, Artificial Sequence
  derived and/or modified sequence opt1 from Alemtuzumab_LightChain_variant_8005_L
gacauccagaugacccagagccccuccagccuguccgccagcgugggcgaccgcgucaccaucacgugcaaggccucccagaacaucgacaaguaccucaacugguaccagcagaagccggggaaggcgcccaagcugcugaucuacaacaccaacaaccuccagaccggcgugcccagccgguucuccgggagcggcuccgggaccgacuucacguucaccaucagcucccugcagcccgaggacaucgccaccuacuacugccugcagcacaucagccgcccgcggaccuucggccagggcacgaagguggagaucaagcgcaccgucgccgcccccuccguguucaucuucccgcccagcgacgagcagcucaaguccgggaccgccagcguggucugccugcugaacaacuucuacccccgggaggcgaaggugcaguggaagguggacaacgcccuccaguccggcaacagccaggaguccgucaccgagcaggacagcaaggacagcacguacucccugagcuccacccugacccucagcaaggccgacuacgagaagcacaagguguacgccugcgaggugacccaccaggggcuguccagccccgucacgaaguccuucaaccgcggcgagugc

SEQ ID NO: 7674 - RNA, 1341 nt, Artificial Sequence
  derived and/or modified sequence opt1 from Alirocumab_HeavyChain1
gaggugcagcuggucgagagcggcgggggccucgugcagcccgggggcucccugcgccugagcugcgccgccuccggguucaccuucaacaacuacgcgaugaacugggugcggcaggccccgggcaagggccucgacugggucagcaccaucuccgggagcggcgggacgaccaacuacgccgacuccgugaagggccgcuucaucaucagccgggacuccagcaagcacacccuguaccugcagaugaacucccuccgcgccgaggacaccgccguguacuacugcgcgaaggacagcaacugggggaacuucgaccuguggggccggggcacgcuggucaccguguccagcgccuccaccaaggggcccagcguguucccccucgcccccuccagcaaguccaccagcggcgggacggccgcgcugggcugccuggucaaggacuacuucccggagcccgugaccgugagcuggaacuccggcgcccucaccagcgggguccacaccuuccccgccgugcugcaguccagcggccuguacucccucagcuccguggucacggugcccagcuccagccuggggacccagaccuacaucugcaacgugaaccacaagccguccaacaccaaggucgacaagaagguggagcccaagagcugcgacaagacgcacacgugcccgcccugccccgcccccgagcugcucggcgggcccuccguguuccuguucccgcccaagcccaaggacacccugaugaucagccgcacccccgaggugaccugcgucguggucgacgugucccacgaggaccccgaggucaaguucaacugguacguggacggcguggagguccacaacgccaagaccaagccgcgggaggagcaguacaacagcaccuaccgcgugguguccguccucaccgugcugcaccaggacuggcugaacggcaaggaguacaagugcaaggugagcaacaaggcgcuccccgcccccaucgagaagacgaucuccaaggccaaggggcagccccgggagccgcaggucuacacccugccgcccagccgcgacgagcugaccaagaaccaggugagccugaccugccucgugaagggcuucuaccccuccgacaucgccgucgagugggagagcaacgggcagcccgagaacaacuacaagacgaccccgcccgugcuggacuccgacggcagcuucuuccucuacuccaagcugaccguggacaagagccgguggcagcaggggaacgucuucuccugcagcgugaugcacgaggcccugcacaaccacuacacccagaagucccucagccugucccccggc

SEQ ID NO: 7675 - RNA, 660 nt, Artificial Sequence
  derived and/or modified sequence opt1 from Alirocumab_LightChain1
gacaucgugaugacccagagccccgacucccuggccgucagccucggcgagcgggccaccaucaacugcaaguccagccaguccgugcuguaccggagcaacaaccgcaacuuccuggggugguaccagcagaagccgggccagccgcccaaccuccugaucuacugggcguccacgcgggagagcggggugcccgaccgcuucuccggcagcggguccggcaccgacuucacccugaccaucagcucccuccaggccgaggacgucgccguguacuacugccagcaguacuacacgacccccuacaccuucggccaggggaccaagcuggagaucaagcggacgguggccgcccccagcgucuucaucuucccgcccuccgacgagcagcucaagagcggcaccgcguccguggugugccugcugaacaacuucuacccccgcgaggccaagguccaguggaagguggacaacgcccugcagagcgggaacucccaggagagcgugaccgagcaggacagcaaggacuccaccuacagccucuccagcacgcugacccuguccaaggccgacuacgagaagcacaaggucuacgcgugcgaggugacccaccagggccucagcucccccgugaccaagagcuucaaccgcggggagugc

SEQ ID NO: 7676 - RNA, 735 nt, Artificial Sequence
  derived and/or modified sequence opt1 from ALX-0061_HeavyChain1
gaggugcagcuggucgagagcggcgggggccucgugcagcccgggggcucccugcgccugagcugcgccgccuccgggagcguguucaagaucaacgucauggcgugguaccggcaggccccgggcaagggccgcgagcucguggccgggaucaucuccggcgggagcaccuccuacgccgacagcgugaagggccgguucaccaucucccgcgacaacgccaagaacacgcuguaccugcagaugaacagccuccggcccgaggacaccgcggucuacuacugcgccuucaucaccaccgaguccgacuacgaccuggggcgccgguacuggggccagggcacgcuggugaccgugagcuccgggggcgggggcagcggcgggggcuccgagguccagcucguggagagcgggggcgggcuggugcagcccggcaacucccugcgccucagcugcgccgccuccggcuucaccuucagcagcuucgggauguccuggguccggcaggcgcccggcaaggggcuggagugggugagcuccaucagcggcuccgggagcgacacccuguacgccgacuccgugaagggccgcuucacgaucagccgggacaacgccaagaccacccucuaccugcagaugaacucccugcgcccggaggacaccgccgucuacuacugcacgaucggcgggagccucucccggagcucccagggcacccuggugaccgugagcucc

SEQ ID NO: 7677 - RNA, 1347 nt, Artificial Sequence
  derived and/or modified sequence opt1 from Amatuximab_HeavyChain1
caggugcagcugcagcagagcggccccgagcucgagaagccgggggccuccgucaagaucagcugcaaggccuccggcuacagcuucaccggguacaccaugaacugggugaagcagucccacggcaagagccuggaguggaucgggcugaucacgcccuacaacggcgcguccagcuacaaccagaaguuccgcggcaaggccacccucaccguggacaaguccagcuccaccgccuacauggaccugcugagccucacguccgaggacagcgccgucuacuucugcgcccgcgggggcuacgacgggcggggcuucgacuacuggggguccggcacccccgugaccgugagcuccgcgagcaccaagggccccuccgucuucccgcuggcccccagcagcaaguccacgagcgggggcaccgccgcccuggggugccucgugaaggacuacuuccccgagcccgugaccgucuccuggaacagcggcgcgcugaccuccggcgugcacacguucccggccgugcugcagagcuccgggcucuacagccuguccagcgucgugaccgugcccuccagcucccugggcacccagaccuacaucugcaacgucaaccacaagcccagcaacacgaagguggacaagaagguggagcccaaguccugcgacaagacccacacgugcccgcccugccccgcccccgagcuccucgggggcccgagcgucuuccuguucccgcccaagcccaaggacacccugaugaucucccggacccccgaggugaccugcguggucguggacgugagccacgaggaccccgaggucaaguucaacugguacguggacggggucgaggugcacaacgccaagaccaagccccgcgaggagcaguacaacuccaccuaccggguggucagcgugcugacggugcugcaccaggacuggcucaacggcaaggaguacaagugcaaggucagcaacaaggcccugcccgcgccgaucgagaagaccaucuccaaggccaagggccagccccgcgagccccagguguacacccugcccccgagccgggacgagcucaccaagaaccaggugucccugacgugccuggucaagggguucuaccccagcgacaucgccguggagugggaguccaacggccagcccgagaacaacuacaagaccaccccgcccgugcucgacagcgacggguccuucuuccuguacagcaagcugaccgucgacaagucccgcuggcagcagggcaacguguucagcugcuccgugaugcacgaggcccuccacaaccacuacacgcagaagucccugagccugagccccgggaag

SEQ ID NO: 7678 - RNA, 639 nt, Artificial Sequence
  derived and/or modified sequence opt1 from Amatuximab_LightChain1
gacaucgagcugacccagagccccgccaucauguccgccagcccgggcgagaaggugaccaugacgugcuccgcgagcuccagcgucuccuacaugcacugguaccagcagaaguccgggaccagccccaagcgcuggaucuacgacaccagcaagcucgccuccggcgugcccgggcgguucagcggcuccgggagcggcaacuccuacagccugaccaucuccagcguggaggccgaggacgacgccacguacuacugccagcagugguccaagcacccccugaccuucggcagcgggaccaaggucgagaucaagcgcaccguggccgcgccgagcguguucaucuucccgcccuccgacgagcagcucaagagcggcacggccuccgucgugugccugcugaacaacuucuacccccgggaggccaaggugcaguggaaggucgacaacgcccuccagagcgggaacucccaggagagcgugaccgagcaggacuccaaggacagcaccuacucccugagcuccacccugacgcucagcaaggcggacuacgagaagcacaagguguacgccugcgaggucacccaccagggccuguccagccccgugaccaaguccuucaaccgcggggagugc

SEQ ID NO: 7679 - RNA, 1350 nt, Artificial Sequence
  derived and/or modified sequence opt1 from Anetumab_ravtansine_HeavyChain1
cagguggagcugguccagagcggcgccgaggugaagaagcccggggagucccucaagaucagcugcaagggcuccggguacagcuucaccuccuacuggaucggcugggugcgccaggccccggggaagggccuggaguggaugggcaucaucgaccccggggacagccggacccgcuacucccccagcuuccagggccaggucacgaucuccgcggacaagagcaucuccaccgccuaccugcaguggagcucccucaaggccagcgacaccgccauguacuacugcgcccgggggcagcuguacggcgggaccuacauggacggcuggggccaggggacgcuggugaccguguccagcgcguccaccaagggccccagcgucuucccgcucgcccccuccagcaagagcaccuccgggggcacggccgcccugggcugccuggugaaggacuacuuccccgagcccgugaccgucagcuggaacuccggggcgcucaccagcggcgugcacaccuucccggccgugcugcaguccagcgggcuguacucccucagcuccgucgugacggugcccagcuccagccugggcacccagaccuacaucugcaacgucaaccacaagcccuccaacaccaagguggacaagaagguggagcccaagagcugcgacaagacgcacacgugcccgcccugccccgcccccgagcugcucgggggcccguccgucuuccuguucccgcccaagcccaaggacacccugaugaucagccgcacccccgaggugaccugcguggucguggacgugucccacgaggaccccgaggucaaguucaacugguacguggacggcgucgaggugcacaacgccaagaccaagccccgggaggagcaguacaacagcaccuaccgcguggucuccgugcucaccgugcugcaccaggacuggcugaacgggaaggaguacaagugcaaggucagcaacaaggcccuccccgcgccgaucgagaagacgaucagcaaggccaagggccagccccgggagccccagguguacacccugcccccgucccgcgacgagcugaccaagaaccaggugagccugaccugccucgucaagggguucuaccccuccgacaucgccguggagugggagagcaacggccagcccgagaacaacuacaagacgaccccgcccgugcuggacuccgacgggagcuucuuccucuacuccaagcugaccgucgacaagagccgguggcagcagggcaacguguucuccugcagcgugaugcacgaggcccugcacaaccacuacacccagaagucccucagccugucccccggcaag

SEQ ID NO: 7680 - RNA, 651 nt, Artificial Sequence
  derived and/or modified sequence opt1 from Anetumab_ravtansine_LightChain1
gacaucgcccugacccagcccgccagcguguccggcagcccggggcaguccaucaccaucagcugcacgggcaccuccagcgacaucgggggcuacaacuccgucagcugguaccagcagcaccccgggaaggcgcccaagcucaugaucuacggcgugaacaaccgccccuccggcgugagcaaccgguucuccgggagcaaguccggcaacaccgccagccugaccaucuccgggcugcaggccgaggacgaggccgacuacuacugcagcuccuacgacaucgagagcgccacgccggucuucggcgggggcaccaagcucaccgugcugggccagcccaaggcggcccccuccgugacccuguucccgcccagcagcgaggagcuccaggccaacaaggccacgcuggucugccugaucuccgacuucuaccccggggcggugaccguggccuggaagggcgacagcucccccgucaaggccgggguggagaccaccacgcccagcaagcaguccaacaacaaguacgccgccagcuccuaccucagccugaccccggagcaguggaagucccaccgcagcuacuccugccaggugacccacgagggcagcaccgucgagaagacgguggcgcccaccgagugcucc

SEQ ID NO: 7681 - RNA, 1341 nt, Artificial Sequence
  derived and/or modified sequence opt1 from Anifrolumab_HeavyChain1
gaggugcagcugguccagagcggcgccgaggugaagaagcccggggagucccucaagaucagcugcaagggcuccggguacaucuucaccaacuacuggaucgccugggugcgccagaugccgggcaaggggcuggagagcaugggcaucaucuaccccggcgacuccgacauccgguacagccccuccuuccaggggcaggucaccaucagcgcggacaaguccaucacgaccgccuaccugcaguggagcucccucaaggccagcgacaccgccauguacuacugcgcccgccacgacaucgagggcuucgacuacugggggcggggcacccuggugacgguguccagcgcguccaccaaggggcccagcgucuucccgcuggcccccuccagcaaguccaccagcggcggcaccgccgcccucgggugccuggugaaggacuacuuccccgagcccgugacggucagcuggaacuccggcgcgcugaccagcggggugcacaccuucccggccgugcuccaguccagcggccuguacucccugagcuccgucgugaccgugcccagcuccagccucggcacgcagaccuacaucugcaacgucaaccacaagcccuccaacaccaagguggacaagcgcguggagcccaagagcugcgacaagacccacacgugcccgcccugccccgcccccgaguucgagggcgggccguccgucuuccuguucccgcccaagcccaaggacacccugaugaucagccggacccccgaggugaccugcguggucguggacgugucccacgaggaccccgaggucaaguucaacugguacguggacggggucgaggugcacaacgccaagacgaagccccgcgaggagcaguacaacagcaccuaccggguggucuccgugcucaccgugcugcaccaggacuggcugaacggcaaggaguacaagugcaaggucagcaacaaggcccuccccgcguccaucgagaagaccaucagcaaggccaaggggcagccgcgcgagccccagguguacacgcugccgcccagccgggaggagaugaccaagaaccaggugucccugaccugccucgucaagggcuucuaccccagcgacaucgccguggagugggaguccaacggccagcccgagaacaacuacaagaccacgcccccggugcuggacagcgacggguccuucuuccuguacagcaagcucaccgucgacaagucccgcuggcagcagggcaacguguucagcugcuccgugaugcacgaggcccugcacaaccacuacacccagaagucccugagccucagccccgggaag

SEQ ID NO: 7682 - RNA, 645 nt, Artificial Sequence
  derived and/or modified sequence opt1 from Anifrolumab_LightChain1
gagaucgugcugacccagagccccggcacccucucccugagcccgggggagcgcgccacgcuguccugccgggccagccaguccgucagcuccagcuucuucgcgugguaccagcagaagcccggccaggcgccccgccuccugaucuacggggccuccagccgggccaccggcauccccgaccgccuguccgggagcggcuccggcaccgacuucacccucacgaucacccggcuggagccggaggacuucgccguguacuacugccagcaguacgacagcuccgccaucaccuucgggcagggcacccgccuggagaucaagcggacgguggccgcccccagcgucuucaucuucccgcccuccgacgagcagcucaagagcgggaccgccuccguggugugccugcugaacaacuucuacccccgcgaggcgaagguccaguggaagguggacaacgcccuccagagcggcaacagccaggaguccgugaccgagcaggacagcaaggacuccaccuacagccuguccagcacgcugacccucuccaaggccgacuacgagaagcacaaggucuacgccugcgaggugacccaccaggggcugagcucccccgugaccaagagcuucaaccggggcgagugc

SEQ ID NO: 7683 - RNA, 1344 nt, Artificial Sequence
  derived and/or modified sequence opt1 from Anrukinzumab_HeavyChain1
gaggugcagcuggucgagagcggcgggggccucgugcagcccgggggcucccugcgccugagcugcgccgccuccggguucaccuucaucagcuacgcgauguccugggugcggcaggccccgggcaagggccucgagugggucgccagcaucuccagcgggggcaacaccuacuaccccgacuccgugaaggggcgcuucacgaucagccgggacaacgccaagaacucccuguaccugcagaugaacagccuccgcgccgaggacaccgcgguguacuacugcgcccggcuggacggcuacuacuucggguucgccuacuggggccagggcacccuggucaccguguccagcgccuccacgaaggggcccagcguguucccccucgcgccguccagcaaguccaccagcggcgggaccgccgcccugggcugccuggucaaggacuacuuccccgagcccgugaccgugagcuggaacuccggcgcccucacgagcgggguccacaccuuccccgccgugcugcaguccagcggccuguacucccucagcuccguggucaccgugccgagcuccagccuggggacccagacguacaucugcaacgugaaccacaagcccuccaacaccaaggucgacaagaagguggagcccaagagcugcgacaagacccacacgugcccgcccugccccgcgcccgaggcccugggcgcccccuccguguuccucuucccgcccaagcccaaggacacccugaugaucagccgcacccccgaggugaccugcgucguggucgacgugucccacgaggacccggaggucaaguucaacugguacguggacgggguggagguccacaacgccaagaccaagccccgggaggagcaguacaacagcacguaccgcgugguguccguccugaccgugcuccaccaggacuggcugaacggcaaggaguacaagugcaaggugagcaacaaggcccugcccgcgcccaucgagaagaccaucuccaaggccaagggccagccgcgggagccccaggucuacacccucccgcccagccgcgaggagaugacgaagaaccaggugagccugaccugccuggugaagggguucuaccccuccgacaucgccgucgagugggagagcaacggccagcccgagaacaacuacaagaccacgcccccggugcucgacuccgacgggagcuucuuccuguacuccaagcugaccguggacaagagccgguggcagcagggcaacgucuucuccugcagcgugaugcacgaggcccuccacaaccacuacacccagaagucccugagccugucccccgggaag

SEQ ID NO: 7684 - RNA, 654 nt, Artificial Sequence
  derived and/or modified sequence opt1 from Anrukinzumab_LightChain1
gacauccagaugacccagagccccuccagccuguccgccagcgugggcgaccgcgucaccaucacgugcaaggccuccgagagcguggacaacuacgggaagucccucaugcacugguaccagcagaagccgggcaaggcgcccaagcugcugaucuaccgggccagcaaccucgaguccggggugcccagccgcuucuccggcagcggguccggcaccgacuucacccugaccaucagcucccugcagcccgaggacuucgccacguacuacugccagcagagcaacgaggacccguggaccuucggcgggggcaccaaggucgagaucaagcggaccguggccgcccccuccguguucaucuucccgcccagcgacgagcagcucaaguccgggacggcgagcgucgugugccugcugaacaacuucuacccccgcgaggccaaggugcaguggaaggucgacaacgcccuccagagcggcaacucccaggagagcgugaccgagcaggacuccaaggacagcaccuacucccugagcuccacccugacgcucagcaaggccgacuacgagaagcacaagguguacgcgugcgaggucacccaccaggggcuguccagccccgugaccaaguccuucaaccggggcgagugc

SEQ ID NO: 7685 - RNA, 1338 nt, Artificial Sequence
  derived and/or modified sequence opt1 from Apolizumab_HeavyChain1
caggugcagcugcaggagagcggccccgggcucgucaagccguccgagacccugagccugaccugcacgguguccggcuucagccucaccaacuacggggugcacuggguccgccagucccccggcaaggggcuggaguggaucggcgugaaguggagcggcggguccaccgaguacaacgccgccuucaucagccggcugaccaucuccaaggacacgagcaagaaccaggugucccucaagcugaacagccugaccgcggccgacaccgccgucuacuacugcgcccgcaacgaccgguacgccauggacuacuggggccaggggacccucgugacgguguccagcgcguccaccaagggccccagcgucuucccccuggccccguccagcaaguccaccagcgggggcaccgccgcccugggcugccucgugaaggacuacuuccccgagcccgugacggucagcuggaacuccggggcgcugaccagcggcgugcacaccuuccccgccgugcugcaguccagcgggcucuacucccugagcuccgucgugaccgugccgagcuccagccugggcacgcagaccuacaucugcaacgucaaccacaagcccuccaacaccaagguggacaagaagguggagcccaagagcugcgacaagacccacacgugcccgcccugccccgcccccgagcuccugggcgggcccuccgucuuccuguucccgcccaagcccaaggacacccucaugaucagccgcacccccgaggugaccugcguggucguggacgucucccacgaggacccggaggugaaguucaacugguacguggacggcgucgaggugcacaacgccaagacgaagccccgggaggagcaguacaacagcaccuaccgcguggucuccgugcugaccgugcugcaccaggacuggcucaacgggaaggaguacaagugcaaggucagcaacaaggcccugcccgcgcccaucgagaagaccaucuccaaggccaagggccagccgcgggagccccagguguacacgcugccgcccagccgcgacgagcucaccaagaaccaggugagccugaccugccuggucaagggguucuaccccuccgacaucgccguggagugggagagcaacggccagcccgagaacaacuacaagaccacgcccccggugcucgacuccgacggcagcuucuuccuguacuccaagcugaccgucgacaagagccgguggcagcaggggaacguguucuccugcagcgugaugcacgaggcccuccacaaccacuacacccagaagucccugagccugucccccggcaag

SEQ ID NO: 7686 - RNA, 642 nt, Artificial Sequence
  derived and/or modified sequence opt1 from Apolizumab_LightChain1
gacauccagaugacccagagccccuccagccuguccgccagcgugggcgaccgggucaccaucacgugccgggccuccgagaacaucuacagcuaccucgcgugguaccagcagaagccggggaaggcccccaagcugcugguguccaacgccaagacccucgccgagggcgugcccagccgcuucuccgggagcggcuccgggaagcaguucacccugaccaucagcucccugcagcccgaggacuucgccacguacuacugccagcaccacuacggcaacagcuacccguucggccaggggaccaagcucgagaucaagcggaccgucgcggcccccuccguguucaucuucccgcccagcgacgagcagcugaaguccggcaccgccagcguggucugccugcucaacaacuucuacccccgcgaggccaaggugcaguggaagguggacaacgcgcugcaguccgggaacagccaggagagcgucacggagcaggacuccaaggacagcaccuacucccugagcuccacccucacccugagcaaggccgacuacgagaagcacaagguguacgccugcgaggugacgcaccagggccuguccagccccgucaccaaguccuucaaccgcggggagugc

SEQ ID NO: 7687 - RNA, 378 nt, Artificial Sequence
  derived and/or modified sequence opt1 from Apomab_HeavyChain
gaggugcagcugguccagagcggcgggggcguggagcgccccgggggcucccuccggcugagcugcgccgccuccggguucaccuucgacgacuacgcgaugugggugcgccaggccccgggcaagggccuggagugggucagcgggaucaacuggcagggcggguccaccggcuacgccgacagcgugaaggggcgggugacgaucucccgcgacaacgccaagaacagccucuaccugcagaugaacucccugcgggccgaggacaccgcggucuacuacugcgccaagauccucggcgccggccgcgggugguacuucgacuacuggggcaaggggaccaccgugacggugagcuccgccagcaccaagggcccc

SEQ ID NO: 7688 - RNA, 324 nt, Artificial Sequence
  derived and/or modified sequence opt1 from Apomab_LightChain
agcgagcugacccaggaccccgccguguccgucgcccucggccagaccgugcgcaucacgugcagcggggacucccugcggagcuacuacgcguccugguaccagcagaagccgggccaggcccccgugcuggucaucuacggggccaacaaccgccccagcggcauccccgaccgguucuccgggagcuccagcggcaacaccgccucccucaccaucaccggcgcccaggcggaggacgaggccgacuacuacugcaacagcgccgacuccagcgggaaccacgugguguucggcgggggcacgaagcugaccguccugggg

SEQ ID NO: 7689 - RNA, 645 nt, Artificial Sequence
  derived and/or modified sequence opt1 from Aquaporumab_LightChain
gagaucgugcugacccagagccccggcacccucucccugagcccgggggagcgcgccacgcuguccugccgggccagccagaccguccgcaccaacuaccucgcgugguuccagcagaagcccggccaggcgccccggcugcugaucuucggggccuccagccgcgccaccggcauccccgaccgguucuccgggagcggcuccggcacggacuucacccucaccaucagccgccuggagccggaggacuucgccguguacuacugccagcaguacggguccagccccuggaccuucggccaggggacgaagguggagaucaagcggaccgucgccgcccccuccguguucaucuucccgcccagcgacgagcagcugaaguccggcaccgccagcguggucugccuccugaacaacuucuacccccgcgaggccaaggugcaguggaagguggacaacgcgcugcaguccgggaacagccaggaguccgucaccgagcaggacagcaaggacagcacguacucccucagcuccacccugacccugagcaaggccgacuacgagaagcacaagguguacgccugcgaggugacccaccagggccucuccagccccgucacgaaguccuucaaccggggcgagugc

SEQ ID NO: 7690 - RNA, 1326 nt, Artificial Sequence
  derived and/or modified sequence opt1 from Arcitumomab_99tc_HeavyChain
gaggugaagcuggucgagagcggcgggggccucgugcagcccgggggcucccugcgccugagcugcgccaccuccggguucaccuucacggacuacuacaugaacugggugcggcagccgcccggcaaggcccucgaguggcugggcuucaucgggaacaaggccaacggcuacaccaccgaguacagcgccuccgucaaggggcgcuucaccaucagccgggacaagucccagagcauccuguaccuccagaugaacacgcugcgcgccgaggacuccgccaccuacuacugcacccgggaccgcggccugcgguucuacuucgacuacugggggcagggcaccacgcucaccgugagcuccgccaagaccaccccgcccagcguguacccccuggcgcccggcuccgccgcccagacgaacagcauggucacccuggggugccucgugaagggcuacuuccccgagcccgugaccgucaccuggaacuccgggagccuguccagcggcgugcacacguucccggccgugcugcaguccgaccucuacacccugagcagcuccgucaccgugcccagcagcccccgccccagcgagaccgugacgugcaacgucgcgcacccggccuccagcaccaagguggacaagaagaucgugccccgggacugcccgcccugcaagugccccgcccccaaccugcucggcgggcccuccgucuucaucuucccgcccaagaucaaggacgugcugaugaucagccugucccccaucgugaccugcgucgugguggacgucagcgaggacgaccccgacgugcagaucuccugguucgucaacaacguggaggugcacaccgcccagacgcagacccaccgcgaggacuacaacagcacccuccgggucguguccgcccugcccauccagcaccaggacuggaugagcggcaaggaguucaagugcaaggugaacaacaaggaccugccggcgcccaucgagcgcaccaucuccaagcccaaggggagcguccgggcgccccagguguacgugcucccgccgcccgaggaggagaugacgaagaagcaggucacccugaccugcauggugaccgacuucaugcccgaggacaucuacguggaguggacgaacaacggcaagaccgagcugaacuacaagaacaccgagcccguccucgacuccgacgggagcuacuucauguacuccaagcugcgcguggagaagaagaacuggguggagcggaacagcuacagcugcuccgucgugcacgagggccugcacaaccaccacaccacgaaguccuucucccgc

SEQ ID NO: 7691 - RNA, 639 nt, Artificial Sequence
  derived and/or modified sequence opt1 from Arcitumomab_99tc_LightChain
cagaccgugcugagccagucccccgccauccucagcgccuccccgggcgagaaggucaccaugacgugccgcgcgagcuccagcgugaccuacauccacugguaccagcagaagcccggguccagccccaaguccuggaucuacgccaccagcaaccuggccuccggcgugcccgcccgguucagcggguccggcagcgggaccuccuacagccugacgaucucccgcgucgaggccgaggacgcggccaccuacuacugccagcacuggagcuccaagccgcccaccuucggcggcgggaccaagcucgagaucaagcgggccgacgccgcgcccacggugagcaucuucccgcccagcuccgagcagcugaccagcggcggggccuccguggucugcuuccugaacaacuucuaccccaaggacaucaacgugaaguggaagaucgacggcagcgagcgccagaacggggugcucaacuccuggaccgaccaggacagcaaggacuccaccuacagcauguccagcacgcugacccugaccaaggacgaguacgagcggcacaacuccuacacgugcgaggccacccacaagaccagcaccucccccaucgucaagagcuucaaccgcaacgagugc

SEQ ID NO: 7692 - RNA, 1329 nt, Artificial Sequence
  derived and/or modified sequence opt1 from Ascrinvacumab_HeavyChain1
caggugcagcugcaggagagcggccccgggcucgucaagccgucccagacccugagccugaccugcacgguguccggcgggagcaucuccagcggcgaguacuacuggaacuggauccgccagcaccccgggaagggccucgaguggaucggcuacaucuacuacuccgggagcaccuacuacaaccccucccucaagagccgggugaccaucuccgucgacaccagcaagaaccaguucucccugaagcucagcuccgugacggccgccgacaccgcgguguacuacugcgcccgcgagagcgucgccggcuucgacuacugggggcagggcacccuggugaccguguccagcgccuccacgaaggggcccagcgucuucccgcuggcccccugcagccgguccaccagcgaguccaccgcggcccucggcugccuggugaaggacuacuuccccgagcccgugaccgucagcuggaacuccggcgcccugacgagcggggugcacaccuucccggccgugcuccaguccagcggccuguacucccugagcuccgucgugaccgugcccagcuccaacuucgggacccagacguacacgugcaacgucgaccacaagcccagcaacaccaagguggacaagaccguggagcgcaagugcugcgucgagugcccgcccugccccgcgccgcccguggccggccccuccguguuccucuucccgcccaagcccaaggacacccugaugaucagccggacccccgaggugaccugcgucgucguggacgugucccacgaggaccccgagguccaguucaacugguacguggacggcguggagguccacaacgccaagaccaagccccgcgaggagcaguucaacagcacguuccgggugguguccguccugaccguggugcaccaggacuggcucaacgggaaggaguacaagugcaaggucagcaacaagggccugcccgccccgaucgagaagaccaucagcaagaccaaggggcagccccgcgagccccagguguacacgcugcccccgucccgggaggagaugaccaagaaccaggugagccugaccugccuggucaagggcuucuaccccuccgacaucgccguggagugggagagcaacgggcagcccgagaacaacuacaagaccacgccgcccaugcuggacuccgacggcagcuucuuccucuacuccaagcugaccguggacaagagccgcuggcagcagggcaacgucuucuccugcagcgugaugcacgaggcgcugcacaaccacuacacccagaagucccucagccugucccccggg

SEQ ID NO: 7693 - RNA, 645 nt, Artificial Sequence
  derived and/or modified sequence opt1 from Ascrinvacumab_LightChain1
gagaucgugcugacccagagccccggcacccucucccugagcccgggggagcgcgccacgcuguccugccgggccagccaguccgucagcuccagcuaccucgcgugguaccagcagaagcccggccaggcgccccgccugcugaucuacgggaccuccagccgggccaccggcauccccgaccgcuucuccgggagcggcuccggcaccgacuucacgcucaccaucagccggcuggagccggaggacuucgccguguacuacugccagcaguacggguccagccccaucaccuucggccaggggacccgccuggagaucaagcggacgguggccgcccccuccgucuucaucuucccgcccagcgacgagcagcucaaguccggcaccgccagcguggugugccugcugaacaacuucuacccccgcgaggccaagguccaguggaagguggacaacgcccuccagagcgggaacucccaggagagcgugaccgagcaggacuccaaggacagcaccuacucccugagcuccacgcugacccucagcaaggcggacuacgagaagcacaaggucuacgccugcgaggugacccaccagggccuguccagccccgugaccaaguccuucaaccggggcgagugc

SEQ ID NO: 7694 - RNA, 1314 nt, Artificial Sequence
  derived and/or modified sequence opt1 from Aselizuab_HeavyChain1
gaggugcagcuggucgagagcggcgggggccucgugcagcccgggggcucccugcgccugagcugcgccgccuccggguucaccuucagcaccuacgcguccugggugcggcaggcccccggcaagggccucgagugggucgccagcaucuccaccgggggcagcaccuacuaccccgacuccgugaaggggcgcuucaccaucagccgggacaacgccaagaacacccuguaccugcagaacucccuccgcgccgaggacacggcgguguacuacugcgcccgggacuacgacggcuacuucgacuacugggggcagggcacccuggucaccgugagcuccgccagcaccaagggccccuccguguucccccuggccccgugcagccgcuccacgagcgaguccaccgcggcccucgggugccuggucaaggacuacuuccccgagcccgugaccgugagcuggaacagcggcgcccugaccuccgggguccacacguuccccgccgugcuccagagcuccggccuguacagccuguccagcguggucaccgugccguccagcucccucggcaccaagaccuacacgugcaacguggaccacaagcccagcaacaccaaggucgacaagcggguggaguccaaguacgggccgcccugccccagcugccccgcccccgaguuccugggcgggcccuccguguuccuguucccgcccaagcccaaggacacccucaucagccgcacccccgaggucacgugcgugguggucgacgugucccaggaggacccggagguccaguucaacugguacguggacggcguggagguccacaacgcgaagaccaagccccgggaggagcaguucaacagcaccuaccgcgugguguccguccugaccgugcugcaccaggacuggcucaacgggaaggaguacaagugcaaggugagcaacaagggccugcccuccagcaucgagaagacgaucagcaaggccaagggccagccccgggagccgcaggucuacacccugccgcccucccaggaggagaccaagaaccaggugagccucacgugccuggugaagggguucuaccccuccgacaucgccgucgagugggagagcaacggccagcccgagaacaacuacaagacgaccccgcccgugcuggacuccgacgggagcuucuuccucuacucccgccugaccguggacaagagccgguggcaggagggcaacgucuucuccugcagcgugcacgaggcccugcacaaccacuacacccagaagucccucagccugucccuggggaag

SEQ ID NO: 7695 - RNA, 1311 nt, Artificial Sequence
  derived and/or modified sequence opt1 from Aselizuab_HeavyChain2
gaggugcagcuggucgagagcggcgggggccucgugcagcccgggggcucccugcgccugagcugcgccgccuccggguucaccuucagcaccuacgcguccugggugcggcaggcccccggcaagggccucgagugggucgccagcaucuccaccgggggcagcacguacuaccccgacuccgugaaggggcgcuucaccaucagccgggacaacgccaagaacacccuguaccugcagaacucccuccgcgccgaggacacggcgguguacuacugcgcccgggacuacgacggcuacuucgacuacugggggcagggcacccuggucaccgugagcuccgccagcaccaagggccccuccguguucccccuggccccgugcagccgcuccacgagcgaguccaccgcggcccucgggugccuggucaaggacuacuuccccgagcccgugaccgugagcuggaacagcggcgcccugaccuccgggguccacacguuccccgccgugcuccagagcuccggccuguacagccuguccagcguggucaccgugccguccagcucccucggcaccaagaccuacacgugcaacguggaccacaagcccagcaacaccaaggucgacaagcggguggaguccaaguacgggccgcccugccccagcugccccgcccccgaguuccugggcgggcccuccguguuccuguucccgcccaagcccaaggacaccaucagccgcacccccgaggucacgugcgugguggucgacgugucccaggaggacccggagguccaguucaacugguacguggacggcguggagguccacaacgcgaagaccaagccccgggaggagcaguucaacagcaccuaccgcgugguguccguccucaccgugcugcaccaggacuggcugaacgggaaggaguacaagugcaaggugagcaacaagggccuccccuccagcaucgagaagacgaucagcaaggccaagggccagccccgggagccgcaggucuacacccugccgcccucccaggaggagaccaagaaccaggugagccugaccugccucgugaagggguucuaccccuccgacaucgccgucgagugggagagcaacggccagcccgagaacaacuacaagacgaccccgcccgugcuggacuccgacgggagcuucuuccuguacucccgccucaccguggacaagagccgguggcaggagggcaacgucuucuccugcagcgugcacgaggcccugcacaaccacuacacccagaagucccugagccucucccuggggaag

SEQ ID NO: 7696 - RNA, 648 nt, Artificial Sequence
  derived and/or modified sequence opt1 from Aselizuab_LightChain1
gacauccagacccagagccccuccagccuguccgccagcgugggcgaccgcgucaccaucacgugcaaggccucccagagcguggacuacgacggggacuccuacaacugguaccagcagaagccgggcaaggcgcccaagcuccugaucuacgccgccagcaaccuggaguccgggauccccagccgguucuccggcagcggguccggcaccgacuucacccucaccaucagcucccugcagcccgaggacuucgccacguacuacugccagcagagcaacgaggacccguggaccuucggccaggggaccaagguggagaucaagcgcaccgucgccgcgcccuccguguucaucuucccgcccagcgacgagcagcugaaguccggcacggccagcguggucugccuccugaacaacuucuacccccgggaggccaaggugcaguggaagguggacaacgcccugcagagcgggaacucccaggagagcgucaccgagcaggacuccaaggacagcaccuacucccucagcuccacccugacgcugagcaaggcggacuacgagaagcacaagguguacgccugcgaggugacccaccagggccucuccagccccgucaccaaguccuucaaccgcggggagugc

SEQ ID NO: 7697 - RNA, 1344 nt, Artificial Sequence
  derived and/or modified sequence opt1 from Atezolizumab_HeavyChain1
gaggugcagcuggucgagagcggcgggggccucgugcagcccgggggcucccugcgccugagcugcgccgccuccggguucaccuucagcgacuccuggauccacugggugcggcaggcgccgggcaagggccucgagugggucgccuggaucagccccuacgggggcuccaccuacuacgccgacagcgugaaggggcgcuucacgaucuccgccgacaccagcaagaacaccgccuaccugcagaugaacucccugcgggcggaggacaccgccguguacuacugcgcccgccggcacuggcccggcggguucgacuacuggggccagggcacgcucgucaccgugagcuccgccagcaccaaggggcccuccguguucccgcuggcgcccagcuccaagagcaccuccggcgggacggccgcccugggcugccucgucaaggacuacuuccccgagcccgugaccgugagcuggaacagcggcgcccugaccuccgggguccacaccuucccggccgugcugcagagcuccggccucuacagccuguccagcguggucacggugcccuccagcucccuggggacccagaccuacaucugcaacgugaaccacaagcccagcaacaccaaggucgacaagaagguggagcccaaguccugcgacaagacgcacacgugcccgcccugccccgcgcccgagcuccugggcgggccgagcguguuccuguucccgcccaagcccaaggacacccucaugaucucccgcacccccgaggugaccugcgucguggucgacgugagccacgaggaccccgaggucaaguucaacugguacguggacggcguggagguccacaacgccaagaccaagccccgggaggagcaguacgccuccaccuaccgcguggugagcguccugaccgugcugcaccaggacuggcucaacggcaaggaguacaagugcaagguguccaacaaggcccugcccgccccgaucgagaagacgaucagcaaggcgaaggggcagccccgggagccccaggucuacacccugcccccgucccgcgaggagaugaccaagaaccaggugagccugaccugccucgugaagggcuucuaccccagcgacaucgccgucgagugggaguccaacgggcagcccgagaacaacuacaagacgaccccgcccgugcuggacagcgacggcuccuucuuccucuacagcaagcugaccguggacaagucccgguggcagcaggggaacgucuucagcugcuccgugaugcacgaggcccugcacaaccacuacacccagaagucccucagccugagccccggcaag

SEQ ID NO: 7698 - RNA, 642 nt, Artificial Sequence
  derived and/or modified sequence opt1 from Atezolizumab_LightChain1
gacauccagaugacccagagccccuccagccuguccgccagcgugggcgaccgcgucaccaucacgugccgggccucccaggacgugagcaccgcgguggccugguaccagcagaagccggggaaggcccccaagcuccugaucuacuccgccagcuuccuguacuccggcguccccagccgcuucuccgggagcggcuccgggaccgacuucacccucacgaucagcucccugcagcccgaggacuucgccaccuacuacugccagcaguaccuguaccacccggcgaccuucggccagggcaccaagguggagaucaagcggacgguggccgcccccagcgucuucaucuucccgcccuccgacgagcagcucaagagcgggaccgccuccguggugugccugcugaacaacuucuacccccgcgaggcgaagguccaguggaagguggacaacgcccuccagagcggcaacagccaggaguccgugaccgagcaggacagcaaggacuccaccuacagccuguccagcacgcugacccucuccaaggccgacuacgagaagcacaaggucuacgccugcgaggugacccaccaggggcugagcucccccgugaccaagagcuucaaccggggcgagugc

SEQ ID NO: 7699 - RNA, 1323 nt, Artificial Sequence
  derived and/or modified sequence opt1 from Atinumab_HeavyChain1
gaggugcagcuggucgagagcggcgggggccucgugcagcccgggggcucccugcgccugagcugcgccgccuccggguucaccuucagcaacuacuggauguccugggugcggcaggcgccgggcaagggccucgagugggucgccaccaucaagcaggacgggagccagaagaacuacguggacuccgugaagggccgcuucacgaucagccgggacaacgccaagaacucccuguaccugcgccucaacagccugcgggccgaggacaccgccgucuacuacugcgcgaccgagcuguucgaccucugggggcgcggcucccuggugaccgugagcuccgccagcacgaaggggcccuccgucuucccccuggcccccugcagccgguccaccagcgaguccaccgccgcgcucggcugccuggugaaggacuacuucccggagcccgugaccgucagcuggaacagcggcgcccugacguccggggugcacaccuuccccgccgugcuccagagcuccggccuguacagccuguccagcgucgugaccgugcccuccagcucccucgggaccaagacguacacgugcaacgucgaccacaagccgagcaacaccaagguggacaagcgcguggaguccaaguacggcccgcccugccccagcugccccgcccccgaguuccugggcgggcccuccgucuuccuguucccgcccaagcccaaggacacccucaugaucagccggacccccgaggugaccugcguggucguggacgucucccaggaggaccccgaggugcaguucaacugguacguggacggcgucgaggugcacaacgccaagaccaagccgcgcgaggagcaguucaacagcaccuaccggguggucuccgugcugacggugcugcaccaggacuggcucaacgggaaggaguacaagugcaaggucagcaacaagggccugcccuccagcaucgagaagaccaucagcaaggcgaaggggcagccccgcgagccccagguguacacccugccgcccucccaggaggagaugaccaagaaccaggugagccucacgugccuggucaagggcuucuaccccuccgacaucgccguggagugggagagcaacggccagcccgagaacaacuacaagaccaccccgcccgugcuggacuccgacgggagcuucuuccucuacucccggcugaccgucgacaagagccgcuggcaggagggcaacguguucuccugcagcgugaugcacgaggcccugcacaaccacuacacgcagaagucccucagccugucccuggggaag

SEQ ID NO: 7700 - RNA, 642 nt, Artificial Sequence
  derived and/or modified sequence opt1 from Atinumab_LightChain1
gagaucgugcugacccagagccccgccacccucucccugagcccgggcgagcgcgccacgcuguccugccgggcgagccaguccgucagcuccuaccucgccugguaccagcagaagcccgggcaggcgccccgccugcugaucuacgacgccagcaaccgggccaccggcauccccgcccgcuucuccgggagcggcuccgggaccgacuucacccucacgaucagcucccuggagccggaggacuucgccguguacuacugccagcagcggagcaacuggcccaucaccuucggccagggcaccaagcuggagaucaagcgcaccguggccgcccccuccgucuucaucuucccgcccagcgacgagcagcucaaguccgggacggcgagcguggugugccugcugaacaacuucuacccccgggaggccaagguccaguggaagguggacaacgcccuccaguccggcaacagccaggagagcgugaccgagcaggacuccaaggacagcaccuacucccugagcuccacccugacgcucagcaaggccgacuacgagaagcacaaggucuacgccugcgaggugacccaccaggggcuguccagccccgugaccaaguccuucaaccgcggcgagugc

SEQ ID NO: 7701 - RNA, 1329 nt, Artificial Sequence
  derived and/or modified sequence opt1 from Atlizuab_HeavyChain1
gugcagcugcaggagagcggccccgggcucguccgccccucccagacccugagccugaccugcacgguguccggcuacagcaucaccuccgaccacgccuggagcugggugcggcagccgcccgggcgcggccucgaguggaucggguacaucuccuacagcggcaucaccaccuacaaccccucccucaagagccgggucacgcugcgcgacaccuccaagaaccaguucagccugcggcuguccagcgugaccgccgcggacaccgccguguacuacugcgcccgcucccuggcccggacgaccgccgacuacuggggccaggggagccucgucaccguguccagcgcguccaccaagggcccgagcguguucccccuggcccccagcuccaagagcacguccgggggcaccgccgcccuggggugccucgucaaggacuacuuccccgagccggugaccgugagcuggaacuccggcgcgcugaccagcggcguccacacguuccccgccgugcugcaguccagcgggcucuacucccugagcuccguggucaccgugcccagcuccagccugggcacccagaccuacaucugcaacgugaaccacaagcccuccaacacgaaggucgacaagaagguggagcccaagagcugcgacaagacccacacgugcccgcccugccccgcccccgagcuccucgggggccccuccguguuccuguucccgcccaagcccaaggacacccugaucagccgcacccccgaggugaccugcgucguggucgacgugucccacgaggaccccgaggucaaguucaacugguacguggacggcguggagguccacaacgccaagaccaagccccgggaggagcaguacaacagcaccuaccgcguggugagcguccugacggugcugcaccaggacuggcucaacgggaaggaguacaagugcaagguguccaacaaggcccugccggcgcccaucgagaagaccaucagcaaggccaagggccagccccgggagccccaggucuacacccugccgcccucccgcgacgagcucaccaagaaccaggugagccugacgugccuggugaagggguucuaccccuccgacaucgccgucgagugggagagcaacggccagccggagaacaacuacaagaccaccccgcccgugcucgacuccgacgggagcuucuuccuguacuccaagcugaccguggacaagagccgguggcagcagggcaacgucuucuccugcagcgugcacgaggcccuccacaaccacuacacgcagaagucccugagccugucccccggc

SEQ ID NO: 7702 - RNA, 639 nt, Artificial Sequence
  derived and/or modified sequence opt1 from Atlizuab_LightChain1
gacauccagacgcagagccccuccagccuguccgccagcgugggcgaccgcgucaccaucacgugccgggccucccaggacaucagcuccuaccucaacugguaccagcagaagccggggaaggcgcccaagcugcugaucuacuacaccagccgccuccacuccggcgugcccagccgguucuccgggagcggcuccgggaccgacuucaccuucacgaucagcucccugcagcccgaggacaucgccaccuacuacugccagcagggcaacacccugccguacaccuucggccaggggacgaagguggagaucaagcgcaccgucgccgcccccagcguguucaucuucccgcccuccgacgagcagcucaagagcggcaccgccuccguggucugccugcugaacaacuucuacccccgggaggcgaaggugcaguggaagguggacaacgcccuccagagcgggaacagccaggaguccgucaccgagcaggacagcaaggacuccacguacagccuguccagcacccugacccucuccaaggccgacuacgagaagcacaagguguacgccugcgaggugacccaccagggccugagcucccccgucaccaagagcuucaaccgcggggagugc

SEQ ID NO: 7703 - RNA, 792 nt, Artificial Sequence
  derived and/or modified sequence opt1 from Aurograb_SingleChain
auggccaaggugcagcugcuccagagcgccaccgaggucaagaagcccggcgcguccgugaaggugagcugcaaggccuacggguacaccuucacggacuacggcaucaccuggguccgccaggccccggggcagggccuggaguggaugggguggaucuccgccuacaacggcuacaccaacuacgcccagaaguuccaggaccggaucaccaugacgaccgacgcgagcaccuccaccgccuacauggagcugcgcagccuccggcccgacgacacggccgugcuguacugcgcccgcgaccgggaggacgcgucccugcuccgcgacggccacugggggcagggcacccuggugaccgucagcuccgggggcgggggcagcggcgggggcggguccggcggcgggggcagcgggggcgggggcuccgagaccacgcugacccagagccccggcacccucucccugagccccggggagcgggccacccuguccugccgcgccagccagaucguguccagcagcuaccucgccugguaccagcagaagccgggccaggcgccccggcugcugaucuacggggccuccagccgcgccacgggcauccccgaccgguucuccgggagcggcuccggcaccgacuucacccucaccaucagcaagcuggagcccgaggacuucgccguguacuacugccagcacuacggguccagcuccccguggacgagccgcccccgggaccaguccgacaucaagcgcgccgccgcgcuggagcaccaccaccaccaccac

SEQ ID NO: 7704 - RNA, 1350 nt, Artificial Sequence
  derived and/or modified sequence opt1 from Avelumab_HeavyChain1
gaggugcagcugcucgagagcggcgggggccugguccagcccgggggcucccugcgccucagcugcgccgccuccggguucaccuucagcuccuacaucaugaugugggugcggcaggcgccgggcaagggccuggagugggugagcuccaucuaccccagcgggggcaucaccuucuacgccgacacggucaaggggcgcuucaccaucucccgggacaacagcaagaacacccuguaccuccagaugaacucccugcgcgccgaggacaccgccguguacuacugcgcccggaucaagcugggcacggugaccaccgucgacuacugggggcagggcacccucgugacggugagcuccgcgagcaccaagggccccuccgucuucccccuggccccgagcuccaagagcaccuccgggggcaccgccgcccuggggugccucgugaaggacuacuuccccgagcccgugacggucagcuggaacagcggcgcgcugaccuccggcgugcacaccuuccccgccgugcugcagagcuccgggcucuacagccuguccagcgucgugaccgugccguccagcucccugggcacgcagaccuacaucugcaacgucaaccacaagcccagcaacaccaagguggacaagaagguggagcccaaguccugcgacaagacccacacgugcccgcccugccccgcccccgagcuccucgggggccccagcgucuuccuguucccgcccaagcccaaggacacccugaugaucucccgcacccccgaggugaccugcguggucguggacgucagccacgaggacccggaggugaaguucaacugguacguggacggggucgaggugcacaacgccaagacgaagccccgggaggagcaguacaacuccaccuaccgcguggucagcgugcugaccgugcugcaccaggacuggcucaacggcaaggaguacaagugcaaggucuccaacaaggcccugcccgcgcccaucgagaagaccaucagcaaggccaagggccagccgcgggagccccagguguacacgcugccgcccucccgcgacgagcucaccaagaaccaggugagccugaccugccuggucaagggguucuaccccagcgacaucgccguggagugggaguccaacggccagcccgagaacaacuacaagaccacgcccccggugcucgacagcgacggguccuucuuccuguacagcaagcugaccgucgacaagucccgguggcagcagggcaacguguucagcugcuccgugaugcacgaggcccuccacaaccacuacacccagaagucccugagccugagccccgggaag

SEQ ID NO: 7705 - RNA, 648 nt, Artificial Sequence
  derived and/or modified sequence opt1 from Avelumab_LightChain1
cagagcgcccugacccagcccgccuccgugagcggcuccccggggcagagcaucaccaucuccugcacgggcaccagcuccgacgucgggggcuacaacuacgugagcugguaccagcagcaccccgggaaggcgcccaagcucaugaucuacgacguguccaaccgccccagcggcgucuccaaccgguucagcggcuccaagagcgggaacaccgccucccugaccaucagcggccugcaggccgaggacgaggccgacuacuacugcuccagcuacacguccagcagcacccgcguguucgggaccggcaccaaggugacgguccucgggcagccgaaggccaaccccaccgugacccuguucccgcccuccagcgaggagcugcaggcgaacaaggccacccucgugugccugaucuccgacuucuaccccggcgccgucacgguggccuggaaggcggacggcagccccgugaaggccggggucgagaccaccaagcccuccaagcagagcaacaacaaguacgccgccuccagcuaccugucccucacccccgagcaguggaagucccaccggagcuacagcugccaggugacgcacgagggcuccaccguggagaagaccgucgccccgaccgagugcagc

SEQ ID NO: 7706 - RNA, 1344 nt, Artificial Sequence
  derived and/or modified sequence opt1 from Bapineuzumab_HeavyChain1
gaggugcagcugcucgagagcggcgggggccugguccagcccgggggcucccugcgccucagcugcgccgccuccggguucaccuucagcaacuacggcauguccugggugcggcaggcgccgggcaaggggcuggaguggguggccagcauccgcuccggcgggggccggaccuacuacagcgacaacgucaaggggcgcuucacgaucucccgggacaacagcaagaacacccuguaccuccagaugaacucccugcgcgccgaggacaccgccguguacuacugcgugcgguacgaccacuacagcggcuccagcgacuacuggggccaggggacccuggucacgguguccagcgccuccaccaagggccccagcguguucccccucgcgcccuccagcaagagcaccuccgggggcaccgccgcccugggcugccuggucaaggacuacuucccggagcccgugacggugagcuggaacuccggggcccucaccagcggcguccacaccuuccccgcggugcugcaguccagcgggcuguacucccucagcuccguggucaccgugcccagcuccagccugggcacgcagaccuacaucugcaacgugaaccacaagccguccaacaccaaggucgacaagaagguggagcccaagagcugcgacaagacccacacgugcccgcccugccccgcccccgagcugcucgggggccccuccguguuccuguucccgcccaagcccaaggacacccugaugaucagccgcacccccgaggugaccugcgucguggucgacgugucccacgaggaccccgaggucaaguucaacugguacguggacggcguggagguccacaacgccaagacgaagccgcgggaggagcaguacaacagcaccuaccgcgugguguccguccucaccgugcugcaccaggacuggcugaacgggaaggaguacaagugcaaggugagcaacaaggcccuccccgcccccaucgagaagaccaucagcaaggcgaagggccagccccgggagccgcaggucuacacgcugccgcccucccgcgaggagaugaccaagaaccaggugagccugaccugccucgugaagggguucuaccccuccgacaucgccgucgagugggagagcaacggccagcccgagaacaacuacaagaccacgccgcccgugcuggacuccgacgggagcuucuuccuguacuccaagcucaccguggacaagagccgguggcagcagggcaacgucuucuccugcagcgugaugcacgaggcccugcacaaccacuacacccagaagucccugagccucucccccggc

SEQ ID NO: 7707 - RNA, 657 nt, Artificial Sequence
  derived and/or modified sequence opt1 from Bapineuzumab_LightChain1
gacguggucaugacccagagcccccugucccucccggugacccccggcgagcccgccagcaucuccugcaagagcucccagagccugcuggacuccgacgggaagacguaccucaacuggcugcugcagaagcccggccagagcccgcagcgccucaucuaccugguguccaagcuggacagcgggguccccgaccgguucuccggcagcggguccggcaccgacuucacccucaagaucagccgcguggaggccgaggacgugggcgucuacuacugcuggcaggggacccacuucccccggacguucggccaggggaccaagguggagaucaagcgcaccguggcggcccccuccgucuucaucuucccgcccagcgacgagcagcugaaguccggcaccgccagcguggugugccugcucaacaacuucuacccccgggaggccaagguccaguggaagguggacaacgcccugcaguccgggaacagccaggagagcgugacggagcaggacuccaaggacagcaccuacucccugagcuccacccucacccugagcaaggcggacuacgagaagcacaaggucuacgccugcgaggugacgcaccagggccuguccagccccgugaccaaguccuucaaccgcggcgagugc

SEQ ID NO: 7708 - RNA, 1338 nt, Artificial Sequence
  derived and/or modified sequence opt1 from Basiliximab_HeavyChain
cagcugcagcagagcggcaccgugcucgcccgccccggggccuccgucaagaugagcugcaaggcguccggcuacagcuucacccgguacuggaugcacuggaucaagcagcgcccggggcagggccuggaguggaucggggccaucuaccccggcaacuccgacacgagcuacaaccagaaguucgagggcaaggccaagcugaccgccgugaccuccgccagcaccgcguacauggagcucuccagccugacgcacgaggacuccgccguguacuacugcagccgggacuacggguacuacuucgacuucuggggccaggggaccacccugaccgucuccagcgccuccacgaagggccccagcguguucccccucgccccguccagcaaguccaccagcgggggcaccgcggcccugggcugccuggugaaggacuacuuccccgagcccgucaccgugagcuggaacuccggggcccucacgagcggcgugcacaccuuccccgccguccugcaguccagcgggcuguacucccucagcuccguggugaccgucccgagcuccagccugggcacccagacguacaucugcaacgugaaccacaagcccuccaacaccaagguggacaagcgcgucgagccgcccaagagcugcgacaagacccacacgugcccgcccugccccgcccccgagcugcucggcgggcccuccguguuccuguucccgcccaagcccaaggacacccugaugaucagccggacccccgaggugaccugcgucgugguggacgucucccacgaggaccccgaggugaaguucaacugguacguggacggcgucgaggugcacaacgcgaagaccaagccccgcgaggagcaguacaacagcacguaccgggucguguccgugcucaccguccugcaccaggacuggcugaacgggaaggaguacaagugcaaggugagcaacaaggcccuccccgccccgaucgagaagaccaucuccaaggccaagggccagccccgcgagccccagguguacacccugcccccgagccgggacgagcugacgaagaaccaggucagccugaccugccucgugaagggguucuaccccuccgacaucgccguggagugggagagcaacggccagcccgagaacaacuacaagaccaccccgcccguccuggacuccgacggcagcuucuuccucuacuccaagcugacgguggacaagagccgcuggcagcaggggaacguguucuccugcagcgucaugcacgaggcgcugcacaaccacuacacccagaagucccucagccugucccccggcaag

SEQ ID NO: 7709 - RNA, 630 nt, Artificial Sequence
  derived and/or modified sequence opt1 from Basiliximab_LightChain
cagaucgugagcacccagucccccgccaucaugagcgccuccccgggcgagaaggucaccaugacgugcagcgcguccagcucccgcagcuacaugcagugguaccagcagaagcccgggaccucccccaagcgguggaucuacgacaccagcaagcuggccuccggcgugcccgcccgcuucagcggguccggcagcgggaccuccuacagccucacgaucuccagcauggaggccgaggacgccgcgaccuacuacugccaccagcgguccagcuacaccuucggcggcgggaccaagcuggagaucaagcgcacgguggccgccccgagcgucuucaucuucccgcccuccgacgagcagcucaagagcggcaccgccuccguggugugccugcugaacaacuucuacccccgggaggcgaagguccaguggaagguggacaacgcccugcagagcgggaacucccaggagagcgugaccgagcaggacuccaaggacagcaccuacucccucagcuccacgcugacccugagcaaggccgacuacgagaagcacaaggucuacgccugcgaggugacccaccagggccucuccagccccgugaccaaguccuucaaccgcggggag

SEQ ID NO: 7710 - RNA, 1350 nt, Artificial Sequence
  derived and/or modified sequence opt1 from Bavituximab_HeavyChain
gaggugcagcugcagcagagcggccccgagcucgagaagccgggggccuccgucaagcugagcugcaaggccuccggcuacagcuucaccggguacaacaugaacugggugaagcagucccacggcaagagccuggaguggaucgggcacaucgaccccuacuacggcgacaccuccuacaaccagaaguuccgcggcaaggcgacgcucaccguggacaagagcuccagcaccgccuacaugcagcugaagucccugaccagcgaggacuccgccgucuacuacugcgugaagggcggguacuacgggcacugguacuucgacguguggggcgccgggacgaccgucaccgugagcuccgccagcaccaagggccccuccguguucccccucgcgccgagcuccaagagcacgagcggcgggaccgccgcccugggcugccuggucaaggacuacuuccccgagcccgugaccguguccuggaacagcggggcccucaccuccggcguccacacguuccccgcggugcugcagagcuccggccuguacagccucuccagcguggucaccgugccguccagcucccuggggacccagaccuacaucugcaacgugaaccacaagcccagcaacacgaaggucgacaagaagguggagcccaaguccugcgacaagacccacacgugcccgcccugccccgcccccgagcugcucggcgggcccagcguguuccuguucccgcccaagcccaaggacacccugaugaucucccggacccccgaggugaccugcgucguggucgacgugagccacgaggacccggaggucaaguucaacugguacguggacggcguggagguccacaacgccaagaccaagccccgcgaggagcaguacaacuccaccuaccggguggugagcguccucacggugcugcaccaggacuggcugaacgggaaggaguacaagugcaagguguccaacaaggcccuccccgcccccaucgagaagaccaucagcaaggcgaagggccagccgcgcgagccccaggucuacacccugccgcccagccgggacgagcugaccaagaaccaggugucccucacgugccuggugaagggcuucuaccccagcgacaucgccgucgagugggaguccaacgggcagcccgagaacaacuacaagaccacgcccccggugcuggacagcgacggcuccuucuuccucuacagcaagcugaccguggacaagucccgcuggcagcaggggaacgucuucagcugcuccgugaugcacgaggcccugcacaaccacuacacccagaagucccucagccugagccccggcaag

SEQ ID NO: 7711 - RNA, 642 nt, Artificial Sequence
  derived and/or modified sequence opt1 from Bavituximab_LightChain
gacauccagaugacccagagccccuccagccuguccgccagccucggcgagcgggugucccugaccugccgggccagccaggacaucggguccagccugaacuggcuccagcagggcccggacgggacgaucaagcgccugaucuacgcgaccuccagccuggacuccggcguccccaagcgguucagcgggucccgcagcggcuccgacuacagccucaccaucuccagccuggaguccgaggacuucguggacuacuacugccugcaguacgugagcagcccgcccaccuucggcgccgggacgaagcucgagcugaagcgggccgacgccgcccccuccgucuucaucuucccgcccagcgacgagcagcugaaguccggcaccgcgagcguggugugccuccugaacaacuucuacccccgcgaggccaagguccaguggaagguggacaacgcccugcaguccgggaacagccaggaguccgugaccgagcaggacagcaaggacuccaccuacagccucuccagcacgcugacccuguccaaggccgacuacgagaagcacaaggucuacgcgugcgaggugacccaccagggccucagcucccccgugaccaagagcuucaaccgcggggagugc

SEQ ID NO: 7712 - RNA, 624 nt, Artificial Sequence
  derived and/or modified sequence opt1 from Bavituximab_LightChain_variant_8734_L
gacauccagaugacccagagccccuccagccuguccgccagccucggcgagcgggugucccugaccugccgggccagccaggacaucggguccagccugaacuggcuccagcagggcccggacgggacgaucaagcgccugaucuacgcgaccuccagccuggacuccggcguccccaagcgguucagcgggucccgcagcggcuccgacuacagccucaccaucuccagccuggaguccgaggacuucguggacuacuacugccugcaguacgugagcagcccgcccaccuucggcgccgggacgaagcucgagcugaagcgggccgacgccgcccccuccgucuucaucuucccgcccagcgacgagcagcugaaguccggcaccgcgagcguggugugccuccugaacaacuucuacccccgcgaggccaagguccaguggaagguggacaacgcccugcaguccgggaacagccaggaguccgugaccgagcaggacagcaaggacuccaccuacagccucuccaaggccgacuacgagaagcacaaggucuacgcgugcgaggugacgcaccagggccugagcucccccgugaccaagagcuucaaccgcggggagugc

SEQ ID NO: 7713 - RNA, 1368 nt, Artificial Sequence
  derived and/or modified sequence opt1 from Begelomab_HeavyChain1
caggugcagcugcagcagagcggcgccgagcucgucaagcccggggccuccgugaagcugagcugcaaggcguccggcuacaccuuccgcagcuacgacaucaacugggugcggcagcgcccggagcaggggcuggaguggaucggcuggaucuuccccggggacggcuccaccaaguacaacgagaaguucaagggcaaggccacgcucaccaccgacaagagcuccagcaccgccuacaugcagcugucccggcugacgagcgaggacuccgccgucuacuucugcgcccgcuggaccgugguggggcccggcuacuucgacgucuggggcgcggggaccaccgugacggugagcuccgccaagaccacgcccccgagcgucuacccccucgcccccgggugcggcgacaccaccggcuccagcgugacccuggggugccuggugaagggcuacuuccccgaguccgucaccgugaccuggaacagcgggucccucagcagcuccgugcacacguucccggcccugcugcagagcggccucuacaccauguccagcuccgucaccgugcccagcuccaccuggcccagccagacggugaccugcuccgucgcgcaccccgccagcuccaccaccguggacaagaagcuggagccgagcggccccaucuccacgaucaaccccugcccgcccugcaaggagugccacaagugccccgcccccaaccuggagggcgggcccagcguguucaucuucccgcccaacaucaaggacguccucaugaucucccugacccccaaggugaccugcguggucguggacgucagcgaggacgaccccgacgugcagaucuccugguucgugaacaacgucgaggugcacaccgcccagacgcagacccaccgggaggacuacaacagcaccauccgcguggucuccacccugccgauccagcaccaggacuggaugagcgggaaggaguucaagugcaaggugaacaacaaggaccuccccagccccaucgagcggacgaucuccaagaucaagggccuggugcgcgcgccccaggucuacauccugccgccgcccgccgagcagcucagccggaaggacgugucccugaccugccugguggucggguucaaccccggcgacaucagcguggaguggaccuccaacggccacaccgaggagaacuacaaggacacggcccccgugcucgacagcgacggguccuacuucaucuacagcaagcugaacaugaagaccuccaagugggagaagaccgacagcuucuccugcaacguccgccacgagggccugaagaacuacuaccucaagaagaccaucagccggucccccgggaag

SEQ ID NO: 7714 - RNA, 639 nt, Artificial Sequence; identical to SEQ ID NO: 7652
  derived and/or modified sequence opt1 from Begelomab_LightChain1

SEQ ID NO: 7715 - RNA, 1353 nt, Artificial Sequence
  derived and/or modified sequence opt1 from Benralizumab_HeavyChain1
gaggugcagcugguccagagcggcgccgaggugaagaagcccggggccuccgugaaggucagcugcaaggcguccggcuacaccuucaccagcuacgugauccacugggugcgccagcggccggggcagggccucgccuggaugggguacaucaaccccuacaacgacggcacgaaguacaacgagcgcuucaagggcaaggucaccaucaccuccgaccggagcaccuccacgguguacauggagcugagcucccugcgcagcgaggacaccgccguguaccucugcgggcgggagggcauccgcuacuacgggcugcugggcgacuacugggggcagggcacccucgucaccguguccagcgccuccacgaagggccccagcguguucccccuggccccguccagcaaguccaccagcgggggcaccgcggcccuggggugccucgucaaggacuacuuccccgagcccgugaccguguccuggaacagcggcgcccugacgagcggcguccacaccuuccccgccgugcugcaguccagcgggcucuacucccugagcuccguggucaccgugccgagcuccagccugggcacccagacguacaucugcaacgugaaccacaagcccuccaacaccaaggucgacaagaagguggagcccaagagcugcgacaagacccacacgugcccgcccugccccgcgcccgagcuccucgggggccccuccguguuccuguucccgcccaagcccaaggacacccugaugaucagccggacccccgaggugaccugcgucgucguggacgugucccacgaggacccggaggucaaguucaacugguacguggacgggguggagguccacaacgccaagaccaagccccgcgaggagcaguacaacagcacguaccgggugguguccguccugaccgugcugcaccaggacuggcucaacggcaaggaguacaagugcaaggugagcaacaaggcccugcccgcccccaucgagaagaccaucuccaaggccaagggccagccgcgcgagccccaggucuacacccugccgcccagccgggacgagcucacgaagaaccaggugucccugaccugccuggugaagggguucuaccccagcgacaucgcggucgagugggagagcaacggccagcccgagaacaacuacaagaccacgcccccggugcucgacuccgacgggagcuucuuccuguacuccaagcugaccguggacaagagccgcuggcagcagggcaacgucuucuccugcagcgugaugcacgaggcccuccacaaccacuacacccagaagucccugagccugucccccgggaag

SEQ ID NO: 7716 - RNA, 642 nt, Artificial Sequence
  derived and/or modified sequence opt1 from Benralizumab_LightChain1
gacauccagaugacccagagccccuccagccuguccgccagcgugggcgaccgcgucaccaucacgugcgggaccuccgaggacaucaucaacuaccucaacugguaccagcagaagccgggcaaggcccccaagcugcugaucuaccacaccagccggcuccaguccggggugcccagccgcuucuccggcagcggguccggcaccgacuucacgcugaccaucagcucccugcagcccgaggacuucgcgaccuacuacugccagcagggcuacacccucccguacacguucgggcagggcaccaagguggagaucaagcggaccgucgccgcccccagcguguucaucuucccgcccuccgacgagcagcucaagagcgggaccgccuccguggucugccugcugaacaacuucuacccccgcgaggccaaggugcaguggaagguggacaacgcgcugcagagcggcaacucccaggagagcgucacggagcaggacagcaaggacuccaccuacagccuguccagcacccucacccuguccaaggccgacuacgagaagcacaagguguacgccugcgaggugacgcaccaggggcugagcucccccgucaccaagagcuucaaccggggcgagugc

SEQ ID NO: 7717 - RNA, 1329 nt, Artificial Sequence
  derived and/or modified sequence opt1 from Betalutin_HeavyChain1
gagauccagcugcagcagagcggccccgagcucgugaagccgggggccuccgucaaggugagcugcaaggccuccggcuacagcuucaccgacuacaacauguacugggugaagcagucccacggcaagagccuggaguggaucggguacaucgaccccuacaacggggacaccaccuacaaccagaaguucaagggcaaggcgacccugaccgucgacaaguccagcuccaccgccuucauccaccucaacagccugacguccgaggacagcgccguguacuacugcgcccgcucccccuacggccacuacgccauggacuacugggggcagggcaccagcgugaccgucuccagcgcgaagaccacgcccccguccguguacccccuggcccccgggagcgccgcccagaccaacuccauggugacccucggcugccuggucaagggguacuuccccgagccggugaccgugacguggaacagcggcagccuguccagcggcguccacaccuuccccgcggugcuccaguccgaccuguacacccugagcuccagcgugaccguccccuccagcacguggcccuccgagaccgugaccugcaacguggcccacccggccagcuccaccaaggucgacaagaagaucgugccccgggacugcgggugcaagcccugcaucugcacggugcccgaggucagcuccguguucaucuucccgcccaagcccaaggacgugcucaccaucacccugacccccaaggucacgugcguggucguggacaucagcaaggacgacccggaggugcaguucuccugguucgucgacgacguggaggugcacaccgcccagacccagccccgcgaggagcaguucaacagcaccuuccgguccgucagcgagcugcccaucaugcaccaggacuggcucaacggcaaggaguucaagugccgcgugaacuccgccgcguuccccgccccgaucgagaagacgaucagcaagaccaaggggcggcccaaggcgccccagguguacaccaucccgccgcccaaggagcagauggccaaggacaaggucagccugaccugcaugaucacggacuucuuccccgaggacaucaccguggaguggcaguggaacggccagcccgccgagaacuacaagaacacccagcccaucauggacaccgacggcuccuacuucguguacagcaagcugaacguccagaaguccaacugggaggccgggaacacguucacgugcagcgugcuccacgagggccugcacaaccaccacaccgagaagucccugagccacucccccgggaag

SEQ ID NO: 7718 - RNA, 642 nt, Artificial Sequence
  derived and/or modified sequence opt1 from Betalutin_LightChain1
gacaucgugaugacccagagccacaagcugcucuccaccagcgugggcgaccgcguguccaucacgugcaaggccagccaggacguguccaccgccgucgacugguaccagcagaagcccgggcagagcccgaagcugcugaucaacugggcguccacccggcacaccggcgugcccgaccgcuucacggggagcggcuccgggaccgacuacacccucaccaucagcuccaugcaggccgaggaccuggcccuguacuacugccggcagcacuacagcacgcccuucaccuucggcuccggcaccaagcucgagaucaagcgcgccgacgccgcgcccaccgugagcaucuucccgcccuccagcgagcagcugacguccgggggcgccagcgucgugugcuuccugaacaacuucuaccccaaggacaucaacgugaaguggaagaucgacggguccgagcggcagaacggcguccucaacagcuggaccgaccaggacagcaaggacuccaccuacagcauguccagcacccugacgcugaccaaggacgaguacgagcgccacaacuccuacacgugcgaggccacccacaagaccagcaccucccccaucgucaagagcuucaaccggaacgagugc

SEQ ID NO: 7719 - RNA, 1344 nt, Artificial Sequence
  derived and/or modified sequence opt1 from Bevacituzuab_HeavyChain1
gaggugcagcuggucgagagcggcgggggccucgugcagcccgggggcucccugcgccugagcugcgccgccuccggguacaccuucaccaacuacggcaacugggugcggcaggcgccgggcaaggggcucgagugggucggcuggaucaacacguacaccggggagcccaccuacgccgccgacuucaagcgccgguucaccuucagccuggacacguccaagagcaccgccuaccugcagaacucccuccgcgccgaggacaccgcgguguacuacugcgccaaguacccccacuacuacggcagcucccacugguacuucgacgugugggggcagggcacccuggucacggugagcuccgccagcaccaagggccccuccguguucccgcuggcccccagcuccaagagcaccuccgggggcaccgcggcccucgggugccuggucaaggacuacuuccccgagcccgugacggugagcuggaacuccggcgcccugaccagcggcguccacaccuucccggccgugcuccagagcuccgggcuguacagccuguccagcguggucaccgugcccuccagcucccucggcacgcagaccuacaucugcaacgugaaccacaagcccagcaacaccaaggucgacaagaagguggagcccaaguccugcgacaagacccacacgugcccgcccugccccgcccccgagcugcucgggggcccgagcguguuccucuucccgcccaagcccaaggacacccugaucucccggacccccgaggugaccugcgucguggucgacgugagccacgaggaccccgaggucaaguucaacugguacguggacgggguggagguccacaacgcgaagacgaagccccgcgaggagcaguacaacuccaccuaccggguggugagcguccugaccgugcuccaccaggacuggcugaacggcaaggaguacaagugcaagguguccaacaaggcccugcccgccccgaucgagaagaccaucagcaaggccaagggccagccccgcgagccccaggucuacacgcugcccccgucccgggaggagaccaagaaccaggugagccugaccugccuggugaagggguucuaccccuccgacaucgccgucgagugggagagcaacggccagcccgagaacaacuacaagaccacgccgcccgugcucgacagcgacggguccuucuuccuguacagcaagcugaccguggacaagucccgcuggcagcagggcaacgucuucagcugcuccgugcacgaggcgcuccacaaccacuacacccagaagucccugagccugagccccgggaag

SEQ ID NO: 7720 - RNA, 639 nt, Artificial Sequence
  derived and/or modified sequence opt1 from Bevacituzuab_LightChain1
gacauccagacgcagagccccuccagccuguccgccagcgugggcgaccgcgucaccaucacgugcuccgccagccaggacaucuccaacuaccucaacugguaccagcagaagccggggaaggcgcccaaggugcugaucuacuucaccagcucccugcacagcggcgugcccucccgguucagcggguccggcagcgggaccgacuucacccucacgaucuccagccugcagcccgaggacuucgccaccuacuacugccagcaguacuccaccgucccguggaccuucggccagggcacgaagguggagaucaagcgcaccguggccgcccccagcgucuucaucuucccgcccuccgacgagcagcucaagagcgggaccgccagcguggugugccugcugaacaacuucuacccccgggaggcgaagguccaguggaagguggacaacgcccugcaguccggcaacagccaggaguccgugaccgagcaggacagcaaggacuccacguacagccucuccagcacccugacccuguccaaggccgacuacgagaagcacaaggucuacgccugcgaggugacccaccaggggcucagcucccccgugaccaagagcuucaaccgcggcgagugc

SEQ ID NO: 7721 - RNA, 639 nt, Artificial Sequence
  derived and/or modified sequence opt1 from Bevacizumab_154-aspartic_acid_LightChain
gacauccagaugacgcagagccccuccagccuguccgccagcgugggcgaccgcgucaccaucacgugcuccgccagccaggacaucuccaacuaccucaacugguaccagcagaagccggggaaggcgcccaaggugcugaucuacuucaccagcucccugcacagcggcgugcccucccgguucagcggguccggcagcgggaccgacuucacccucacgaucuccagccugcagcccgaggacuucgccaccuacuacugccagcaguacuccaccgucccguggaccuucggccagggcacgaagguggagaucaagcgcaccguggccgcccccagcgucuucaucuucccgcccuccgacgagcagcucaagagcgggaccgccagcguggugugccugcugaacaacuucuacccccgggaggcgaagguccaguggaagguggacaacgccgaccaguccggcaacagccaggaguccgugaccgagcaggacagcaaggacuccacguacagccuguccagcacccucacccuguccaaggccgacuacgagaagcacaaggucuacgccugcgaggugacccaccaggggcugagcucccccgugaccaagagcuucaaccgcggcgag

SEQ ID NO: 7722 - RNA, 639 nt, Artificial Sequence; identical to SEQ ID NO: 7721
  derived and/or modified sequence opt1 from Bevacizumab_154-substitution_deriv_LightChain

SEQ ID NO: 7723 - RNA, 672 nt, Artificial Sequence
  derived and/or modified sequence opt1 from Bevacizumab_180-serine_HeavyChain
gaggugcagcuggucgagagcggcgggggccucgugcagcccgggggcucccugcgccugagcugcgccgccuccggguacaccuucaccaacuacggcaugaacugggugcggcaggcgccgggcaaggggcucgagugggucggcuggaucaacacguacaccggggagcccaccuacgccgccgacuucaagcgccgguucaccuucagccuggacacguccaagagcaccgccuaccugcagaugaacucccuccgcgccgaggacaccgcgguguacuacugcgccaaguacccccacuacuacggcagcucccacugguacuucgacgugugggggcagggcacccuggucacggugagcuccgccagcaccaagggccccuccguguucccgcuggcccccagcuccaagagcaccuccgggggcaccgcggcccucgggugccuggucaaggacuacuuccccgagcccgugacggugagcuggaacuccggcgcccugaccagcggcguccacaccuucccggccgugagccaguccagcgggcucuacucccugagcuccguggucaccgugcccagcuccagccugggcacgcagaccuacaucugcaacgugaaccacaagcccuccaacaccaaggucgacaagaagguggagcccaag

SEQ ID NO: 7724 - RNA, 672 nt, Artificial Sequence; identical to SEQ ID NO: 7723
  derived and/or modified sequence opt1 from Bevacizumab_180-substitution_deriv_HeavyCahin

SEQ ID NO: 7725 - RNA, 1359 nt, Artificial Sequence
  derived and/or modified sequence opt1 from Bevacizumab_beta_HeavyChain1
gaggugcagcuggucgagagcggcgggggccucgugcagcccgggggcucccugcgccugagcugcgccgccuccggguacaccuucaccaacuacggcaugaacugggugcggcaggcgccgggcaaggggcucgagugggucggcuggaucaacacguacaccggggagcccaccuacgccgccgacuucaagcgccgguucaccuucagccuggacacguccaagagcaccgccuaccugcagaugaacucccuccgcgccgaggacaccgcgguguacuacugcgccaaguacccccacuacuacggcagcucccacugguacuucgacgugugggggcagggcacccuggucacggugagcuccgccagcaccaagggccccuccguguucccgcuggcccccagcuccaagagcaccuccgggggcaccgcggcccucgggugccuggucaaggacuacuuccccgagcccgugacggugagcuggaacuccggcgcccugaccagcggcguccacaccuucccggccgugcuccagagcuccgggcuguacagccuguccagcguggucaccgugcccuccagcucccucggcacgcagaccuacaucugcaacgugaaccacaagcccagcaacaccaaggucgacaagaagguggagcccaaguccugcgacaagacccacacgugcccgcccugccccgcccccgagcugcucgggggcccgagcguguuccucuucccgcccaagcccaaggacacccugaugaucucccggacccccgaggugaccugcgucguggucgacgugagccacgaggaccccgaggucaaguucaacugguacguggacgggguggagguccacaacgcgaagacgaagccccgcgaggagcaguacaacuccaccuaccggguggugagcguccugaccgugcuccaccaggacuggcugaacggcaaggaguacaagugcaagguguccaacaaggcccugcccgccccgaucgagaagaccaucagcaaggccaagggccagccccgcgagccccaggucuacacgcugcccccgucccgggaggagaugaccaagaaccaggugagccugaccugccuggugaagggguucuaccccuccgacaucgccgucgagugggagagcaacggccagcccgagaacaacuacaagaccacgccgcccgugcucgacagcgacggguccuucuuccuguacagcaagcugaccguggacaagucccgcuggcagcagggcaacgucuucagcugcuccgugaugcacgaggcgcuccacaaccacuacacccagaagucccugagccugagccccgggaag

SEQ ID NO: 7726 - RNA, 642 nt, Artificial Sequence
  derived and/or modified sequence opt1 from Bevacizumab_beta_LightChain1
gacauccagaugacgcagagccccuccagccuguccgccagcgugggcgaccgcgucaccaucacgugcuccgccagccaggacaucuccaacuaccucaacugguaccagcagaagccggggaaggcgcccaaggugcugaucuacuucaccagcucccugcacagcggcgugcccucccgguucagcggguccggcagcgggaccgacuucacccucacgaucuccagccugcagcccgaggacuucgccaccuacuacugccagcaguacuccaccgucccguggaccuucggccagggcacgaagguggagaucaagcgcaccguggccgcccccagcgucuucaucuucccgcccuccgacgagcagcucaagagcgggaccgccagcguggugugccugcugaacaacuucuacccccgggaggcgaagguccaguggaagguggacaacgcccugcaguccggcaacagccaggaguccgugaccgagcaggacagcaaggacuccacguacagccucuccagcacccugacccuguccaaggccgacuacgagaagcacaaggucuacgccugcgaggugacccaccaggggcucagcucccccgugaccaagagcuucaaccgcggcgagugc

SEQ ID NO: 7727 - RNA, 687 nt, Artificial Sequence
  derived and/or modified sequence opt1 from Bevacizumab_FcDomain
agcugcgacaagacccacacgugcccgcccugccccgcccccgagcugcucggcgggcccuccguguuccuguucccgcccaagcccaaggacacccugaugaucagccgcacccccgaggugaccugcgucguggucgacgugucccacgaggacccggaggugaaguucaacugguacgucgacggcguggaggugcacaacgccaagaccaagccccgggaggagcaguacaacagcacguaccgcgucguguccgugcucaccguccugcaccaggacuggcugaacgggaaggaguacaagugcaaggugagcaacaaggcgcuccccgcccccaucgagaagaccaucuccaaggccaagggccagccgcgggagccccagguguacacccugccgcccagccgcgacgagcugacgaagaaccaggucucccugaccugccucgugaagggguucuaccccagcgacaucgccguggagugggaguccaacggccagcccgagaacaacuacaagaccaccccgcccguccuggacagcgacggcuccuucuuccucuacagcaagcugacgguggacaagucccgguggcagcaggggaacguguucagcugcuccgucaugcacgaggcccugcacaaccacuacacccagaagucccucagccugagccccggcaag

SEQ ID NO: 7728 - RNA, 672 nt, Artificial Sequence
  derived and/or modified sequence opt1 from Bevacizumab_HeavyChain
gaggugcagcuggucgagagcggcgggggccucgugcagcccgggggcucccugcgccugagcugcgccgccuccggguacaccuucaccaacuacggcaugaacugggugcggcaggcgccgggcaaggggcucgagugggucggcuggaucaacacguacaccggggagcccaccuacgccgccgacuucaagcgccgguucaccuucagccuggacacguccaagagcaccgccuaccugcagaugaacucccuccgcgccgaggacaccgcgguguacuacugcgccaaguacccccacuacuacggcagcucccacugguacuucgacgugugggggcagggcacccuggucacggugagcuccgccagcaccaagggccccuccguguucccgcuggcccccagcuccaagagcaccuccgggggcaccgcggcccucgggugccuggucaaggacuacuuccccgagcccgugacggugagcuggaacuccggcgcccugaccagcggcguccacaccuucccggccgugcuccagagcuccgggcuguacagccuguccagcguggucaccgugcccuccagcucccucggcacgcagaccuacaucugcaacgugaaccacaagcccagcaacaccaaggucgacaagaagguggagcccaag

SEQ ID NO: 7729 - RNA, 1428 nt, Artificial Sequence
  derived and/or modified sequence opt1 from Bevacizumab_HeavyChain_variant1
gccagcgccaccaugggcugguccugcaucauccuguuccucguggcgaccgccacggggguccacagcgaggugcagcugguggaguccggcgggggccugguccagcccgggggcagccuccgccuguccugcgccgccagcggcuacaccuucaccaacuacgggaugaacugggugcggcaggccccgggcaaggggcuggagugggugggcuggaucaacaccuacacgggggagcccaccuacgcggccgacuucaagcgccgguucaccuucucccucgacaccagcaaguccacggccuaccugcagaugaacagccugcgcgccgaggacaccgcggucuacuacugcgccaaguacccccacuacuacggcuccagccacugguacuucgacguguggggccaggggacccucgugaccgucuccagcgccuccacgaagggccccagcguguucccgcuggcccccuccagcaaguccaccagcgggggcaccgccgcgcugggcugccucgugaaggacuacuuccccgagcccgucaccgugagcuggaacuccggggcccugacgagcggcgugcacaccuucccggccguccugcaguccagcgggcucuacucccugagcuccguggugaccguccccagcuccagccugggcacccagacguacaucugcaacgugaaccacaagcccuccaacaccaagguggacaagaaggucgagcccaagagcugcgacaagacccacacgugcccgcccugccccgcccccgagcuccucgggggcccguccguguuccuguucccgcccaagcccaaggacacccucaugaucagccggacccccgaggugaccugcgucguggucgacgugucccacgaggaccccgaggugaaguucaacugguacgucgacggcguggaggugcacaacgccaagaccaagccccgcgaggagcaguacaacagcacguaccgggucguguccgugcugaccguccugcaccaggacuggcucaacgggaaggaguacaagugcaaggugagcaacaaggcgcugcccgccccgaucgagaagaccaucuccaaggccaagggccagccccgcgagccccagguguacacccugcccccgagccgggaggagaugacgaagaaccaggucagccugaccugccuggugaagggguucuaccccuccgacaucgccguggagugggagagcaacggccagcccgagaacaacuacaagaccaccccgcccguccuggacuccgacgggagcuucuuccucuacuccaagcugacgguggacaagagccgcuggcagcagggcaacguguucuccugcagcgucaugcacgaggcccugcacaaccacuacacccagaagucccucagccugucccccggcaag

SEQ ID NO: 7730 - RNA, 369 nt, Artificial Sequence
  derived and/or modified sequence opt1 from Bevacizumab_HeavyChain_V-Region
gaggugcagcuggucgagagcggcgggggccucgugcagcccgggggcucccugcgccugagcugcgccgccuccggguacaccuucaccaacuacggcaugaacugggugcggcaggcgccgggcaaggggcucgagugggucggcuggaucaacacguacaccggggagcccaccuacgccgccgacuucaagcgccgguucaccuucagccuggacacguccaagagcaccgccuaccugcagaugaacucccuccgcgccgaggacaccgcgguguacuacugcgccaaguacccccacuacuacggcagcucccacugguacuucgacgugugggggcagggcacccuggucacggugagcucc

SEQ ID NO: 7731 - RNA, 717 nt, Artificial Sequence
  derived and/or modified sequence opt1 from Bevacizumab_LightChain1
gccagcaagcuggccaccaugggcugguccugcaucauccucuuccugguggcgaccgccacggggguccacagcgacauccagaugacccagucccccagcucccugagcgccuccgugggcgaccgcgugaccaucacgugccgggccagccaggacaucuccagcuaccucaacugguaccagcagaagccggggaaggcccccaagcugcugaucuacuacaccucccgccuccacagcggcguccccucccgguucagcggguccggcagcggcaccgacuucaccuucaccaucuccagccugcagcccgaggacaucgcgacguacuacugccagcaggggaacacccugccguacaccuucggccaggggaccaagguggagaucaagcgcacgguggccgcccccuccgucuucaucuucccgcccagcgacgagcagcucaagagcggcaccgccuccguggugugccugcugaacaacuucuacccccgggaggcgaagguccaguggaagguggacaacgcccuccagagcgggaacucccaggagagcgugaccgagcaggacuccaaggacagcaccuacucccugagcuccacgcugacccucagcaaggccgacuacgagaagcacaaggucuacgccugcgaggugacccaccagggccuguccagccccgugaccaaguccuucaaccgcggcgagugc

SEQ ID NO: 7732 - RNA, 711 nt, Artificial Sequence
  derived and/or modified sequence opt1 from Bevacizumab_LightChain2
gccagcgccaccaugggcugguccugcaucauccuguuccucguggcgaccgccacggggguccacagcgacauccagaugacccagucccccagcucccugagcgccuccgugggcgaccgcgugaccaucacgugcagcgccucccaggacaucagcaacuaccugaacugguaccagcagaagccggggaaggcccccaagguccucaucuacuucaccuccagccugcacuccggcgugcccagccgguucuccgggagcggcuccggcaccgacuucacccugaccaucagcucccuccagcccgaggacuucgcgacguacuacugccagcaguacagcaccgugccguggaccuucgggcagggcaccaaggucgagaucaagcgcacgguggccgcccccagcguguucaucuucccgcccuccgacgagcagcucaagagcgggaccgccuccgucgugugccugcugaacaacuucuacccccgggaggcgaaggugcaguggaaggucgacaacgcccugcagagcggcaacucccaggagagcgugaccgagcaggacuccaaggacagcaccuacucccugagcuccacgcucacccugagcaaggccgacuacgagaagcacaagguguacgccugcgaggucacccaccaggggcuguccagccccgugaccaaguccuucaaccgcggcgagugc

SEQ ID NO: 7733 - RNA, 642 nt, Artificial Sequence; identical to SEQ ID NO: 7726
  derived and/or modified sequence opt1 from Bevacizumab_LightChain

SEQ ID NO: 7734 - RNA, 324 nt, Artificial Sequence
  derived and/or modified sequence opt1 from Bevacizumab_LightChain_VJ-Region
gacauccagaugacccagagccccuccagccuguccgccagcgugggcgaccgcgucaccaucacgugcuccgccagccaggacaucuccaacuaccucaacugguaccagcagaagccggggaaggcgcccaaggugcugaucuacuucaccagcucccugcacagcggcgugcccucccgguucagcggguccggcagcgggaccgacuucacccucacgaucuccagccugcagcccgaggacuucgccaccuacuacugccagcaguacuccaccgucccguggaccuucggccagggcacgaagguggagaucaagcgc

SEQ ID NO: 7735 - RNA, 321 nt, Artificial Sequence
  derived and/or modified sequence opt1 from Bevacizumab_LightChain_V-Region
gacauccagaugacccagagccccuccagccuguccgccagcgugggcgaccgcgucaccaucacgugcuccgccagccaggacaucuccaacuaccucaacugguaccagcagaagccggggaaggcgcccaaggugcugaucuacuucaccagcucccugcacagcggcgugcccucccgguucagcggguccggcagcgggaccgacuucacccucacgaucuccagccugcagcccgaggacuucgccaccuacuacugccagcaguacuccaccgucccguggaccuucggccagggcacgaagguggagaucaag

SEQ ID NO: 7736 - RNA, 369 nt, Artificial Sequence; identical to SEQ ID NO: 7730
  derived and/or modified sequence opt1 from Bevacizumab-rhuMAb-VEGF_HeavyChain_gamma1-Chain_VDJ-Region

SEQ ID NO: 7737 - RNA, 321 nt, Artificial Sequence; identical to SEQ ID NO: 7735
  derived and/or modified sequence opt1 from Bevacizumab-rhuMAb-VEGF_LightChain_VJ-Region

SEQ ID NO: 7738 - RNA, 1341 nt, Artificial Sequence
  derived and/or modified sequence opt1 from Bevacizumab_gamma1-Chain
gaggugcagcuggucgagagcggcgggggccucgugcagcccgggggcucccugcgccugagcugcgccgccuccggguacaccuucaccaacuacggcaugaacugggugcggcaggcgccgggcaaggggcucgagugggucggcuggaucaacacguacaccggggagcccaccuacgccgccgacuucaagcgccgguucaccuucagccuggacacguccaagagcaccgccuaccugcagaugaacucccuccgcgccgaggacaccgcgguguacuacugcgccaaguacccccacuacuacggcagcucccacugguacuucgacgugugggggcagggcacccuggucacggugagcuccgccagcaccaagggccccuccguguucccgcuggcccccagcuccaagagcaccuccgggggcaccgcggcccucgggugccuggucaaggacuacuuccccgagcccgugacggugagcuggaacuccggcgcccugaccagcggcguccacaccuucccggccgugcuccagagcuccgggagccuguccagcguggucaccgugcccuccagcucccugggcacgcagaccuacaucugcaacgugaaccacaagcccagcaacaccaaggucgacaagaagguggagcccaaguccugcgacaagacccacacgugcccgcccugccccgcccccgagcuccucgggggcccgagcguguuccuguucccgcccaagcccaaggacacccugaugaucucccggacccccgaggugaccugcgucguggucgacgugagccacgaggaccccgaggucaaguucaacugguacguggacgggguggagguccacaacgcgaagacgaagccccgcgaggagcaguacaacuccuacguggugagcguccugaccgugcugcaccaggacuggcucaacggcaaggaguacaagugcaagguguccaacaaggcccugcccgccccgaucgagaagaccaucagcaaggccaagggccagccccgggagccccaggucuacacccugcccccgucccgcgacgagcucacgaagaaccaggugagccugaccugccuggugaagggguucuaccccuccgacaucgccgucgagugggagagcaacggccagcccgagaacaacuacaagaccaccccgcccgugcucgacagcgacggguccuucuucaagaagcugacgguggacaagagccgguggcagcagggcaacgucuucuccugcagcgugaugcacgaggcgcugcacaaccacuacacccagaagucccucagccugucccccgggaag

SEQ ID NO: 7739 - RNA, 1359 nt, Artificial Sequence
  derived and/or modified sequence opt1 from Bevacizumab_gamma1-Chain_CH3-Region_mutein
gaggugcagcuggucgagagcggcgggggccucgugcagcccgggggcucccugcgccugagcugcgccgccuccggguacaccuucaccaacuacggcaugaacugggugcggcaggcgccgggcaaggggcucgagugggucggcuggaucaacacguacaccggggagcccaccuacgccgccgacuucaagcgccgguucaccuucagccuggacacguccaagagcaccgccuaccugcagaugaacucccuccgcgccgaggacaccgcgguguacuacugcgccaaguacccccacuacuacggcagcucccacugguacuucgacgugugggggcagggcacccuggucacggugagcuccgccagcaccaagggccccuccguguucccgcuggcccccagcuccaagagcaccuccgggggcaccgcggcccucgggugccuggucaaggacuacuuccccgagcccgugacggugagcuggaacuccggcgcccugaccagcggcguccacaccuucccggccgugcuccagagcuccgggcuguacagccuguccagcguggucaccgugcccuccagcucccucggcacgcagaccuacaucugcaacgugaaccacaagcccagcaacaccaaggucgacaagaagguggagcccaaguccugcgacaagacccacacgugcccgcccugccccgcccccgagcugcucgggggcccgagcguguuccucuucccgcccaagcccaaggacacccugaugaucucccggacccccgaggugaccugcgucguggucgacgugagccacgaggaccccgaggucaaguucaacugguacguggacgggguggagguccacaacgcgaagacgaagccccgcgaggagcaguacaacuccaccuaccggguggugagcguccugaccgugcuccaccaggacuggcugaacggcaaggaguacaagugcaagguguccaacaaggcccugcccgccccgaucgagaagaccaucagcaaggccaagggccagccccgcgagccccaggucugcacgcugcccccgucccgggacgagcugaccaagaaccaggugagccuguccugcgccgugaagggguucuaccccagcgacaucgcggucgagugggagagcaacggccagcccgagaacaacuacaagaccaccccgcccgugcucgacuccgacgggagcuucuuccugguguccaagcugacggucgacaagagccgcuggcagcagggcaacguguucuccugcagcgugaugcacgaggcccuccacaaccacuacacccagaagucccugagccugucccccgggaag

SEQ ID NO: 7740 - RNA, 1347 nt, Artificial Sequence; identical to SEQ ID NO: 7653
  derived and/or modified sequence opt1 from Bezlotoxumab_HeavyChain1

SEQ ID NO: 7741 - RNA, 645 nt, Artificial Sequence; identical to SEQ ID NO: 7654
  derived and/or modified sequence opt1 from Bezlotoxumab_LightChain1

SEQ ID NO: 7742 - RNA, 1335 nt, Artificial Sequence
  derived and/or modified sequence opt1 from Bimagrumab_HeavyChain1
caggugcagcugguccagagcggcgccgaggugaagaagcccggggccuccgugaaggucagcugcaaggcguccggcuacaccuucaccagcuccuacaucaacugggugcgccaggccccggggcagggccucgaguggauggggacgaucaaccccgugagcggcuccaccagcuacgcccagaaguuccagggccgggucaccaugacccgcgacacguccaucagcaccgccuacauggagcugucccggcugcgcagcgacgacaccgccguguacuacugcgcgcgcgggggcugguucgacuacugggggcagggcacccucgugacggucuccagcgccuccaccaaggggcccagcguguucccccuggccccguccagcaaguccaccagcggcggcaccgccgcgcuggggugccucgugaaggacuacuuccccgagcccgucacggugagcuggaacuccggcgcccugaccagcggggugcacaccuuccccgccguccugcaguccagcggccucuacucccugagcuccguggugaccgucccgagcuccagccugggcacgcagaccuacaucugcaacgugaaccacaagcccuccaacaccaagguggacaagcgggucgagcccaagagcugcgacaagacccacacgugcccgcccugccccgcccccgaggccgccgggggccccuccguguuccucuucccgcccaagcccaaggacacccugaugaucagccggacccccgaggugaccugcgucguggucgacgugucccacgaggacccggaggugaaguucaacugguacgucgacgggguggaggugcacaacgcgaagacgaagccccgcgaggagcaguacaacagcaccuaccgggucguguccgugcugaccguccuccaccaggacuggcugaacggcaaggaguacaagugcaaggugagcaacaaggcccugcccgcccccaucgagaagaccaucuccaaggccaaggggcagccgcgcgagccccagguguacacgcucccgcccagccgggaggagaugaccaagaaccaggucagccugaccugccuggugaagggcuucuaccccuccgacaucgcgguggagugggagagcaacggccagcccgagaacaacuacaagaccacgcccccgguccucgacuccgacgggagcuucuuccuguacuccaagcugaccguggacaagagccgcuggcagcagggcaacguguucuccugcagcgucaugcacgaggcccuccacaaccacuacacccagaagucccugagccugucccccgggaag

SEQ ID NO: 7743 - RNA, 1332 nt, Artificial Sequence
  derived and/or modified sequence opt1 from Bimagrumab_HeavyChain
caggugcagcugguccagagcggcgccgaggugaagaagcccggggccuccgugaaggucagcugcaaggcguccggcuacaccuucaccagcuccuacaucaacugggugcgccaggccccggggcagggccucgaguggauggggacgaucaaccccgugagcggcuccaccagcuacgcccagaaguuccagggccgggucaccaugacccgcgacacguccaucagcaccgccuacauggagcugucccggcugcgcagcgacgacaccgccguguacuacugcgcgcgcgggggcugguucgacuacugggggcagggcacccucgugacggucuccagcgccuccaccaaggggcccagcguguucccccuggccccguccagcaaguccaccagcggcggcaccgccgcgcuggggugccucgugaaggacuacuuccccgagcccgucacggugagcuggaacuccggcgcccugaccagcggggugcacaccuuccccgccguccugcaguccagcggccucuacucccugagcuccguggugaccgucccgagcuccagccugggcacgcagaccuacaucugcaacgugaaccacaagcccuccaacaccaagguggacaagcgggucgagcccaagagcugcgacaagacccacacgugcccgcccugccccgcccccgaggccgccgggggccccuccguguuccucuucccgcccaagcccaaggacacccugaugaucagccggacccccgaggugaccugcgucguggucgacgugucccacgaggacccggaggugaaguucaacugguacgucgacgggguggaggugcacaacgcgaagacgaagccccgcgaggagcaguacaacagcaccuaccgggucguguccgugcugaccguccuccaccaggacuggcugaacggcaaggaguacaagugcaaggugagcaacaaggcccugcccgcccccaucgagaagaccaucuccaaggccaaggggcagccgcgcgagccccagguguacacgcucccgcccagccgggaggagaugaccaagaaccaggucagccugaccugccuggugaagggcuucuaccccuccgacaucgcgguggagugggagagcaacggccagcccgagaacaacuacaagaccacgcccccgguccucgacuccgacgggagcuucuuccuguacuccaagcugaccguggacaagagccgcuggcagcagggcaacguguucuccugcagcgucaugcacgaggcccuccacaaccacuacacccagaagucccugagccugucccccggg

SEQ ID NO: 7744 - RNA, 651 nt, Artificial Sequence
  derived and/or modified sequence opt1 from Bimagrumab_LightChain1
cagagcgcccugacccagcccgccuccgugagcggcuccccggggcagagcaucaccaucuccugcacgggcaccagcuccgacgucgggagcuacaacuacgugaacugguaccagcagcaccccggcaaggcgcccaagcucaugaucuacgggguguccaagcgccccagcggcgucuccaaccgguucagcggcuccaagagcgggaacaccgccucccugaccaucagcggccugcaggccgaggacgaggccgacuacuacugcgggacguucgccggcggguccuacuacggcguguucggcgggggcaccaagcucaccgugcuggggcagccgaaggcggcccccagcgucacccuguucccgcccuccagcgaggagcuccaggccaacaaggccacgcuggugugccugaucagcgacuucuaccccggcgcggugaccgucgccuggaaggccgacuccagccccgugaaggccggcguggagaccaccacgcccuccaagcagagcaacaacaaguacgccgcguccagcuaccucucccugacccccgagcaguggaagucccaccgcagcuacagcugccaggucacccacgagggguccaccguggagaagacgguggccccgaccgagugcagc

SEQ ID NO: 7745 - RNA, 1365 nt, Artificial Sequence
  derived and/or modified sequence opt1 from Bimekizumab_HeavyChain1
gaggugcagcuggucgagagcggcgggggccucgugcagcccgggggcucccugcgccugagcugcgccgccuccggguucaccuucagcgacuacaacauggcgugggugcggcaggccccgggcaagggccucgagugggucgccaccaucacguacgaggggcgcaacaccuacuaccgggacuccgugaagggccgcuucaccaucagccgggacaacgccaagaacucccuguaccugcagaugaacagccuccgcgccgaggacaccgcgguguacuacugcgccuccccgccccaguacuacgaggggagcaucuaccggcugugguucgcccacuggggccaggggacgcuggucaccguguccagcgccuccaccaagggccccagcguguucccccucgcgcccuccagcaaguccaccagcggcgggacggccgcccugggcugccuggucaaggacuacuuccccgagcccgugaccguguccuggaacagcggggcccucaccagcggcguccacaccuucccggccgugcugcaguccagcggccuguacucccucagcuccguggucacggugcccagcuccagccuggggacccagaccuacaucugcaacgugaaccacaagcccuccaacaccaaggucgacaagaagguggagcccaagagcugcgacaagacgcacacgugcccgcccugccccgcgcccgagcugcucggcgggccguccguguuccuguucccgcccaagcccaaggacacccugaugaucagccgcacccccgaggugaccugcgucguggucgacgugucccacgaggaccccgaggucaaguucaacugguacguggacggcguggagguccacaacgccaagaccaagccccgggaggagcaguacaacagcaccuaccgcgugguguccguccucaccgugcugcaccaggacuggcugaacgggaaggaguacaagugcaaggugagcaacaaggcccuccccgccccgaucgagaagacgaucuccaaggccaagggccagccccgggagccccaggucuacacccugcccccgagccgcgacgagcugaccaagaaccaggugucccugaccugccucgugaagggcuucuaccccagcgacaucgcggucgagugggagagcaacgggcagcccgagaacaacuacaagacgaccccgcccgugcuggacuccgacggcagcuucuuccucuacuccaagcugaccguggacaagagccgguggcagcaggggaacgucuucuccugcagcgugaugcacgaggcccugcacaaccacuacacccagaagucccucagccugucccccggcaag

SEQ ID NO: 7746 - RNA, 642 nt, Artificial Sequence
  derived and/or modified sequence opt1 from Bimekizumab_LightChain1
gccauccagcugacccagagccccuccagccucuccgccagcgugggcgaccgcgucaccaucacgugccgggcggacgaguccgugcgcacccugaugcacugguaccagcagaagccggggaaggcccccaagcugcucaucuaccuggugagcaacuccgagaucggcguccccgaccgguucagcggguccggcagcgggaccgacuuccgccugaccaucuccagccuccagcccgaggacuucgccacguacuacugccagcagaccugguccgacccguggaccuucggccagggcaccaagguggagaucaagcggacgguggccgcccccagcgucuucaucuucccgcccuccgacgagcagcucaagagcgggaccgcguccguggugugccugcugaacaacuucuacccccgcgaggccaagguccaguggaagguggacaacgcccugcagagcggcaacucccaggagagcgugaccgagcaggacagcaaggacuccaccuacagccuguccagcacgcucacccuguccaaggccgacuacgagaagcacaaggucuacgcgugcgaggugacccaccaggggcugagcucccccgugaccaagagcuucaaccggggcgagugc

SEQ ID NO: 7747 - RNA, 1344 nt, Artificial Sequence
  derived and/or modified sequence opt1 from Bleselumab_HeavyChain1
cagcugcagcuccaggagagcggccccgggcugcugaagccguccgagacccucagccugaccugcacgguguccggcgggagcaucuccagccccggcuacuacgggggcuggauccgccagccgcccggcaaggggcuggaguggaucggcuccaucuacaagagcggguccaccuaccacaaccccagccucaagucccgggucaccaucagcguggacaccuccaagaaccaguucagccugaagcuguccagcgugacggccgccgacaccgcggucuacuacugcacccgccccguggugcgguacuucggcugguucgaccccugggggcagggcacccucgucacgguguccagcgccuccaccaagggccccagcguguucccgcuggcccccugcagccgcuccaccagcgaguccaccgccgcccuggggugccucgucaaggacuacuuccccgagcccgugacggugagcuggaacuccggcgcgcugaccagcgggguccacaccuucccggccgugcugcaguccagcggccucuacucccugagcuccguggucaccgugcccagcuccagccugggcacgaagaccuacacgugcaacguggaccacaagcccuccaacaccaaggucgacaagcggguggagagcaaguacgggcccccgugcccgcccugccccgcccccgaguucgagggcgggcccuccguguuccucuucccgcccaagcccaaggacacccugaugaucagccgcacccccgaggugaccugcgucguggucgacgugucccaggaggaccccgagguccaguucaacugguacguggacggcguggagguccacaacgccaagaccaagccccgggaggagcaguucaacagcacguaccgcguggugagcguccugaccgugcuccaccaggacuggcugaacgggaaggaguacaagugcaagguguccaacaagggccugccgagcuccaucgagaagaccaucagcaaggcgaagggccagccccgggagccccaggucuacacccucccgcccucccaggaggagaugacgaagaaccaggugagccugaccugccuggugaagggguucuaccccuccgacaucgccgucgagugggagagcaacggccagcccgagaacaacuacaagaccaccccgcccgugcucgacuccgacgggagcuucuuccuguacucccgccugacgguggacaagagccgguggcaggagggcaacgucuucuccugcagcgugaugcacgaggcccuccacaaccacuacacccagaagucccugagccugucccucgggaag

SEQ ID NO: 7748 - RNA, 639 nt, Artificial Sequence
  derived and/or modified sequence opt1 from Bleselumab_LightChain1
gccauccagcugacccagagccccuccagccucuccgccagcgugggcgaccgggucaccaucacgugccgggcgucccaggggaucagcuccgcccuggccugguaccagcagaagccgggcaaggcccccaagcugcucaucuacgacgccagcaaccuggaguccggggugcccagccgcuucuccggcagcggguccggcaccgacuucacccugaccaucagcucccuccagcccgaggacuucgcgacguacuacugccagcaguucaacagcuacccgaccuucggccaggggaccaagguggagaucaagcggaccgucgccgcccccuccguguucaucuucccgcccagcgacgagcagcugaaguccggcacggccagcguggucugccugcucaacaacuucuacccccgcgaggcgaaggugcaguggaagguggacaacgcccugcagagcgggaacucccaggagagcgucaccgagcaggacuccaaggacagcaccuacucccugagcuccacccucacgcugagcaaggccgacuacgagaagcacaagguguacgccugcgaggugacccaccagggccuguccagccccgucaccaaguccuucaaccgcggggagugc

SEQ ID NO: 7749 - RNA, 1512 nt, Artificial Sequence
  derived and/or modified sequence opt1 from Blinatumomab_HeavyChain1
gacauccagcugacccagagccccgccucccucgccgugagccugggccagcgcgcgaccaucuccugcaaggccagccaguccgucgacuacgacggggacagcuaccugaacugguaccagcagaucccgggccagccgcccaagcuccugaucuacgacgccuccaaccuggugagcgggaucccgccccgguucuccggcagcggguccggcacggacuucacccucaacauccaccccguggagaaggucgacgccgccaccuaccacugccagcagagcaccgaggaccccuggacguucggcgggggcaccaagcuggagaucaagggcggcgggggcuccggcgggggcgggagcggcggcgggggcucccaggugcagcugcagcagagcggggcggagcucgugcgccccggcuccagcgucaagaucuccugcaaggccagcggguacgccuucagcuccuacuggaugaacugggugaagcagcggcccggccagggccuggaguggaucgggcagaucuggcccggcgacggggacaccaacuacaacggcaaguucaaggggaaggccacccugacggcggacgagagcuccagcaccgccuacaugcagcucuccagccuggccuccgaggacagcgccguguacuucugcgcccgccgggagaccaccacggucggccgcuacuacuacgcgauggacuacuggggccaggggaccaccgugaccguguccagcggcgggggcggguccgacaucaagcugcagcagagcggcgccgagcucgcccggcccggcgccuccgucaagaugagcugcaagacguccggguacaccuucacccgcuacaccaugcacugggugaagcagcggcccggccaggggcuggaguggaucggcuacaucaacccgagccgcggcuacacgaacuacaaccagaaguucaaggacaaggccacccugaccaccgacaaguccagcuccacggcguacaugcagcucagcagccugaccuccgaggacagcgccguguacuacugcgcccgguacuacgacgaccacuacugccuggacuacugggggcagggcaccacccucacggucuccagcguggagggcggguccggcgggagcggcggguccggcgggagcggcgggguggacgacauccagcugacccagucccccgccaucaugagcgccucccccggggagaaggucaccaugaccugccgcgcgagcuccagcguguccuacaugaacugguaccagcagaaguccggcacgagccccaagcgguggaucuacgacaccagcaagguggccagcggggucccguaccgcuucuccggcagcggguccggcaccagcuacucccugaccaucagcuccauggaggccgaggacgccgccacguacuacugccagcaguggagcuccaacccccucaccuucggggcgggcaccaagcuggagcugaagcaccaccaccaccaccac

SEQ ID NO: 7750 - RNA, 1512 nt, Artificial Sequence; identical to SEQ ID NO: 7749
  derived and/or modified sequence opt1 from Blinatumomab_SingleChain

SEQ ID NO: 7751 - RNA, 1512 nt, Artificial Sequence; identical to SEQ ID NO: 7749
  derived and/or modified sequence opt1 from Blinatumumab_SingleChain_variable_fragment_fusion_protein_(bite)

SEQ ID NO: 7752 - RNA, 1344 nt, Artificial Sequence
  derived and/or modified sequence opt1 from Blontuvetmab_HeavyChain
caggugcagcugcagcagagccgcgccgagcucguccggcccggcgccuccgugacccugagcugcaagcccuccggguacaccuucacggacuacgaggugcacugggucaagcagacccccgugcacggccuggaguggaucggggcgaucgaccccgagaccggcgggaccgccgacaaccagaaguucaagggcaaggccauccucacggccgacaagagcuccagcaccgccuacauggagcugcgcucccugaccagcgaggacuccgcgguguacuacugcaccaacuucgucgacguguggggcacggggaccaccgugaccgucagcuccgccagcacgaccgcccccuccguguucccgcucgcccccagcugcggcucccagagcggguccaccguggcgcuggccugccuggucagcggcuacuuccccgagcccgugaccguguccuggaacagcgggagccucacguccggcguccacaccuucccgagcgugcugcaguccagcggccuguacucccucagcuccauggugaccguccccagcucccgguggcccagcgagaccuucacgugcaacguggcccaccccgccuccaagaccaagguggacaagccgguccccaagcgcgagaacgggcgggugccccggcccccggacugccccaagugccccgcccccgagaugcugggcgggccgagcguguucaucuucccgcccaagcccaaggacacccugcucaucgcgcgcacccccgaggucacgugcguggucguggaccuggaccccgaggaccccgaggugcagaucuccugguucgucgacggcaagcagaugcagaccgccaagacccagccccgcgaggagcaguucaacggcaccuaccggguggugagcguccugccgaucgggcaccaggacuggcucaagggcaagcaguucacgugcaaggugaacaacaaggcccugcccucccccaucgagcgcaccaucagcaaggcccgggggcaggcccaccagccguccguguacguccugccgcccagccgcgaggagcucuccaagaacaccgugagccugaccugccugaucaaggacuucuucccgcccgacaucgacguggaguggcagagcaacggccagcaggagcccgaguccaaguaccggacgaccccgccccagcucgacgaggacgggagcuacuuccuguacuccaagcugagcgucgacaagucccgcuggcagcggggcgacaccuucaucugcgcggugaugcacgaggcccuccacaaccacuacacccagaagucccugagccacagccccggcaag

SEQ ID NO: 7753 - RNA, 657 nt, Artificial Sequence
  derived and/or modified sequence opt1 from Blontuvetmab_LightChain
gacguggucaugagccagucccccagcucccuggccgugagcgugggcgagaaggucaccauguccugcaagagcucccagagccuccuguacuccgggaaccagaagaacuaccuggccugguaccagcagaagccgggccagagcccccgccuccugaucuacugggcguccacccgggagagcggggugcccgaccgcuucacgggcuccgggagcggcaccgacuucacccugaccaucuccagcgugaaggccgaggaccucgccgucuucuacugccagcaguacuacaacuacccccugacguucggcgggggcacccaccugaccgugcucgggcagccgaaggccucccccagcgugacccuguucccgcccuccagcgaggagcugggcgccaacaaggcgacgcucgucugccugaucagcgacuucuaccccuccggggugaccguggccuggaaggccgacggcagccccaucacccagggcgucgagaccacgaagcccuccaagcagagcaacaacaaguacgccgcguccagcuaccugucccucacccccgacaaguggaagucccacagcagcuucuccugccuggugacccacgaggggagcaccguggagaagaaggucgccccggccgagugcucc

SEQ ID NO: 7754 - RNA, 1332 nt, Artificial Sequence
  derived and/or modified sequence opt1 from Blosozumab_HeavyChain1
caggugcagcugguccagagcggcgccgaggugaagaagcccggggccuccgugaaggucagcugcaagguguccggcuucccgaucaaggacaccuuccagcacugggugcgccaggcgcccgggaagggccucgaguggaugggguggagcgaccccgagaucggcgacaccgaguacgccuccaaguuccagggccgggucacgaugaccgaggacaccagcaccgacacggccuacauggagcuguccagccugcgcuccgaggacaccgccguguacuacugcgccaccggggacaccacguacaaguucgacuucuggggccaggggaccaccgugaccgucagcuccgcgagcacgaagggccccuccguguucccgcucgcccccugcagccgguccaccagcgaguccaccgccgcccuggggugccuggugaaggacuacuuccccgagcccgucaccgugagcuggaacuccggcgcgcucacgagcggcgugcacaccuucccggccguccugcagagcuccgggcuguacagccucuccagcguggugaccguccccuccagcucccugggcaccaagacguacacgugcaacguggaccacaagcccagcaacaccaagguggacaagcgcgucgaguccaaguacgggcccccgugcccgcccugccccgcccccgaguuccugggcggccccagcguguuccucuucccgcccaagcccaaggacacccugaugaucucccggacccccgaggugaccugcgucguggucgacgugagccaggaggaccccgaggugcaguucaacugguacgucgacgggguggaggugcacaacgccaagaccaagccccgcgaggagcaguucaacuccaccuaccgggucgugagcgugcugacgguccuccaccaggacuggcugaacggcaaggaguacaagugcaagguguccaacaaggggcugccgagcuccaucgagaagaccaucagcaaggccaagggccagccccgcgagccccagguguacacccugcccccgucccaggaggagaugaccaagaaccaggucagccucacgugccuggugaagggguucuaccccagcgacaucgcgguggagugggaguccaacggccagcccgagaacaacuacaagaccaccccgcccguccucgacagcgacggcuccuucuuccuguacagccggcugaccguggacaagucccgcuggcaggaggggaacguguucagcugcuccgucaugcacgaggcccuccacaaccacuacacgcagaagucccugagccugagccucggc

SEQ ID NO: 7755 - RNA, 642 nt, Artificial Sequence
  derived and/or modified sequence opt1 from Blosozumab_LightChain1
gacauccagaugacccagagccccuccagccuguccgccagcgugggcgaccgggucaccaucacgugcaaggccucccaggacgugcacaccgcgguggccugguaccagcagaagccggggaaggcccccaagcuccugaucuacugggccagcacccgguggaccggcguccccucccgcuucagcggguccggcagcgggacggacuucacccugaccaucuccagccuccagcccgaggacuucgccaccuacuacugccagcaguacuccgacuacccguggacguucggcggcgggaccaagguggagaucaagcggaccguggcggcccccagcgucuucaucuucccgcccuccgacgagcagcucaagagcggcaccgccuccguggugugccugcugaacaacuucuacccccgcgaggccaagguccaguggaagguggacaacgcgcugcagagcgggaacucccaggagagcgugacggagcaggacagcaaggacuccaccuacagccuguccagcacccucacccuguccaaggccgacuacgagaagcacaaggucuacgccugcgaggugacgcaccagggccugagcucccccgugaccaagagcuucaaccgcggggagugc

SEQ ID NO: 7756 - RNA, 1332 nt, Artificial Sequence
  derived and/or modified sequence opt1 from Bococizumab_HeavyChain1
caggugcagcugguccagagcggcgccgaggugaagaagcccggggccuccgugaaggucagcugcaaggcguccggcuacaccuucaccagcuacuacaugcacugggugcgccaggccccggggcagggccucgaguggaugggggagaucucccccuucggcggccggacgaacuacaacgagaaguucaagagccgcgugaccaugacccgggacaccuccacgagcaccgucuacauggagcuguccagccugcgcuccgaggacaccgccguguacuacugcgcccgggagcgcccccucuacgccagcgaccugugggggcagggcaccacggugaccgucuccagcgcguccaccaaggggcccagcguguucccgcuggcccccugcucccggagcaccuccgagagcacggccgcccucggcugccuggugaaggacuacuuccccgagcccgucaccgugagcuggaacuccggggcgcugaccagcggcgugcacaccuucccggccguccuccaguccagcggccuguacucccugagcuccguggugacgguccccagcuccaacuucgggacccagaccuacacgugcaacguggaccacaagcccagcaacaccaagguggacaagaccgucgagcgcaagugcugcguggagugcccgcccugccccgccccgcccguggccggccccuccgucuuccucuucccgcccaagcccaaggacacccugaugaucagccggacccccgaggugacgugcgucgugguggacgucucccacgaggaccccgaggugcaguucaacugguacguggacggggucgaggugcacaacgccaagaccaagccccgcgaggagcaguucaacagcaccuuccggguggucuccgugcugaccgugguccaccaggacuggcucaacggcaaggaguacaagugcaaggugagcaacaagggccugcccuccagcaucgagaagacgaucuccaagaccaaggggcagccgcgcgagccccagguguacacccugccgcccagccgggaggagaugaccaagaaccaggucagccucacgugccuggugaagggcuucuaccccuccgacaucgcgguggagugggagagcaacgggcagcccgagaacaacuacaagaccacgcccccgaugcuggacuccgacggcagcuucuuccucuacuccaagcugaccgucgacaagagccgcuggcagcaggggaacguguucuccugcagcgugaugcacgaggcccugcacaaccacuacacccagaagucccucagccugucccccggcaag

SEQ ID NO: 7757 - RNA, 642 nt, Artificial Sequence
  derived and/or modified sequence opt1 from Bococizumab_LightChain1
gacauccagaugacccagagccccuccagccuguccgccagcgugggcgaccgcgucaccaucacgugccgggccucccaggggaucagcuccgcgcucgccugguaccagcagaagccgggcaaggcccccaagcugcugaucuacagcgccuccuaccgcuacaccggggugcccagccgguucuccggcagcggguccggcaccgacuucaccuucacgaucagcucccuccagcccgaggacaucgccaccuacuacugccagcagcgcuacagccuguggcggaccuucggccaggggaccaagcuggagaucaagcgcacgguggcggccccguccgucuucaucuucccgcccagcgacgagcagcucaaguccggcaccgccagcguggugugccugcugaacaacuucuacccccgggaggccaagguccaguggaagguggacaacgcgcuccagagcgggaacucccaggagagcgugaccgagcaggacuccaaggacagcaccuacucccugagcuccacgcugacccucagcaaggccgacuacgagaagcacaaggucuacgccugcgaggugacccaccagggccuguccagccccgugaccaaguccuucaaccgcggggagugc

SEQ ID NO: 7758 - RNA, 1338 nt, Artificial Sequence
  derived and/or modified sequence opt1 from Brentuximab_vedotin_HeavyChain1
cagauccagcugcagcagagcggccccgagguggucaagccgggggccuccgugaagaucagcugcaaggccuccggcuacaccuucaccgacuacuacaucacgugggugaagcagaagcccgggcagggccucgaguggaucggguggaucuaccccggcagcggcaacaccaaguacaacgagaaguucaaggggaaggcgacccugaccgucgacacguccagcuccaccgccuucaugcagcugagcucccucaccagcgaggacaccgccguguacuucugcgccaacuacggcaacuacugguucgccuacugggggcagggcacccaggugaccgucuccgcggccagcaccaaggggcccuccguguucccgcuggcccccagcuccaagagcaccuccggcggcacggccgcgcuggggugccucgugaaggacuacuuccccgagcccgucaccgugagcuggaacuccggcgcccugaccagcggggugcacaccuucccggccguccugcagagcuccggccucuacagccuguccagcguggugacgguccccuccagcucccugggcacccagaccuacaucugcaacgugaaccacaagcccagcaacaccaagguggacaagaaggucgagcccaaguccugcgacaagacgcacacgugcccgcccugccccgcccccgagcuccucgggggcccgagcguguuccuguucccgcccaagcccaaggacacccugaugaucucccgcacccccgaggugacgugcgucgugguggacgucagccacgaggaccccgaggugaaguucaacugguacgucgacgggguggaggugcacaacgccaagaccaagccccgggaggagcaguacaacuccaccuaccgcgucgugagcgugcugaccguccugcaccaggacuggcucaacggcaaggaguacaagugcaagguguccaacaaggcgcugcccgccccgaucgagaagacgaucagcaaggccaaggggcagccccgggagccccagguguacacccugcccccgucccgcgacgagcucaccaagaaccaggucagccugaccugccuggugaagggcuucuaccccuccgacaucgccguggagugggagagcaacggccagcccgagaacaacuacaagacgaccccgcccguccucgacagcgacggguccuucuuccuguacagcaagcugaccguggacaagucccgguggcagcagggcaacguguucagcugcuccgucaugcacgaggcccuccacaaccacuacacccagaagucccugagccugagccccggg

SEQ ID NO: 7759 - RNA, 654 nt, Artificial Sequence
  derived and/or modified sequence opt1 from Brentuximab_vedotin_LightChain1
gacaucgugcugacccagagccccgccucccucgccgucagccugggccagcgcgcgaccaucuccugcaaggccagccaguccguggacuucgacggggacagcuacaugaacugguaccagcagaagccgggccagccgcccaaggugcugaucuacgccgccuccaaccucgagagcgggauccccgcccgguucuccggcagcggguccggcacggacuucacccugaacauccaccccgucgaggaggaggacgcggccaccuacuacugccagcagagcaacgaggaccccuggaccuucggcgggggcacgaagcuggagaucaagcgcaccguggccgcccccuccguguucaucuucccgcccagcgacgagcagcucaaguccgggaccgcgagcgucgugugccugcugaacaacuucuacccccgggaggccaaggugcaguggaaggucgacaacgcccuccaguccggcaacagccaggaguccgugaccgagcaggacagcaaggacagcacguacucccugagcuccacccugacccucagcaaggccgacuacgagaagcacaagguguacgccugcgaggucacccaccaggggcuguccagccccgugacgaaguccuucaaccgcggcgagugc

SEQ ID NO: 7760 - RNA, 1335 nt, Artificial Sequence
  derived and/or modified sequence opt1 from Briakinumab_HeavyChain1
caggugcagcuggucgagagcggcgggggcguggugcagcccgggcgcucccuccggcugagcugcgccgccuccggcuucaccuucagcuccuacgggaugcacuggguccgccaggcgccgggcaagggccuggaguggguggccuucauccgguacgacgggagcaacaaguacuacgccgacuccgugaagggccgcuucaccaucagccgggacaacuccaagaacacgcucuaccugcagaugaacagccugcgcgccgaggacaccgccgucuacuacugcaagacccacgggucccacgacaacuggggccaggggaccauggugacggugagcuccgcgagcaccaagggccccuccgucuucccccucgcccccagcuccaagagcaccuccggcgggaccgccgcccugggcugccuggugaaggacuacuucccggagcccgugacggucagcuggaacagcggggcgcucaccuccggcgugcacaccuuccccgccgugcugcagagcuccggccuguacagccucuccagcgucgugaccgugcccuccagcucccuggggacgcagaccuacaucugcaacgucaaccacaagccgagcaacaccaagguggacaagaagguggagcccaaguccugcgacaagacccacacgugcccgcccugcccggcccccgagcugcucggcgggcccagcgucuuccuguucccgcccaagcccaaggacacccugaugaucucccggacccccgaggugaccugcguggucguggacgucagccacgaggaccccgaggugaaguucaacugguacguggacggcgucgaggugcacaacgccaagacgaagccgcgcgaggagcaguacaacuccaccuaccggguggucagcgugcucaccgugcugcaccaggacuggcugaacgggaaggaguacaagugcaaggucuccaacaaggcccuccccgcgcccaucgagaagaccaucagcaaggccaagggccagccccgcgagccccagguguacacgcugccgcccucccgggaggagaugaccaagaaccaggugagccugaccugccucgucaagggcuucuaccccagcgacaucgccguggagugggaguccaacgggcagcccgagaacaacuacaagaccacgccgcccgugcuggacagcgacggcuccuucuuccuguacagcaagcucaccgucgacaagucccgcuggcagcaggggaacguguucagcugcuccgugaugcacgaggcccugcacaaccacuacacccagaagucccugagccucagccccggcaag

SEQ ID NO: 7761 - RNA, 651 nt, Artificial Sequence
  derived and/or modified sequence opt1 from Briakinumab_LightChain1
cagagcgugcugacccagcccccguccgucagcggcgcccccgggcagcgcgugaccaucuccugcagcggcucccggagcaacaucggguccaacacggugaagugguaccagcagcuccccggcaccgcccccaagcugcugaucuacuacaacgaccagcgcccgagcgggguccccgaccgguucuccggcagcaaguccggcaccagcgcgucccucgccaucaccgggcugcaggccgaggacgaggccgacuacuacugccagagcuacgaccgcuacacgcaccccgcccuccuguucggcaccgggaccaaggugaccgugcugggccagcccaaggcggccccguccgucacgcuguucccgcccagcuccgaggagcuccaggccaacaaggccacccuggugugccugaucagcgacuucuaccccggggcggugaccgucgccuggaaggccgacuccagccccgugaaggccggcguggagaccacgacccccagcaagcaguccaacaacaaguacgccgcgagcuccuaccucagccugacccccgagcaguggaagucccaccggagcuacuccugccaggucacccacgagggcagcacgguggagaagaccguggcccccaccgagugcucc

SEQ ID NO: 7762 - RNA, 1326 nt, Artificial Sequence
  derived and/or modified sequence opt1 from Brodalumab_HeavyChain1
caggugcagcugguccagagcggcgccgaggugaagaagcccggggccuccgugaaggucagcugcaaggcguccggcuacaccuucacccgcuacgggaucagcugggugcggcaggccccgggccaggggcucgaguggaugggcuggaucuccacguacagcggcaacaccaacuacgcccagaagcugcaggggcgcgugaccaugaccacggacaccuccaccagcaccgccuacauggagcugcggucccuccgcagcgacgacacggccgucuacuacugcgcgcggcgccagcuguacuucgacuacuggggccaggggacccuggugaccguguccagcgccuccaccaagggccccagcgucuucccccucgcccccugcucccggagcacguccgagagcaccgccgcgcuggggugccuggugaaggacuacuucccggagcccgugaccgucuccuggaacagcggcgcccucaccagcggcgugcacacguuccccgccgugcugcaguccagcgggcuguacucccucagcuccgucgugaccgugcccagcuccaacuucggcacccagaccuacacgugcaacgucgaccacaagccgagcaacaccaagguggacaagaccguggagcgcaagugcugcgucgagugcccgcccugccccgccccgcccguggccgggcccuccguguuccuguucccgcccaagcccaaggacacccugaugaucagccggacgcccgaggugaccugcgucgucguggacgugucccacgaggaccccgagguccaguucaacugguacguggacggcguggagguccacaacgcgaagaccaagccgcgcgaggagcaguucaacagcaccuuccgggugguguccguccucacgguggugcaccaggacuggcugaacggcaaggaguacaagugcaaggucagcaacaaggggcugcccgcccccaucgagaagaccaucuccaagaccaagggccagccccgcgagccccagguguacacccucccgcccagccgggaggagaugacgaagaaccaggugucccugaccugccuggucaagggguucuaccccagcgacaucgccguggagugggaguccaacggccagcccgagaacaacuacaagaccaccccgcccaugcucgacagcgacgggagcuucuuccuguacuccaagcugacgguggacaagagccgcuggcagcagggcaacgucuucuccugcagcgugaugcacgaggcccuccacaaccacuacacccagaagucccugagccugucccccggcaag

SEQ ID NO: 7763 - RNA, 642 nt, Artificial Sequence
  derived and/or modified sequence opt1 from Brodalumab_LightChain1
gagaucgugaugacccagagccccgccacccuguccgucagcccgggcgagcgggccacgcucuccugccgggcgagccaguccgugagcuccaaccuggccugguuccagcagaagcccgggcaggcgccccgcccccugaucuacgacgccagcacccgggccaccggcgugccggcccgcuucuccgggagcggcuccgggaccgacuucacgcucaccaucagcucccugcagagcgaggacuucgccgucuacuacugccagcaguacgacaacuggccccugaccuucggcggcgggaccaagguggagaucaagcggacgguggccgcccccuccgucuucaucuucccgcccagcgacgagcagcucaaguccggcaccgcgagcguggugugccugcugaacaacuucuacccccgcgaggccaagguccaguggaagguggacaacgcccuccaguccgggaacagccaggagagcgugaccgagcaggacuccaaggacagcaccuacucccugagcuccacgcugacccucagcaaggccgacuacgagaagcacaaggucuacgccugcgaggugacccaccagggccuguccagccccgugaccaaguccuucaaccgcggggagugc

SEQ ID NO: 7764 - RNA, 756 nt, Artificial Sequence
  derived and/or modified sequence opt1 from Brolucizumab_HeavyChain1
auggagaucgugaugacccagagccccuccacccugagcgcguccgucggcgaccgcgugaucaucacgugccaggccagcgagaucauccacuccuggcucgcgugguaccagcagaagccggggaaggcccccaagcugcugaucuaccucgccagcacccuggccuccggcgugcccagccgguucuccgggagcggcuccggggccgaguucacccugaccaucagcucccuccagcccgacgacuucgcgacguacuacugccagaacgucuaccuggccagcaccaacggcgccaacuucggccaggggaccaagcugaccgugcucggcgggggcgggggcuccggcgggggcgggagcggcggcgggggcuccgggggcgggggcagcgaggugcagcuggucgaguccggcgggggccuggugcagcccgggggcagccuccgccugagcugcacggccuccggguucagccugaccgacuacuacuacaugaccugggugcggcaggcgccgggcaagggccucgagugggucggguucaucgaccccgacgacgaccccuacuacgccaccugggccaagggccgcuucacgaucucccgggacaacagcaagaacacccuguaccugcagaugaacucccuccgcgccgaggacaccgccguguacuacugcgccgggggcgaccacaacagcggguggggccuggacaucuggggccaggggacccuggugacggucuccagc

SEQ ID NO: 7765 - RNA, 756 nt, Artificial Sequence; identical to SEQ ID NO: 7764
  derived and/or modified sequence opt1 from Brolucizumab_scFv_fragment

SEQ ID NO: 7766 - RNA, 1341 nt, Artificial Sequence
  derived and/or modified sequence opt1 from Brontictuzumab_HeavyChain1
caggugcagcugguccagagcggcgccgaggugaagaagcccggggccuccgugaagaucagcugcaaggucuccggcuacacccuccgcggguacuggaucgagugggugcggcaggcgccgggcaaggggcuggaguggaucggccagauccugcccggcaccgggcgcacgaacuacaacgagaaguucaagggccgggugaccaugaccgccgacaccagcacggacaccgccuacauggagcucuccagccugcgcuccgaggacaccgccgucuacuacugcgcccgguucgacgggaacuacggcuacuacgcgauggacuacugggggcagggcaccacggugaccgugagcuccgccagcaccaagggccccuccgucuucccccuggccccgugcagccgcuccaccagcgaguccacggccgcgcucgggugccuggugaaggacuacuuccccgagcccgugaccgucagcuggaacuccggcgcccugaccagcggggugcacaccuuccccgccgugcuccaguccagcggccuguacagccuguccagcgucgugacggugccguccagcaacuucggcacccagaccuacacgugcaacgucgaccacaagcccuccaacaccaagguggacaagaccguggagcggaagugcugcgucgagugcccgcccugccccgccccgcccguggccgggcccagcguguuccucuucccgcccaagcccaaggacacccugaugaucucccgcacccccgaggucacgugcguggucguggacgugagccacgaggaccccgagguccaguucaacugguacguggacggcguggagguccacaacgcgaagaccaagccccgggaggagcaguucaacuccaccuuccgcguggugagcguccugaccguggugcaccaggacuggcucaacgggaaggaguacaagugcaaggucuccaacaagggccugcccgcccccaucgagaagacgaucagcaagaccaaggggcagccgcgggagccccagguguacacccugccgcccucccgcgaggagaugaccaagaaccaggugagccucacgugccuggucaagggcuucuaccccuccgacaucgccguggagugggagagcaacggccagcccgagaacaacuacaagaccacgcccccgaugcuggacuccgacgggagcuucuuccucuacuccaagcugaccguggacaagagccgguggcagcagggcaacgucuucagcugcuccgugaugcacgaggcccugcacaaccacuacacccagaagucccucagccugagccccgggaag

SEQ ID NO: 7767 - RNA, 645 nt, Artificial Sequence
  derived and/or modified sequence opt1 from Brontictuzumab_LightChain1
caggccguggucacccaggagcccagccugaccguguccccgggcgggacggugacccugaccugccgcagcuccaccggcgccgucacgaccagcaacuacgcgaacugguuccagcagaagcccgggcaggcgccccggacccucaucggcgggaccaacaaccgcgcccccggcgugccggcccgguucuccggcagccugcucgggggcaaggccgcccugacgcuguccggggcccagcccgaggacgaggccgaguacuacugcgcccucugguacagcaaccacuggguguucggcgggggcaccaagcugaccguccugggccagcccaaggcggcccccuccgugacccucuucccgcccagcuccgaggagcugcaggccaacaaggccacgcuggugugccucgucagcgacuucuaccccggggccgugaccguggcguggaaggccgacggcucccccgucaagguggggguggagaccaccaagccgagcaagcaguccaacaacaaguacgccgccagcuccuaccugagccugacgcccgagcaguggaagucccaccgcagcuacagcugccgggucacccacgagggcuccaccguggagaagaccguggcccccgcggagugcagc

SEQ ID NO: 7768 - RNA, 1332 nt, Artificial Sequence
  derived and/or modified sequence opt1 from BTT-1023_HeavyChain1
caggugcagcuggucgagagcggcgggggcguggugcagcccgggcgcucccuccggcugagcugcgccgccuccggcuucaccuucuucagcuacgcgaugcacuggguccgccagacccccgggaagggccuggaguggguggccgugaucugguucgacggcuccaacgagaacuacgucgacagcgugaaggggcgguucacgaucucccgcgacaacagcaagaacacccucuaccugcagaugaacacccugcgggccgaggacaccgccguguacuacugcgcccgcgacgcgugguccuacuucgacuacuggggccaggggacgcucgucaccgugagcuccgccagcaccaagggccccuccguguucccccuggcccccugcagccgguccaccagcgaguccacggccgcgcuggggugccucgucaaggacuacuucccggagcccgugaccgugagcuggaacuccggcgcccugaccagcggcguccacaccuuccccgccgugcugcagagcuccgggcucuacagccuguccagcguggucacggugcccuccagcucccugggcaccaagaccuacacgugcaacguggaccacaagccgagcaacaccaaggucgacaagcgcguggaguccaaguacgggccgcccugcccgcccugccccgcccccgaguucgccggcggccccagcguguuccucuucccgcccaagcccaaggacacccugaugaucucccggacccccgaggugaccugcgucgucguggacgugagccaggaggaccccgagguccaguucaacugguacguggacgggguggagguccacaacgcgaagacgaagccccgcgaggagcaguucaacuccaccuaccggguggugagcguccugaccgugcuccaccaggacuggcugaacggcaaggaguacaagugcaagguguccaacaaggggcugcccagcuccaucgagaagaccaucagcaaggccaagggccagccccgcgagccgcaggucuacacgcucccgcccucccaggaggagaugaccaagaaccaggugagccugaccugccuggugaagggguucuaccccagcgacaucgccgucgagugggaguccaacggccagcccgagaacaacuacaagaccacgccgcccgugcucgacagcgacggcuccuucuuccuguacagccggcugaccguggacaagucccgcuggcaggaggggaacgucuucagcugcuccgugaugcacgaggcccuccacaaccacuacacccagaagucccugagccugagccucggcaag

SEQ ID NO: 7769 - RNA, 642 nt, Artificial Sequence
  derived and/or modified sequence opt1 from BTT-1023_LightChain1
gugauccagcugacccagagccccuccagccucuccgccagcgucggcgaccgcgugaccaucacgugccgggccucccaggggaucagccgcgcgcuggccugguaccagcagaagccgggcaaggggcccaagcugcucaucuacgacgccuccagccuggaguccggcgugcccagccgguucuccgggagcggcuccggcaccgacuucacccugaccaucagcucccuccagcccgaggacuucgccacguacuacugccagcaguucaacagcuacccgcugaccuucgggggcgggaccaaggucgagaucaagcgcaccguggccgcgcccuccguguucaucuucccgcccagcgacgagcagcugaaguccggcacggccagcgucgugugccuccugaacaacuucuacccccgggaggccaaggugcaguggaaggucgacaacgcccugcagagcgggaacucccaggagagcgugaccgagcaggacuccaaggacagcaccuacucccucagcuccacccugacgcugagcaaggcggacuacgagaagcacaagguguacgccugcgaggucacccaccagggccucuccagccccgugaccaaguccuucaaccgcggcgagugc

SEQ ID NO: 7770 - RNA, 1341 nt, Artificial Sequence
  derived and/or modified sequence opt1 from Burosumab_HeavyChain1
caggugcagcugguccagagcggcgccgaggugaagaagcccggggccuccgugaaggucagcugcaaggcguccggcuacaccuucaccaaccacuacaugcacugggugcgccaggccccggggcagggccucgaguggauggggaucaucaaccccaucagcggcuccacgagcaacgcccagaaguuccagggccgggugaccaugacccgcgacaccuccacgagcaccgucuacauggagcuguccagccugcgguccgaggacaccgccguguacuacugcgcccgcgacaucguggacgcguucgacuucugggggcagggcaccauggucacggugagcuccgccagcaccaaggggcccuccguguucccccucgccccgagcuccaagagcaccuccggcgggaccgccgcgcugggcugccuggucaaggacuacuuccccgagcccgugacggugagcuggaacagcggcgcccucaccuccgggguccacaccuuccccgccgugcugcagagcuccggccuguacagccucuccagcguggucaccgugccguccagcucccuggggacgcagaccuacaucugcaacgugaaccacaagcccagcaacaccaaggucgacaagaagguggagcccaaguccugcgacaagacccacacgugcccgcccugccccgcccccgagcugcucggcggccccagcguguuccuguucccgcccaagcccaaggacacccugaugaucucccggacccccgaggugaccugcgucgucguggacgugagccacgaggacccggaggucaaguucaacugguacguggacgggguggagguccacaacgccaagacgaagccccgcgaggagcaguacaacuccaccuaccggguggugagcguccucaccgugcugcaccaggacuggcugaacggcaaggaguacaagugcaagguguccaacaaggcgcuccccgcccccaucgagaagaccaucagcaaggccaaggggcagccgcgcgagccccaggucuacacgcugccgcccucccgggacgagcugaccaagaaccaggugagccugaccugccucgugaagggcuucuaccccagcgacaucgccgucgagugggaguccaacgggcagcccgagaacaacuacaagaccacgcccccggugcuggacagcgacggcuccuucuuccucuacagcaagcugaccguggacaagucccgcuggcagcagggcaacgucuucagcugcuccgugaugcacgaggcccugcacaaccacuacacccagaagucccucagccugagccccgggaag

SEQ ID NO: 7771 - RNA, 639 nt, Artificial Sequence
  derived and/or modified sequence opt1 from Burosumab_LightChain1
gccauccagcugacccagagccccuccagccucuccgccagcgugggcgaccgggucaccaucacgugccgggcgucccaggggaucagcuccgcccuggugugguaccagcagaagccgggcaaggcccccaagcugcucaucuacgacgccagcucccuggagagcggggugcccucccgcuucagcggcuccgggagcggcaccgacuucacccugaccaucuccagccuccagcccgaggacuucgccacguacuacugccagcaguucaacgacuacuucaccuucggcccggggaccaaggucgacaucaagcggaccguggcggcccccuccguguucaucuucccgcccagcgacgagcagcugaaguccggcacggccagcgucgugugccugcucaacaacuucuacccccgcgaggccaaggugcaguggaaggucgacaacgcgcugcagagcgggaacucccaggagagcgugaccgagcaggacuccaaggacagcaccuacucccugagcuccacccucacgcugagcaaggccgacuacgagaagcacaagguguacgccugcgaggucacccaccagggccuguccagccccgugaccaaguccuucaaccgcggggagugc

SEQ ID NO: 7772 - RNA, 1344 nt, Artificial Sequence
  derived and/or modified sequence opt1 from Canakinumab_HeavyChain1
caggugcagcuggucgagagcggcgggggcguggugcagcccgggcgcucccuccggcugagcugcgccgccuccggcuucaccuucagcgucuacgggaugaacugggugcgccaggcgccgggcaagggccuggaguggguggccaucaucugguacgacggggacaaccaguacuacgccgacuccgucaagggccgguucaccaucagccgcgacaacuccaagaacacgcucuaccugcagaugaacgggcugcgggccgaggacaccgccguguacuacugcgcgcgcgaccuccggaccggccccuucgacuacugggggcagggcacccuggugacggucagcuccgccagcaccaagggccccuccguguucccccuggccccgagcuccaagagcaccuccgggggcaccgccgcgcucgggugccuggugaaggacuacuuccccgagcccgucacggugagcuggaacuccggcgcccugaccagcggcgugcacaccuuccccgccguccuccaguccagcgggcuguacagccuguccagcguggugaccgucccguccagcucccucggcacgcagaccuacaucugcaacgugaaccacaagcccagcaacaccaagguggacaagcgcgucgagcccaaguccugcgacaagacccacacgugcccgcccugccccgcccccgagcugcucgggggccccagcguguuccuguucccgcccaagcccaaggacacccugaugaucucccggacccccgaggugaccugcgucguggucgacgugagccacgaggacccggaggugaaguucaacugguacgucgacgggguggaggugcacaacgccaagacgaagccccgcgaggagcaguacaacuccaccuaccgggucgugagcgugcugaccguccuccaccaggacuggcugaacggcaaggaguacaagugcaagguguccaacaaggcgcugcccgcccccaucgagaagaccaucagcaaggccaagggccagccgcgcgagccccagguguacacgcucccgcccucccgggaggagaugaccaagaaccaggucagccugaccugccuggugaagggguucuaccccuccgacaucgccguggagugggagagcaacggccagcccgagaacaacuacaagaccacgcccccgguccucgacuccgacgggagcuucuuccuguacagcaagcugaccguggacaagucccgcuggcagcagggcaacguguucagcugcuccgucaugcacgaggcccuccacaaccacuacacccagaagucccugagccugagccccgggaag

SEQ ID NO: 7773 - RNA, 1344 nt, Artificial Sequence; identical to SEQ ID NO: 7772
  derived and/or modified sequence opt1 from Canakinumab_HeavyChain

SEQ ID NO: 7774 - RNA, 642 nt, Artificial Sequence
  derived and/or modified sequence opt1 from Canakinumab_LightChain1
gagaucgugcugacccagagccccgacuuccaguccgucaccccgaaggagaaggugacgaucacgugccgcgccagccaguccaucggcagcucccuccacugguaccagcagaagcccgaccagagccccaagcugcugaucaaguacgccucccagagcuucuccggggugcccagccgguucuccggcagcggguccggcaccgacuucacccucaccaucaacagccuggaggcggaggacgccgccgccuacuacugccaccaguccagcucccugccguucaccuucgggcccggcaccaaggucgacaucaagcgcaccguggccgcgcccagcguguucaucuucccgcccuccgacgagcagcucaagagcggcacggccagcgucgugugccugcugaacaacuucuacccccgggaggccaaggugcaguggaaggucgacaacgcccuccaguccgggaacagccaggaguccgugaccgagcaggacagcaaggacuccaccuacagccuguccagcacccugacgcucuccaaggcggacuacgagaagcacaagguguacgccugcgaggucacccaccagggccugagcucccccgugaccaagagcuucaaccgcggggagugc

SEQ ID NO: 7775 - RNA, 642 nt, Artificial Sequence; identical to SEQ ID NO: 7774
  derived and/or modified sequence opt1 from Canakinumab_LightChain

SEQ ID NO: 7776 - RNA, 1182 nt, Artificial Sequence
  derived and/or modified sequence opt1 from Canakinumab_LightChain_variant_8836_L
caggugcagcuggucgagagcggcgggggcguggugcagcccgggcgcucccuccggcugagcugcgccgccuccggcuucaccuucagcgucuacgggaugaacugggugcgccaggcgccgggcaagggccuggaguggguggccaucaucugguacgacggggacaaccaguacuacgccgacuccgucaagggccgguucaccaucagccgcgacaacuccaagaacacgcucuaccugcagaugaacgggcugcgggccgaggacaccgccguguacuacugcgcgcgcgaccuccggaccggccccuucgacuacugggggcagggcacccuggugacggucagcuccgccagcaccaagggccccuccguguucccccuggccccgagcuccaagagcaccuccgggggcaccgccgcgcucgggugccuggugaaggacuacuuccccgagcccgucacggugagcuggaacuccggcgcccugaccagcggcgugcacaccuuccccgccguccuccaguccagcgggcuggagaucgugcugacccagagcccggacuuccaguccgugacgcccaaggagaaggucaccaucacgugccgcgccagccaguccaucggcagcucccuccacugguaccagcagaagcccgaccagagccccaagcugcugaucaaguacgccucccagagcuucuccggggugccgagccgguucuccggcagcggguccggcaccgacuucacccucaccaucaacagccuggaggcggaggacgccgccgccuacuacugccaccaguccagcucccugcccuucaccuucggccccgggaccaagguggacaucaagcgcacggucgccgcgcccagcguguucaucuucccgcccuccgacgagcagcucaagagcggcaccgccagcguggucugccugcugaacaacuucuacccccgggaggccaaggugcaguggaaggucgacaacgcccuccaguccgggaacagccaggaguccgugaccgagcaggacagcaaggacuccaccuacagccuguccagcacgcugacccucuccaaggccgacuacgagaagcacaagguguacgcgugcgaggucacccaccagggccugagcucccccgugaccaagagcuucaaccgcggggagugc

SEQ ID NO: 7777 - RNA, 1197 nt, Artificial Sequence
  derived and/or modified sequence opt1 from Cantuzumab_HeavyChain1
aucgacaccaccacgggcgagcccaccuacgcccagaaguuccaggggcgcaucgccuucagccuggagaccuccgcgagcaccgccuaccuccagaucaagucccucaagagcgaggacacggccaccuacuucugcgcccggcgcggcccguacaacugguacuucgacgugugggggcagggcaccaccgucacgguguccagcgccuccaccaaggggcccagcguguucccccuggcgcccuccagcaaguccaccagcggcggcaccgccgcccuggggugccuggucaaggacuacuucccggagcccgugacgguguccuggaacagcggcgcccugaccuccgggguccacaccuuccccgcggugcuccagagcuccggccuguacagccuguccagcguggucaccgugcccagcuccagccucgggacgcagaccuacaucugcaacgugaaccacaagccguccaacaccaaggucgacaagaagguggagcccaagagcugcgacaagacccacacgugcccgcccugccccgcccccgagcugcugggcggccccuccguguuccucuucccgcccaagcccaaggacacccugaugaucagccggacccccgaggugaccugcgucguggucgacgugucccacgaggaccccgaggugaaguucaacugguacgucgacgggguggaggugcacaacgccaagacgaagccgcgcgaggagcaguacaacagcaccuaccgggucguguccguccugaccgugcuccaccaggacuggcugaacggcaaggaguacaagugcaaggugagcaacaaggcccugcccgcccccaucgagaagaccaucuccaaggcgaaggggcagccccgcgagccgcaggucuacacgcucccgcccagccgggacgagcugaccaagaaccaggugucccugaccugccucgugaagggcuucuaccccagcgacaucgccgucgagugggaguccaacggccagcccgagaacaacuacaagaccacgccgcccgugcuggacagcgacggguccuucuuccuguacagcaagcucaccguggacaagucccgcuggcagcagggcaacgucuucagcugcagcgugaugcacgaggcccugcacaaccacuacacccagaagucccugagccucucccccgggaag

SEQ ID NO: 7778 - RNA, 1347 nt, Artificial Sequence
  derived and/or modified sequence opt1 from Cantuzumab_HeavyChain
caggugcagcugguccagagcggcgccgaggugaagaagcccggggagaccgugaagaucuccugcaaggccagcgacuacaccuucacguacuacggcaugaacugggucaagcaggcgccggggcagggccucaaguggaugggguggaucgacaccaccaccggcgagcccacguacgcccagaaguuccagggccgcaucgccuucucccuggagaccagcgccuccaccgccuaccugcagaucaagagccucaaguccgaggacaccgcgacguacuucugcgcccggcgcgggcccuacaacugguacuucgacguguggggccaggggaccaccgugaccgucagcuccgccagcacgaagggccccuccguguucccgcuggcccccagcuccaagagcaccuccgggggcaccgcggcccugggcugccucgugaaggacuacuuccccgagcccgucaccgugagcuggaacuccggggcccugacgagcggcgugcacaccuucccggccguccugcaguccagcgggcucuacagccuguccagcguggugaccguccccuccagcucccugggcacccagacguacaucugcaacgugaaccacaagcccagcaacaccaagguggacaagaaggucgagcccaaguccugcgacaagacccacacgugcccgcccugccccgcccccgagcuccugggcgggccgagcguguuccuguucccgcccaagcccaaggacacccucaugaucucccggacccccgaggugaccugcgucgugguggacgucagccacgaggaccccgaggugaaguucaacugguacgucgacggcguggaggugcacaacgcgaagaccaagccccgcgaggagcaguacaacuccacguaccgggucgugagcgugcugaccguccugcaccaggacuggcucaacgggaaggaguacaagugcaagguguccaacaaggcccugcccgccccgaucgagaagaccaucagcaaggccaagggccagccccgcgagccccagguguacacccugcccccgucccgggacgagcucacgaagaaccaggucagccugaccugccuggugaagggguucuaccccuccgacaucgccguggagugggagagcaacggccagcccgagaacaacuacaagaccaccccgcccguccucgacuccgacggcagcuucuuccuguacagcaagcugacgguggacaagucccgcuggcagcaggggaacguguucagcugcuccgucaugcacgaggcgcuccacaaccacuacacccagaagucccugagccugagccccggcaag

SEQ ID NO: 7779 - RNA, 657 nt, Artificial Sequence
  derived and/or modified sequence opt1 from Cantuzumab_LightChain1
gacaucgugaugacccagagcccccuguccgucccggugacccccggcgagcccgugagcaucuccugccgcagcuccaagagccuccugcacuccaacgggaacacguaccuguacugguuccuccagcggcccggccagagcccgcagcugcugaucuaccgcauguccaaccucgucagcggggugcccgaccgguucuccggcagcggguccggcaccgccuucacccugcgcaucagccggguggaggccgaggacgucggcguguacuacugccugcagcaccucgaguaccccuucaccuucgggcccggcacgaagcuggagcugaagcgcaccguggcggccccguccgucuucaucuucccgcccagcgacgagcagcucaaguccgggaccgccagcguggugugccugcugaacaacuucuacccccgggaggccaagguccaguggaagguggacaacgcccuccaguccggcaacagccaggagagcgugaccgagcaggacuccaaggacagcacguacucccugagcuccacccugacccucagcaaggcggacuacgagaagcacaaggucuacgccugcgaggugacccaccaggggcuguccagccccgugacgaaguccuucaaccgcggcgagugc

SEQ ID NO: 7780 - RNA, 1344 nt, Artificial Sequence
  derived and/or modified sequence opt1 from Cantuzumab_mertansine_HeavyChain1
gugcagcugguccagagcggcgccgaggugaagaagcccggggagaccgugaagaucuccugcaaggccagcgacuacaccuucacguacuacggcaugaacugggucaagcaggcgccggggcagggccucaaguggaugggguggaucgacaccaccaccggcgagcccacguacgcccagaaguuccagggccgcaucgccuucucccuggagaccagcgccuccaccgccuaccugcagaucaagagccucaaguccgaggacaccgcgacguacuucugcgcccggcgcgggcccuacaacugguacuucgacguguggggccaggggaccaccgugaccgucagcuccgccagcacgaagggccccuccguguucccgcuggcccccagcuccaagagcaccuccgggggcaccgcggcccugggcugccucgugaaggacuacuuccccgagcccgucaccgugagcuggaacuccggggcccugacgagcggcgugcacaccuucccggccguccugcaguccagcgggcucuacagccuguccagcguggugaccguccccuccagcucccugggcacccagacguacaucugcaacgugaaccacaagcccagcaacaccaagguggacaagaaggucgagcccaaguccugcgacaagacccacacgugcccgcccugccccgcccccgagcuccugggcgggccgagcguguuccuguucccgcccaagcccaaggacacccucaugaucucccggacccccgaggugaccugcgucgugguggacgucagccacgaggaccccgaggugaaguucaacugguacgucgacggcguggaggugcacaacgcgaagaccaagccccgcgaggagcaguacaacuccacguaccgggucgugagcgugcugaccguccugcaccaggacuggcucaacgggaaggaguacaagugcaagguguccaacaaggcccugcccgccccgaucgagaagaccaucagcaaggccaagggccagccccgcgagccccagguguacacccugcccccgucccgggacgagcucacgaagaaccaggucagccugaccugccuggugaagggguucuaccccuccgacaucgccguggagugggagagcaacggccagcccgagaacaacuacaagaccaccccgcccguccucgacuccgacggcagcuucuuccuguacagcaagcugacgguggacaagucccgcuggcagcaggggaacguguucagcugcuccgucaugcacgaggcgcuccacaaccacuacacccagaagucccugagccugagccccggcaag

SEQ ID NO: 7781 - RNA, 657 nt, Artificial Sequence; identical to SEQ ID NO: 7779
  derived and/or modified sequence opt1 from Cantuzumab_mertansine_LightChain1

SEQ ID NO: 7782 - RNA, 1347 nt, Artificial Sequence; identical to SEQ ID NO: 7778
  derived and/or modified sequence opt1 from Cantuzumab_ravtansine_HeavyChain1

SEQ ID NO: 7783 - RNA, 657 nt, Artificial Sequence; identical to SEQ ID NO: 7779
  derived and/or modified sequence opt1 from Cantuzumab_ravtansine_LightChain1

SEQ ID NO: 7784 - RNA, 777 nt, Artificial Sequence
  derived and/or modified sequence opt1 from Caplacizumab
gaggugcagcuggucgagagcggcgggggccucgugcagcccgggggcucccugcgccugagcugcgccgccuccgggcggaccuucagcuacaacccgaugggcugguuccgccaggcgcccggcaaggggcgggagcucguggccgccaucucccgcaccggcgggagcacguacuaccccgacuccgucgagggccgguucaccaucagccgcgacaacgccaagcggaugguguaccugcagaugaacucccugcgcgccgaggacaccgcgguguacuacugcgccgccgccgggguccgggcggaggacggccgcgugcggacccuccccagcgaguacacguucuggggccaggggacccaggugaccgucuccagcgccgccgccgaggugcagcugguggaguccggcgggggccugguccagccgggcgggagccuccgccuguccugcgccgcgagcggccggaccuucuccuacaaccccauggggugguuccgccaggcccccggcaaggggcgggagcugguggccgccaucagccgcacgggcggcuccaccuacuaccccgacagcguggaggggcgguucaccaucagccgcgacaacgccaagcggauggucuaccuccagaugaacucccugcgcgcggaggacaccgccguguacuacugcgccgccgccggcgugcgggcggaggacgggcgcguccgcacgcugccgagcgaguacaccuucuggggccaggggacccaggugaccguguccagc

SEQ ID NO: 7785 - RNA, 777 nt, Artificial Sequence; identical to SEQ ID NO: 7784
  derived and/or modified sequence opt1 from Caplacizumab_HeavyChain1

SEQ ID NO: 7786 - RNA, 777 nt, Artificial Sequence; identical to SEQ ID NO: 7784
  derived and/or modified sequence opt1 from Caplacizumab_HeavyChain1

SEQ ID NO: 7787 - RNA, 1347 nt, Artificial Sequence
  derived and/or modified sequence opt1 from Carlumab_HeavyChain1
caggugcagcugguccagagcggcgccgaggugaagaagcccggguccagcgugaaggucuccugcaaggccagcggcgggaccuucuccagcuacggcaucuccugggugcgccaggcgccggggcagggccucgaguggaugggcgggaucauccccaucuucggcaccgccaacuacgcccagaaguuccaggggcgggugacgaucaccgccgacgagagcaccuccaccgccuacauggagcugagcucccugcgcagcgaggacacggcggucuacuacugcgcccgguacgacggcaucuacggggagcucgacuucuggggccagggcacccuggugaccguguccagcgccuccaccaaggggcccagcgucuucccccuggccccguccagcaaguccacgagcggcgggaccgcggcccucggcugccuggugaaggacuacuuccccgagcccgugaccgucagcuggaacuccggcgcccugaccagcggggugcacacguuccccgccgugcuccaguccagcggccuguacucccugagcuccgucgugaccgugccgagcuccagccucgggacccagaccuacaucugcaacgucaaccacaagcccuccaacacgaagguggacaagaagguggagcccaagagcugcgacaagacccacacgugcccgcccugccccgcccccgagcugcugggcgggcccuccgucuuccucuucccgcccaagcccaaggacacccugaugaucagccgcacccccgaggugaccugcguggucguggacgucucccacgaggacccggaggugaaguucaacugguacguggacggcgucgaggugcacaacgcgaagaccaagccccgggaggagcaguacaacagcaccuaccgcguggucuccgugcugacggugcuccaccaggacuggcugaacggcaaggaguacaagugcaaggucagcaacaaggcccugcccgcccccaucgagaagaccaucuccaaggccaaggggcagccgcgggagccccagguguacacccucccgcccagccgcgacgagcugaccaagaaccaggugagccugacgugccucgucaagggcuucuaccccuccgacaucgccguggagugggagagcaacgggcagcccgagaacaacuacaagaccacgcccccggugcuggacuccgacggcagcuucuuccuguacuccaagcucaccgucgacaagagccgguggcagcaggggaacguguucuccugcagcgugaugcacgaggcgcugcacaaccacuacacccagaagucccugagccucucccccggcaag

SEQ ID NO: 7788 - RNA, 648 nt, Artificial Sequence
  derived and/or modified sequence opt1 from Carlumab_LightChain1
gagaucgugcugacccagagccccgccacccucucccugagcccgggcgagcgcgccacgcuguccugccgggcgagccaguccgucagcgacgccuaccucgccugguaccagcagaagcccgggcaggcgccccgccugcugaucuacgacgccuccagccgggccaccggcgugcccgcccgcuucuccgggagcggcuccgggaccgacuucacccucacgaucagcucccuggagccggaggacuucgccguguacuacugccaccaguacauccagcugcacagcuucaccuucggccagggcaccaaggucgagaucaagcggaccguggccgcgcccuccguguucaucuucccgcccagcgacgagcagcucaaguccgggacggccagcgucgugugccugcugaacaacuucuacccccgcgaggccaaggugcaguggaaggucgacaacgcccuccaguccggcaacagccaggagagcgugaccgagcaggacuccaaggacagcaccuacucccugagcuccacccugacgcucagcaaggccgacuacgagaagcacaagguguacgcgugcgaggucacccaccaggggcuguccagccccgugaccaaguccuucaaccggggcgagugc

SEQ ID NO: 7789 - RNA, 1353 nt, Artificial Sequence
  derived and/or modified sequence opt1 from Cergutuzumab_amunaleukin_HeavyChain1
caggugcagcugguccagagcggcgccgaggugaagaagcccggggccuccgugaaggucagcugcaaggcguccggcuacaccuucaccgaguucgggaugaacugggugcgccaggccccgggccaggggcucgaguggaugggcuggaucaacacgaagaccggcgaggccaccuacguggaggaguucaaggggcgggucaccuucacgaccgacaccagcaccuccacggccuacauggagcugcgcagccugcgguccgacgacaccgccguguacuacugcgcgcgcugggacuucgccuacuacguggaggccauggacuacuggggccaggggaccaccgucacggugagcuccgccagcaccaagggccccuccguguucccccucgcgcccagcuccaagagcaccuccgggggcaccgccgcccugggcugccuggucaaggacuacuucccggagcccgugacggugagcuggaacuccggggcccucaccagcggcguccacaccuuccccgccgugcugcaguccagcgggcuguacagccucuccagcguggucaccgugcccuccagcucccugggcacgcagaccuacaucugcaacgugaaccacaagccgagcaacaccaaggucgacaagaagguggagcccaaguccugcgacaagacccacacgugcccgcccugccccgcgcccgaggccgccggcgggcccagcguguuccuguucccgcccaagcccaaggacacccucaugaucucccggacccccgaggugaccugcgucgucguggacgugagccacgaggaccccgaggucaaguucaacugguacguggacggcguggagguccacaacgccaagacgaagccgcgcgaggagcaguacaacuccaccuaccggguggugagcguccugaccgugcugcaccaggacuggcucaacgggaaggaguacaagugcaagguguccaacaaggcccugggcgcgcccaucgagaagaccaucagcaaggccaaggggcagccccgcgagccccaggucugcacgcugccgcccucccgggacgagcucaccaagaaccaggugagccuguccugcgccgugaagggcuucuaccccagcgacaucgccgucgagugggaguccaacggccagcccgagaacaacuacaagaccaccccgcccgugcuggacagcgacgggagcuucuuccucguguccaagcugacggucgacaagagccgcuggcagcagggcaacguguucuccugcagcgugaugcacgaggcccugcacaaccacuacacccagaagucccucagccugucccccgggaag

SEQ ID NO: 7790 - RNA, 1794 nt, Artificial Sequence
  derived and/or modified sequence opt1 from Cergutuzumab_amunaleukin_HeavyChain2
caggugcagcugguccagagcggcgccgaggugaagaagcccggggccuccgugaaggucagcugcaaggcguccggcuacaccuucaccgaguucgggaugaacugggugcgccaggccccgggccaggggcucgaguggaugggcuggaucaacacgaagaccggcgaggccaccuacguggaggaguucaaggggcgggucaccuucacgaccgacaccagcaccuccacggccuacauggagcugcgcagccugcgguccgacgacaccgccguguacuacugcgcgcgcugggacuucgccuacuacguggaggccauggacuacuggggccaggggaccaccgucacggugagcuccgccagcaccaagggccccuccguguucccccucgcgcccagcuccaagagcaccuccgggggcaccgccgcccugggcugccuggucaaggacuacuucccggagcccgugacggugagcuggaacuccggggcccucaccagcggcguccacaccuuccccgccgugcugcaguccagcgggcuguacagccucuccagcguggucaccgugcccuccagcucccugggcacgcagaccuacaucugcaacgugaaccacaagccgagcaacaccaaggucgacaagaagguggagcccaaguccugcgacaagacccacacgugcccgcccugccccgcgcccgaggccgccggcgggcccagcguguuccuguucccgcccaagcccaaggacacccucaugaucucccggacccccgaggugaccugcgucgucguggacgugagccacgaggaccccgaggucaaguucaacugguacguggacggcguggagguccacaacgccaagacgaagccgcgcgaggagcaguacaacuccaccuaccggguggugagcguccugaccgugcugcaccaggacuggcucaacgggaaggaguacaagugcaagguguccaacaaggcccugggcgcgcccaucgagaagaccaucagcaaggccaaggggcagccccgcgagccccaggucuacacgcugccgcccugccgggacgagcucaccaagaaccaggugucccuguggugccuggugaagggcuucuaccccagcgacaucgccgucgagugggaguccaacggccagcccgagaacaacuacaagaccaccccgcccgugcucgacagcgacggguccuucuuccuguacagcaagcugacgguggacaagagccgcuggcagcagggcaacgucuucuccugcagcgugaugcacgaggcccuccacaaccacuacacccagaagucccugagccugucccccgggggcgggggcggcagcgggggcgggggcuccgggggcggcgggagcgccccggcguccagcuccaccaagaagacccagcuccagcuggagcaccuccugcuggaccugcagaugauccucaacggcaucaacaacuacaagaaccccaagcugacccggaugcugacggccaaguucgccaugcccaagaaggccaccgagcucaagcaccuccagugccuggaggaggagcugaagccccuggaggaggugcugaacggggcccagagcaagaacuuccaccuccgcccgcgggaccugaucuccaacaucaacgucaucgugcuggagcucaagggcagcgagaccaccuucaugugcgaguacgcggacgagacggccaccaucguggaguuccugaaccgcuggaucaccuucgcccaguccaucaucagcacccugacg

SEQ ID NO: 7791 - RNA, 645 nt, Artificial Sequence
  derived and/or modified sequence opt1 from Cergutuzumab_amunaleukin_LightChain1
gacauccagaugacgcagagccccuccagccuguccgccagcgugggcgaccgcgucaccaucacgugcaaggccuccgcggccguggggaccuacguggccugguaccagcagaagccgggcaaggcccccaagcuccugaucuacagcgccuccuaccggaagcgcgggguccccagccgguucuccggcagcggguccggcaccgacuucacccugacgaucagcucccuccagcccgaggacuucgcgaccuacuacugccaccaguacuacaccuacccgcuguucaccuucggccaggggacgaagcuggagaucaagcgcaccguggccgcccccagcguguucaucuucccgcccuccgacgagcagcucaagagcggcaccgccuccgucgugugccugcugaacaacuucuacccccgggaggcgaaggugcaguggaaggucgacaacgcccuccagagcgggaacucccaggagagcgugaccgagcaggacagcaaggacuccacguacagccuguccagcacccugacccucuccaaggccgacuacgagaagcacaagguguacgccugcgaggucacccaccagggccugagcucccccgugaccaagagcuucaaccgcggggagugc

SEQ ID NO: 7792 - RNA, 687 nt, Artificial Sequence
  derived and/or modified sequence opt1 from Certolizumab_pegol_HeavyChain1
gaggugcagcuggucgagagcggcgggggccucgugcagcccgggggcucccugcgccugagcugcgccgccuccggguacguguucaccgacuacggcaugaacuggguccggcaggcgccgggcaaggggcucgaguggaugggcuggaucaacaccuacaucggggagcccaucuacgccgacagcgugaagggccgcuucaccuucucccuggacaccagcaaguccaccgccuaccugcagaugaacagccuccgggccgaggacaccgccguguacuacugcgcgcgcggguaccgguccuacgccauggacuacuggggccagggcacgcuggucaccgugagcuccgccagcaccaaggggcccuccguguucccccuggccccgagcuccaagagcaccuccggcgggacggcggcccucggcugccuggucaaggacuacuuccccgagcccgugaccgugagcuggaacuccggcgcccugaccagcgggguccacaccuuccccgccgugcuccagagcuccggccuguacagccuguccagcguggucacggugccguccagcucccucgggacccagaccuacaucugcaacgugaaccacaagcccagcaacaccaaggucgacaagaagguggagcccaaguccugcgacaagacgcacacgugcgccgcg

SEQ ID NO: 7793 - RNA, 687 nt, Artificial Sequence; identical to SEQ ID NO: 7792
  derived and/or modified sequence opt1 from Certolizumab_pegol_HeavyChain

SEQ ID NO: 7794 - RNA, 642 nt, Artificial Sequence
  derived and/or modified sequence opt1 from Certolizumab_pegol_LightChain1
gacauccagaugacccagagccccuccagccuguccgccagcgugggcgaccgcgucaccaucacgugcaaggccucccagaacguggggaccaacguggcgugguaccagcagaagccgggcaaggcccccaaggcccucaucuacagcgccuccuuccuguacagcgggguccccuaccgguucuccggcagcggguccggcaccgacuucacccugacgaucagcucccuccagcccgaggacuucgccaccuacuacugccagcaguacaacaucuacccgcugaccuucggccaggggaccaagguggagaucaagcgcacgguggcggcccccagcgucuucaucuucccgcccuccgacgagcagcucaagagcggcaccgccuccguggugugccugcugaacaacuucuacccccgggaggccaagguccaguggaagguggacaacgcgcugcagagcgggaacucccaggagagcgugaccgagcaggacagcaaggacuccaccuacagccucuccagcacgcugacccuguccaaggccgacuacgagaagcacaaggucuacgccugcgaggugacccaccagggccucagcucccccgugaccaagagcuucaaccgcggggagugc

SEQ ID NO: 7795 - RNA, 642 nt, Artificial Sequence; identical to SEQ ID NO: 7794
  derived and/or modified sequence opt1 from Certolizumab_pegol_LightChain

SEQ ID NO: 7796 - RNA, 1356 nt, Artificial Sequence
  derived and/or modified sequence opt1 from Cetuximab_HeavyChain
caggugcagcugaagcagagcggccccgggcucguccagcccucccagagccuguccaucacgugcaccgugagcggcuucucccugaccaacuacggggugcacuggguccgccagagccccggcaaggggcucgaguggcugggcgugaucugguccggcgggaacaccgacuacaacacccccuucaccagccggcuguccaucaacaaggacaacagcaagucccagguguucuucaagaugaacagccuccaguccaacgacacggccaucuacuacugcgcccgcgcgcugaccuacuacgacuacgaguucgccuacuggggccaggggacccuggucaccgugagcgccgccuccacgaagggccccagcguguucccgcucgcccccuccagcaaguccaccagcgggggcaccgcggcccugggcugccuggucaaggacuacuuccccgagcccgugaccgugagcuggaacuccggggcccucacgagcggcguccacaccuucccggccgugcugcaguccagcgggcuguacucccucagcuccguggucaccgugcccagcuccagccugggcacccagacguacaucugcaacgugaaccacaagcccuccaacaccaaggucgacaagcggguggagcccaagagcccgaaguccugcgacaagacccacacgugcccgcccugccccgcgcccgagcugcucggcgggcccagcguguuccuguucccgcccaagcccaaggacacccugaugaucucccgcacccccgaggugaccugcgucguggucgacgugagccacgaggaccccgaggucaaguucaacugguacguggacggcguggagguccacaacgccaagaccaagccccgggaggagcaguacaacuccacguaccgcguggugagcguccucaccgugcugcaccaggacuggcugaacgggaaggaguacaagugcaagguguccaacaaggcccucccggcccccaucgagaagaccaucagcaaggccaagggccagccccgggagccccaggucuacacccugccgcccagccgcgacgagcugacgaagaaccaggugucccugaccugccucgugaagggguucuaccccagcgacaucgcggucgagugggaguccaacggccagccggagaacaacuacaagaccaccccgcccgugcuggacagcgacggcuccuucuuccucuacagcaagcugacgguggacaagucccgguggcagcaggggaacgucuucagcugcuccgugaugcacgaggcccugcacaaccacuacacccagaagucccucagccugagccccggcaag

SEQ ID NO: 7797 - RNA, 1347 nt, Artificial Sequence
  derived and/or modified sequence opt1 from Cetuximab_HeavyChain_variant
caggugcagcugaagcagagcggccccgggcucguccagccgucccagagccuguccaucacgugcaccgugagcggcuucucccugaccaacuacggggugcacuggguccgccagagccccggcaaggggcucgaguggcugggcgugaucugguccggcgggaacaccgacuacaacacccccuucaccagccggcuguccaucaacaaggacaacagcaagucccagguguucuucaagaugaacagccuccaguccaacgacacggccaucuacuacugcgcccgcgcgcugaccuacuacgacuacgaguucgccuacuggggccaggggacccuggucaccgugagcgccgccuccacgaagggccccagcguguucccgcucgcccccuccagcaaguccaccagcgggggcaccgcggcccugggcugccuggucaaggacuacuuccccgagcccgugaccgugagcuggaacuccggggcccucacgagcggcguccacaccuucccggccgugcugcaguccagcgggcuguacucccucagcuccguggucaccgugcccagcuccagccugggcacccagacguacaucugcaacgugaaccacaagcccuccaacaccaaggucgacaagaagguggagcccaagagcugcgacaagacccacacgugcccgcccugccccgcgcccgagcugcucggcgggccguccguguuccuguucccgcccaagcccaaggacacccugaugaucagccggacccccgaggugaccugcgucguggucgacgugucccacgaggaccccgaggucaaguucaacugguacguggacggcguggagguccacaacgccaagaccaagccccgcgaggagcaguacaacagcacguaccgggugguguccguccucaccgugcugcaccaggacuggcugaacgggaaggaguacaagugcaaggugagcaacaaggcccuccccgccccgaucgagaagaccaucuccaaggccaagggccagccccgcgagccccaggucuacacccugcccccgagccgggacgagcugacgaagaaccaggugagccugaccugccucgugaagggguucuaccccuccgacaucgcggucgagugggagagcaacggccagcccgagaacaacuacaagaccaccccgcccgugcuggacuccgacggcagcuucuuccucuacuccaagcugacgguggacaagagccgcuggcagcaggggaacgucuucuccugcagcgugaugcacgaggcccugcacaaccacuacacccagaagucccucagccugucccccggcaag

SEQ ID NO: 7798 - RNA, 639 nt, Artificial Sequence
  derived and/or modified sequence opt1 from Cetuximab_LightChain
gacauccugcucacccagagccccgugauccuguccgucagcccgggcgagcggguguccuucagcugccgggccucccagagcaucgggaccaacauccacugguaccagcagcgcacgaacggcagcccccggcugcucaucaaguacgccagcgaguccaucagcgggauccccucccgcuucagcggcuccgggagcggcaccgacuucacccuguccaucaacagcguggaguccgaggacaucgcggacuacuacugccagcagaacaacaacuggcccaccacguucggcgccgggaccaagcuggagcucaagcggaccgucgccgccccgagcguguucaucuucccgcccuccgacgagcagcugaaguccggcaccgccagcguggucugccugcucaacaacuucuacccccgcgaggcgaaggugcaguggaagguggacaacgcccugcaguccgggaacagccaggaguccgucacggagcaggacagcaaggacuccaccuacagccuguccagcacccucacccuguccaaggccgacuacgagaagcacaagguguacgccugcgaggugacgcaccagggccugagcucccccgucaccaagagcuucaaccgcggggcg

SEQ ID NO: 7799 - RNA, 642 nt, Artificial Sequence
  derived and/or modified sequence opt1 from Cetuximab_LightChain_variant
gacauccugcucacccagagccccgugauccuguccgucagcccgggcgagcggguguccuucagcugccgggccucccagagcaucgggaccaacauccacugguaccagcagcgcacgaacggcagcccccggcugcucaucaaguacgccagcgaguccaucagcgggauccccucccgcuucagcggcuccgggagcggcaccgacuucacccuguccaucaacagcguggaguccgaggacaucgcggacuacuacugccagcagaacaacaacuggcccaccacguucggcgccgggaccaagcuggagcucaagcggaccgucgccgccccgagcguguucaucuucccgcccuccgacgagcagcugaaguccggcaccgccagcguggucugccugcucaacaacuucuacccccgcgaggcgaaggugcaguggaagguggacaacgcccugcaguccgggaacagccaggaguccgucacggagcaggacagcaaggacuccaccuacagccuguccagcacccucacccuguccaaggccgacuacgagaagcacaagguguacgccugcgaggugacgcaccagggccugagcucccccgucaccaagagcuucaaccgcggggagugc

SEQ ID NO: 7800 - RNA, 675 nt, Artificial Sequence
  derived and/or modified sequence opt1 from Citatuzumab_bogatox_HeavyChain1
caccaccaccaccaccacgaggugcagcugguccagagcggccccgggcucgugcagccgggcggguccgugcgcaucagcugcgccgccuccggcuacaccuucaccaacuacgggaugaacugggucaagcaggcgcccggcaagggccuggaguggaugggguggaucaacacguacaccggcgagagcaccuacgccgacuccuucaaggggcgguucaccuucagccuggacacguccgccagcgccgccuaccuccagaucaacucccugcgcgcggaggacaccgccguguacuacugcgcccgguucgccaucaagggcgacuacugggggcagggcacccugcucaccgugagcuccgcgagcacgaagggccccuccgucuucccccuggccccgagcuccaagagcaccuccgggggcaccgccgcccuggggugccucgugaaggacuacuuccccgagcccgugaccgucagcuggaacuccggcgcccugacgagcggcgugcacaccuuccccgcggugcugcagagcuccgggcucuacagccuguccagcgucgugaccgugccguccagcucccugggcacccagacguacaucugcaacgucaaccacaagcccagcaacaccaagguggacaagaagguggagcccaaguccugc

SEQ ID NO: 7801 - RNA, 1443 nt, Artificial Sequence
  derived and/or modified sequence opt1 from Citatuzumab_bogatox_LightChain1
gacauccagaugacccagagccccuccagccuguccgccagcgugggcgaccgcgucaccaucacgugccgguccaccaagagccuccugcacuccaacgggaucaccuaccuguacugguaccagcagaagccgggcaaggcccccaagcuccugaucuaccagaugagcaaccuggcguccggggugcccagccgcuucuccagcuccggcagcgggaccgacuucacgcucaccaucuccagccugcagcccgaggacuucgccaccuacuacugcgcccagaaccuggagaucccgcggaccuucggccagggcacgaagguggagcucaagcgcaccgucgccgcccccuccguguucaucuucccgcccagcgacgagcagcugaaguccgggaccgcgagcguggucugccugcucaacaacuucuacccccgggaggccaaggugcaguggaagguggacaacgcccugcagagcggcaacucccaggagagcgucaccgagcaggacuccaaggacagcacguacucccugagcuccacccucacccugagcaaggccgacuacgagaagcacaagguguacgcgugcgaggugacccaccaggggcuguccagccccgucacgaaguccuucaaccgcggcgagugcacccggcaccgccagccccgggggugggagcagcucuacaacaccgugagcuucaaccugggcgaggccuacgaguaccccaccuucauccaggaccugcgcaacgagcucgccaagggcacgccggugugccagcugcccgucacccugcagaccaucgccgacgacaagcgguucgugcucguggacaucaccacgaccuccaagaagaccgucaagguggccaucgacgugaccgacgucuacguggugggguaccaggacaagugggacggcaaggaccgcgcggucuuccuggacaaggugcccacggucgccaccagcaagcuguuccccggggugaccaaccgggugacccucacguucgacggcuccuaccagaagcuggucaacgccgccaaggccgaccgcaaggcgcuggagcucggcgugaacaagcuggaguucagcaucgaggccauccacgggaagaccaucaacggccaggaggccgccaaguucuuccugaucgugauccagauggucuccgaggccgcgcgguucaaguacaucgagaccgaggugguggaccgcgggcucuacggcagcuucaagccgaacuucaagguccugaaccuggagaacaacuggggcgacaucuccgacgccauccacaagagcagcccccagugcaccacgaucaaccccgcccuccagcugaucucccccagcaacgacccguggguggugaacaaggucucccagaucagccccgacauggggauccugaaguucaaguccagcaag

SEQ ID NO: 7802 - RNA, 1380 nt, Artificial Sequence
  derived and/or modified sequence opt1 from Cixutumumab_HeavyChain1
gaggugcagcugguccagagcggcgccgaggugaagaagcccggguccagcgugaaggucuccugcaaggccagcggcgggaccuucuccagcuacgcgaucuccugggugcgccaggccccgggccaggggcucgaguggaugggcggcaucauccccaucuucgggaccgccaacuacgcccagaaguuccagggccgggugacgaucaccgccgacaagagcaccuccaccgcguacauggagcugagcucccugcgcagcgaggacacggccgucuacuacugcgcccgggcgccccuccgcuuccuggagugguccacccaggaccacuacuacuacuacuacauggacgugugggggaagggcaccaccgugacggucagcuccgccagcaccaaggggcccuccguguucccgcuggcccccagcuccaagagcaccagcggcggcaccgccgcccucgggugccuggugaaggacuacuuccccgagcccgucacgguguccuggaacagcggcgcccugaccuccggggugcacaccuucccggcgguccuccagagcuccggccuguacagccuguccagcguggugaccguccccuccagcucccucggcacgcagaccuacaucugcaacgugaaccacaagcccagcaacaccaagguggacaagaaggucgagcccaaguccugcgacaagacccacacgugcccgcccugccccgcccccgagcugcucgggggcccgagcguguuccucuucccgcccaagcccaaggacacccugaugaucucccggacccccgaggugaccugcgucguggucgacgugagccacgaggaccccgaggugaaguucaacugguacgucgacgggguggaggugcacaacgccaagacgaagccccgcgaggagcaguacaacuccaccuaccgggucgugagcgugcugaccguccuccaccaggacuggcugaacggcaaggaguacaagugcaagguguccaacaaggcccugcccgccccgaucgagaagaccaucagcaaggcgaaggggcagccccgcgagccccagguguacacgcugcccccgagccgggaggagaugaccaagaaccaggucucccugaccugccuggugaagggcuucuaccccagcgacaucgccguggagugggaguccaacggccagcccgagaacaacuacaagaccacgccgcccguccucgacagcgacggguccuucuuccuguacagcaagcugaccguggacaagucccgcuggcagcagggcaacguguucagcugcuccgucaugcacgaggcccuccacaaccacuacacccagaagucccugagccugagccccgggaag

SEQ ID NO: 7803 - RNA, 642 nt, Artificial Sequence
  derived and/or modified sequence opt1 from Cixutumumab_LightChain1
agcuccgagcugacccaggaccccgccgugagcgucgcccucggccagaccgugcgcaucacgugccagggggacucccugcggagcuacuacgcgaccugguaccagcagaagccgggccaggcccccauccuggugaucuacggggagaacaagcgccccuccggcauccccgaccgguucagcggguccagcuccggcaacaccgccagccucaccaucacgggcgcccaggccgaggacgaggcggacuacuacugcaagucccgcgacgggagcggccagcaccuggucuucgggggcgggaccaagcugaccgugcucggccagccgaaggccgcccccuccgugacccuguucccgcccagcuccgaggagcugcaggccaacaaggcgacgcucgucugccugaucagcgacuucuaccccggcgccgugaccguggccuggaaggccgacuccagccccgucaaggccgggguggagaccaccacgcccuccaagcagagcaacaacaaguacgcggccagcuccuaccugagccucacccccgagcaguggaagucccaccggagcuacuccugccaggugacccacgagggcagcaccgucgagaagacgguggccccggccgagugcucc

SEQ ID NO: 7804 - RNA, 1350 nt, Artificial Sequence
  derived and/or modified sequence opt1 from Clazakizumab_HeavyChain1
gaggugcagcuggucgagagcggcgggggccucgugcagcccgggggcucccugcgccugagcugcgccgccuccggguucagccucuccaacuacuacgugaccuggguccggcaggcgccgggcaagggccuggaguggguggggaucaucuacggcagcgacgagaccgccuacgccacguccgccaucgggcgcuucaccaucagccgggacaacuccaagaacacccuguaccuccagaugaacagccugcgcgccgaggacaccgcgguguacuacugcgcccgggacgacuccagcgacugggacgccaaguucaaccuguggggccaggggacgcucgucaccguguccagcgccuccaccaagggccccagcguguucccccuggcgcccuccagcaaguccaccagcggcgggacggccgcccugggcugccucgucaaggacuacuucccggagcccgugaccgugagcuggaacuccggggcccugaccagcggcguccacaccuuccccgccgugcugcaguccagcggccucuacucccugagcuccguggucacggugcccagcuccagccuggggacccagaccuacaucugcaacgugaaccacaagccguccaacaccaaggucgacaagcgcguggagcccaagagcugcgacaagacgcacacgugcccgcccugccccgcgcccgagcuccugggcgggcccuccguguuccuguucccgcccaagcccaaggacacccucaugaucagccggacccccgaggugaccugcgucguggucgacgugucccacgaggaccccgaggucaaguucaacugguacguggacggcguggagguccacaacgccaagaccaagccgcgcgaggagcaguacgccagcaccuaccgggugguguccguccugaccgugcugcaccaggacuggcucaacgggaaggaguacaagugcaaggugagcaacaaggcccugcccgcccccaucgagaagacgaucuccaaggcgaagggccagccccgcgagccgcaggucuacacccugccgcccagccgggaggagaugaccaagaaccaggugagccugaccugccucgugaagggcuucuaccccuccgacaucgccgucgagugggagagcaacgggcagcccgagaacaacuacaagacgaccccgcccgugcuggacuccgacggcagcuucuuccucuacuccaagcugaccguggacaagagccgcuggcagcaggggaacgucuucuccugcagcgugaugcacgaggcccugcacaaccacuacacccagaagucccucagccugucccccggcaag

SEQ ID NO: 7805 - RNA, 651 nt, Artificial Sequence
  derived and/or modified sequence opt1 from Clazakizumab_LightChain1
gccauccagaugacccagagccccuccagccuguccgccagcgugggcgaccgcgucaccaucacgugccaggcgucccagagcaucaacaacgagcucuccugguaccagcagaagccggggaaggcccccaagcugcugaucuaccgggccagcacccucgccuccggcgugcccagccgcuucuccgggagcggcuccgggaccgacuucacccugacgaucagcucccugcagcccgacgacuucgccaccuacuacugccagcagggcuacagccuccggaacaucgacaacgcguucggcgggggcaccaagguggagaucaagcgcaccgucgccgccccguccguguucaucuucccgcccagcgacgagcagcugaaguccgggacggccagcguggucugccugcucaacaacuucuacccccgggaggcgaaggugcaguggaagguggacaacgcccugcagagcggcaacucccaggagagcgucaccgagcaggacuccaaggacagcaccuacucccugagcuccacccucacgcugagcaaggccgacuacgagaagcacaagguguacgccugcgaggugacccaccaggggcuguccagccccgucaccaaguccuucaaccgcggcgagugc

SEQ ID NO: 7806 - RNA, 1347 nt, Artificial Sequence
  derived and/or modified sequence opt1 from Clivatuzumab_tetraxetan_HeavyChain1
caggugcagcugcagcagagcggcgccgaggucaagaagcccggggccuccgugaaggugagcugcgaggcguccggcuacaccuucccgagcuacguccuccacugggugaagcaggcccccgggcagggccuggaguggaucggguacaucaaccccuacaacgacggcacccaguacaacgagaaguucaagggcaaggccacgcugacccgcgacaccuccaucaacaccgccuacauggagcucagccggcugcgcuccgacgacacggccguguacuacugcgcgcggggguucggcgggagcuacggcuucgccuacugggggcagggcacccuggucaccguguccagcgccuccaccaagggccccagcguguucccgcucgcccccuccagcaaguccacgagcgggggcaccgcggcccuggggugccuggucaaggacuacuuccccgagcccgugaccguguccuggaacagcggcgcccucaccuccggcguccacacguucccggccgugcugcagagcagcgggcuguacucccucagcuccguggucaccgugcccagcuccagccugggcacccagaccuacaucugcaacgugaaccacaagcccuccaacacgaaggucgacaagcgcguggagcccaagagcugcgacaagacccacacgugcccgcccugccccgcccccgagcugcucgggggcccguccguguuccuguucccgcccaagcccaaggacacccugaugaucagccggacccccgaggugaccugcgucguggucgacgugucccacgaggaccccgaggucaaguucaacugguacguggacgggguggagguccacaacgcgaagaccaagccccgcgaggagcaguacaacagcaccuaccgggugguguccguccucacggugcugcaccaggacuggcugaacggcaaggaguacaagugcaaggugagcaacaaggcccuccccgccccgaucgagaagaccaucuccaaggccaagggccagccccgcgagccccaggucuacacccugcccccgagccgggaggagaugaccaagaaccaggugucccugacgugccucgugaagggguucuaccccagcgacaucgccgucgagugggaguccaacggccagcccgagaacaacuacaagaccaccccgcccgugcuggacagcgacgggagcuucuuccuguacuccaagcucaccguggacaagagccgcuggcagcagggcaacgucuucuccugcagcgugaugcacgaggcgcugcacaaccacuacacgcagaagucccugagccucucccccgggaag

SEQ ID NO: 7807 - RNA, 645 nt, Artificial Sequence
  derived and/or modified sequence opt1 from Clivatuzumab_tetraxetan_LightChain1
gacauccagcugacccagagccccuccagccucuccgccagcgugggcgaccgcgucaccaugacgugcuccgccagcuccagcguguccagcuccuaccuguacugguaccagcagaagccggggaaggcgcccaagcuguggaucuacagcaccuccaaccucgccagcggcgugcccgcccgguucuccgggagcggcuccgggaccgacuucacccugacgaucagcucccugcagcccgaggacagcgccagcuacuucugccaccaguggaaccgcuacccguacaccuucggcggcgggacccggcucgagaucaagcgcaccgucgccgcgcccuccguguucaucuucccgcccagcgacgagcagcugaaguccggcacggccagcguggucugccugcucaacaacuucuacccccgggaggccaaggugcaguggaagguggacaacgcccugcaguccgggaacagccaggaguccgucaccgagcaggacagcaaggacuccaccuacagccuguccagcacccucacgcuguccaaggcggacuacgagaagcacaagguguacgccugcgaggugacccaccagggccugagcucccccgucaccaagagcuucaaccgcggggagugc

SEQ ID NO: 7808 - RNA, 1335 nt, Artificial Sequence
  derived and/or modified sequence opt1 from Codrituzumab_HeavyChain1
caggugcagcugguccagagcggcgccgaggugaagaagcccggggccuccgugaaggucagcugcaaggcguccggcuacaccuucaccgacuacgagaugcacugggugcgccaggccccggggcagggccucgaguggaugggggcccuggaccccaagacgggcgacaccgccuacagccagaaguucaagggccgggugacccugaccgccgacaaguccacgagcaccgcguacauggagcucuccagccugaccuccgaggacaccgccgucuacuacugcacgcgcuucuacagcuacaccuacugggggcagggcacccuggugaccguguccagcgccuccacgaaggggcccagcgucuucccccucgccccguccagcaaguccaccagcggcgggaccgcggcccugggcugccuggugaaggacuacuuccccgagcccgugaccgucuccuggaacagcggcgcccucacgagcggggugcacaccuuccccgccgugcugcaguccagcggccuguacucccucagcuccgucgugaccgugccgagcuccagccuggggacccagacguacaucugcaacgucaaccacaagcccuccaacaccaagguggacaagaagguggagcccaagagcugcgacaagacccacacgugcccgcccugccccgcccccgagcugcucggcggccccuccgucuuccuguucccgcccaagcccaaggacacccugaugaucagccggacccccgaggugaccugcguggucguggacgucucccacgaggacccggaggugaaguucaacugguacguggacggggucgaggugcacaacgcgaagaccaagccccgcgaggagcaguacaacagcacguaccggguggucuccgugcucaccgugcugcaccaggacuggcugaacggcaaggaguacaagugcaaggucagcaacaaggcccuccccgcccccaucgagaagaccaucuccaaggccaaggggcagccgcgcgagccccagguguacacccugccgcccagccgggacgagcugacgaagaaccaggugucccugaccugccucgucaagggcuucuaccccagcgacaucgccguggagugggagagcaacgggcagcccgagaacaacuacaagaccacgcccccggugcuggacuccgacggcagcuucuuccucuacuccaagcugaccgucgacaagagccgcuggcagcagggcaacguguucuccugcagcgugaugcacgaggcgcugcacaaccacuacacccagaagucccucagccugucccccgggaag

SEQ ID NO: 7809 - RNA, 657 nt, Artificial Sequence
  derived and/or modified sequence opt1 from Codrituzumab_LightChain1
gacguggucaugacccagagcccccugucccucccggugacccccggcgagcccgccagcaucuccugccggagcucccagagccuggugcacuccaaccggaacacguaccugcacugguaccuccagaagcccgggcagagcccgcagcugcugaucuacaaggucuccaaccgcuucagcggcgugcccgaccgguucuccgggagcggcuccgggaccgacuucacccucaagaucagccgcguggaggccgaggacgucggcguguacuacugcucccagaacacccacgugccgcccacguucggccaggggaccaagcuggagaucaagcggaccgucgcggcccccagcguguucaucuucccgcccuccgacgagcagcucaagagcggcaccgccuccguggucugccugcugaacaacuucuacccccgcgaggccaaggugcaguggaagguggacaacgcccugcagagcgggaacagccaggaguccgucacggagcaggacagcaaggacuccaccuacagccucuccagcacccugacccuguccaaggcggacuacgagaagcacaagguguacgccugcgaggugacgcaccagggccucagcucccccgucaccaagagcuucaaccgcggggagugc

SEQ ID NO: 7810 - RNA, 1350 nt, Artificial Sequence
  derived and/or modified sequence opt1 from Coltuximab_ravtansine_HeavyChain1
caggugcagcugguccagcccggcgccgagguggugaagcccggggccagcgucaagcucuccugcaagaccagcggcuacaccuucacguccaacuggaugcacugggugaagcaggcgcccgggcagggccuggaguggaucggggagaucgaccccagcgacuccuacaccaacuacaaccagaacuuccagggcaaggccaagcugaccguggacaagagcaccuccacggccuacauggaggucagcucccuccgcagcgacgacaccgccguguacuacugcgcccggggcuccaaccccuacuacuacgcgauggacuacugggggcagggcaccagcgugaccgucuccagcgccuccacgaaggggccgagcguguucccccuggcccccuccagcaaguccaccagcggcgggaccgccgcgcugggcugccucgugaaggacuacuuccccgagccggucaccgugagcuggaacuccggcgcccugacgagcggggugcacaccuuccccgccguccugcaguccagcggccucuacucccugagcuccguggugaccguccccagcuccagccuggggacccagacguacaucugcaacgugaaccacaagcccuccaacaccaagguggacaagaaggucgagcccaagagcugcgacaagacccacacgugcccgcccugccccgccccggagcuccugggcggccccuccguguuccuguucccgcccaagcccaaggacacccucaugaucagccgcacccccgaggugaccugcgucguggucgacgugucccacgaggaccccgaggugaaguucaacugguacgucgacgggguggaggugcacaacgccaagaccaagccccgggaggagcaguacaacagcacguaccgcgucguguccgugcugaccguccugcaccaggacuggcucaacggcaaggaguacaagugcaaggugagcaacaaggcgcugccggcccccaucgagaagaccaucuccaaggccaaggggcagccccgggagccccagguguacacccugccgcccagccgcgacgagcucacgaagaaccaggucagccugaccugccuggugaagggcuucuaccccuccgacaucgccguggagugggagagcaacgggcagccggagaacaacuacaagaccaccccgcccguccucgacuccgacggcagcuucuuccuguacuccaagcugacgguggacaagagccgguggcagcagggcaacguguucuccugcagcgucaugcacgaggcccuccacaaccacuacacccagaagucccugagccugucccccgggaag

SEQ ID NO: 7811 - RNA, 633 nt, Artificial Sequence
  derived and/or modified sequence opt1 from Coltuximab_ravtansine_LightChain1
gagaucgugcugacccagagccccgccaucauguccgccagcccgggcgagcgcgucaccaugacgugcuccgcgagcuccggggugaacuacaugcacugguaccagcagaagcccggcaccagcccccggcgcuggaucuacgacaccuccaagcucgccagcggggugcccgcccgguucuccggcagcggguccggcaccgacuacagccugacgaucuccagcauggagccggaggacgccgccaccuacuacugccaccagcgcggcuccuacaccuucgggggcgggaccaagcuggagaucaagcggacggucgcggcccccagcguguucaucuucccgcccuccgacgagcagcucaagagcggcaccgccuccguggucugccugcugaacaacuucuacccccgcgaggccaaggugcaguggaagguggacaacgcgcuccagagcgggaacagccaggaguccgucaccgagcaggacagcaaggacuccaccuacagccuguccagcacgcugacccucuccaaggccgacuacgagaagcacaagguguacgccugcgaggugacccaccagggccugagcucccccgucaccaagagcuucaaccggggcgagugc

SEQ ID NO: 7812 - RNA, 1356 nt, Artificial Sequence
  derived and/or modified sequence opt1 from Conatumumab_CV_HeavyChain
caggugcagcugcaggagagcggccccgggcucgucaagccgucccagacccugagccugaccugcacgguguccggcgggagcaucuccagcggcgacuacuucugguccuggauccgccagcuccccgggaagggccuggaguggaucggccacauccacaacagcgggaccaccuacuacaaccccucccucaagagccgggugaccaucuccgucgacacgagcaagaagcaguucucccuccgccugagcuccgugaccgccgccgacaccgcgguguacuacugcgcccgggaccgcggcggggacuacuacuacggcauggacgucugggggcagggcaccacggugaccgugagcuccgccagcaccaagggccccuccgucuucccgcuggcccccagcagcaaguccaccagcgggggcacggccgcgcucgggugccuggugaaggacuacuuccccgagcccgugaccgucuccuggaacagcggcgcccugaccuccggcgugcacaccuucccggccgugcuccagagcuccgggcuguacagccuguccagcgucgugacggugcccuccagcucccucggcacccagaccuacaucugcaacgucaaccacaagcccagcaacaccaagguggacaagcggguggagcccaaguccugcgacaagacgcacacgugcccgcccugccccgcccccgagcugcucgggggcccgagcgucuuccuguucccgcccaagcccaaggacacccugaugaucucccgcacccccgaggugaccugcguggucguggacgucagccacgaggaccccgaggugaaguucaacugguacguggacggggucgaggugcacaacgcgaagaccaagccccgggaggagcaguacaacuccaccuaccgcguggucagcgugcugaccgugcuccaccaggacuggcugaacggcaaggaguacaagugcaaggucagcaacaaggcccugcccgccccgaucgagaagacgaucuccaaggccaagggccagccccgggagccccagguguacacccugcccccgagccgcgaggagaugaccaagaaccaggugucccugaccugccuggucaagggguucuaccccagcgacaucgccguggagugggaguccaacggccagcccgagaacaacuacaagacgaccccgcccgugcucgacagcgacggguccuucuuccuguacagcaagcugaccgucgacaagucccgguggcagcagggcaacguguucagcugcuccgugaugcacgaggcgcuccacaaccacuacacccagaagucccugagccugagccccgggaag

SEQ ID NO: 7813 - RNA, 645 nt, Artificial Sequence
  derived and/or modified sequence opt1 from Conatumumab_CV_LightChain
gagaucgugcugacccagagccccggcacccucucccugagcccgggggagcgcgccacgcuguccugccgggccagccagggcaucucccgcagcuaccucgcgugguaccagcagaagcccgggcaggcccccucccugcugaucuacggcgccagcucccgggccaccgggauccccgaccgcuucagcggcuccggcagcgggaccgacuucacccucacgaucucccggcuggagccggaggacuucgccgucuacuacugccagcaguucggcagcucccccuggaccuucgggcagggcaccaagguggagaucaagcgcaccguggcggcccccagcgucuucaucuucccgcccuccgacgagcagcucaagagcgggacggccuccguggugugccugcugaacaacuucuacccccgggaggccaagguccaguggaagguggacaacgcgcugcagagcggcaacagccaggaguccgugaccgagcaggacagcaaggacuccaccuacagccucuccagcacccugacgcuguccaaggccgacuacgagaagcacaaggucuacgccugcgaggugacccaccagggccucagcucccccgugaccaagagcuucaaccgcggggagugc

SEQ ID NO: 7814 - RNA, 1356 nt, Artificial Sequence; identical to SEQ ID NO: 7812
  derived and/or modified sequence opt1 from Conatumumab_HeavyChain1

SEQ ID NO: 7815 - RNA, 1356 nt, Artificial Sequence; identical to SEQ ID NO: 7812
  derived and/or modified sequence opt1 from Conatumumab_HeavyChain

SEQ ID NO: 7816 - RNA, 645 nt, Artificial Sequence; identical to SEQ ID NO: 7813
  derived and/or modified sequence opt1 from Conatumumab_LightChain1

SEQ ID NO: 7817 - RNA, 645 nt, Artificial Sequence; identical to SEQ ID NO: 7813
  derived and/or modified sequence opt1 from Conatumumab_LightChain

SEQ ID NO: 7818 - RNA, 1344 nt, Artificial Sequence
  derived and/or modified sequence opt1 from Concizumab_HeavyChain1
gaggugcagcuggucgagagcggcgggggccucgugaagcccgggggcucccugcgccugagcugcgccgccuccggguucaccuucagcaacuacgcgauguccugggugcggcagaccccggagaagcgccucgagugggucgccacgaucagccgguccggcagcuacuccuacuuccccgacagcgugcagggccgcuucaccaucucccgggacaacgccaagaacagccuguaccugcagaugaacucccuccgcgccgaggacaccgccguguacuacugcgcgcggcucgggggcuacgacgagggggacgccauggacagcuggggccaggggaccacggucaccguguccagcgccuccaccaagggccccagcguguucccccuggccccgugcucccgcagcaccagcgaguccacggcggcccucggcugccuggucaaggacuacuuccccgagcccgugaccgugagcuggaacuccggggcccugaccagcggcguccacaccuuccccgccgugcuccaguccagcgggcuguacucccugagcuccguggucacggugccgagcuccagccucggcaccaagaccuacacgugcaacguggaccacaagcccuccaacaccaaggucgacaagcggguggagagcaaguacggcccgcccugcccgcccugccccgcccccgaguuccucgggggccccuccguguuccuguucccgcccaagcccaaggacacccugaugaucagccgcacccccgaggugaccugcgucguggucgacgugucccaggaggaccccgagguccaguucaacugguacguggacgggguggagguccacaacgcgaagacgaagccccgggaggagcaguucaacagcaccuaccgcgugguguccguccugaccgugcugcaccaggacuggcucaacggcaaggaguacaagugcaaggugagcaacaaggggcugcccagcuccaucgagaagaccaucagcaaggccaagggccagccgcgggagccccaggucuacacgcugccgcccucccaggaggagaugaccaagaaccaggugagccugaccugccuggugaagggcuucuaccccuccgacaucgccgucgagugggagagcaacgggcagcccgagaacaacuacaagaccacgcccccggugcuggacuccgacggcagcuucuuccucuacucccgccugaccguggacaagagccgguggcaggaggggaacgucuucuccugcagcgugaugcacgaggcccugcacaaccacuacacccagaagucccucagccugucccugggcaag

SEQ ID NO: 7819 - RNA, 657 nt, Artificial Sequence
  derived and/or modified sequence opt1 from Concizumab_LightChain1
gacaucgugaugacccagacgccccugagccucuccgucaccccgggccagcccgccagcaucuccugcaagagcucccagagccugcuggaguccgacgggaagaccuaccucaacugguaccugcagaagcccggccagagcccccagcugcucaucuaccugguguccauccuggacagcggggugccggaccgcuucuccggcagcggguccggcaccgacuucacccucaagaucagccgggucgaggccgaggacgugggcguguacuacugccugcaggcgacgcacuucccccagaccuucgggggcgggaccaaggucgagaucaagcgcaccguggccgcccccuccguguucaucuucccgcccagcgacgagcagcugaaguccggcacggccagcgucgugugccuccugaacaacuucuacccccgggaggccaaggugcaguggaaggucgacaacgcgcugcaguccgggaacagccaggagagcgugaccgagcaggacuccaaggacagcaccuacucccucagcuccacccugacgcugagcaaggccgacuacgagaagcacaagguguacgccugcgaggucacccaccagggccucuccagccccgugaccaaguccuucaaccgcggcgagugc

SEQ ID NO: 7820 - RNA, 1314 nt, Artificial Sequence
  derived and/or modified sequence opt1 from Crenezumab_HeavyChain1
gaggugcagcuggucgagagcggcgggggccucgugcagcccgggggcucccugcgccugagcugcgccgccuccggguucaccuucagcuccuacggcaugagcugggugcggcaggcgcccggcaaggggcucgagcuggucgccuccaucaacagcaacggcggguccaccuacuaccccgacagcgugaagggccgcuucacgaucucccgggacaacgccaagaacagccuguaccuccagaugaacucccugcgcgccgaggacaccgccguguacuacugcgcgagcggggacuacuggggccagggcaccaccgucacgguguccagcgccuccaccaaggggcccagcguguucccccuggccccgugcucccggagcaccagcgaguccaccgccgcgcucggcugccuggucaaggacuacuuccccgagcccgugacggugagcuggaacuccggggcccugaccagcggcguccacaccuuccccgccgugcuccaguccagcggccuguacucccugagcuccguggucaccgugccgagcuccagccucgggacgaagaccuacacgugcaacguggaccacaagcccuccaacaccaaggucgacaagcgcguggagagcaaguacggcccgcccugcccgcccugccccgcccccgaguuccucgggggcccguccguguuccuguucccgcccaagcccaaggacacccucaugaucagccggacccccgaggugaccugcgucguggucgacgugucccaggaggaccccgagguccaguucaacugguacguggacgggguggagguccacaacgccaagaccaagccccgcgaggagcaguucaacagcacguaccgggugguguccguccugaccgugcugcaccaggacuggcucaacggcaaggaguacaagugcaaggugagcaacaagggccugcccagcuccaucgagaagaccaucagcaaggcgaaggggcagccgcgcgagccccaggucuacacccugccgcccucccaggaggagaugacgaagaaccaggugagccugaccugccuggugaagggcuucuaccccuccgacaucgccgucgagugggagagcaacgggcagcccgagaacaacuacaagaccaccccgcccgugcuggacuccgacggcagcuucuuccucuacucccggcugacgguggacaagagccgcuggcaggaggggaacgucuucuccugcagcgugaugcacgaggcccugcacaaccacuacacccagaagucccucagccugucccugggc

SEQ ID NO: 7821 - RNA, 657 nt, Artificial Sequence
  derived and/or modified sequence opt1 from Crenezumab_LightChain1
gacaucgugaugacccagagcccccugucccucccggucacccccggcgagcccgccagcaucuccugccgcagcucccagagccugguguacuccaacggggacacguaccugcacugguaccuccagaagcccggccagagcccgcagcugcugaucuacaagguguccaaccgguucagcgggguccccgaccgcuucuccggcagcggguccggcaccgacuucacccucaagaucagccggguggaggccgaggacgugggcgucuacuacugcucccagagcacccacgugcccuggacguucgggcagggcaccaagguggagaucaagcgcaccgucgcggcccccuccguguucaucuucccgcccagcgacgagcagcugaaguccgggaccgccagcguggucugccugcucaacaacuucuacccccgggaggccaaggugcaguggaagguggacaacgcccugcagagcggcaacucccaggagagcgucacggagcaggacuccaaggacagcaccuacucccugagcuccacccucacccugagcaaggcggacuacgagaagcacaagguguacgccugcgaggugacgcaccaggggcuguccagccccgucaccaaguccuucaaccgcggcgagugc

SEQ ID NO: 7822 - RNA, 1365 nt, Artificial Sequence
  derived and/or modified sequence opt1 from Crotedumab_HeavyChain1
gaggugcagcuggucgagagcggcgggggccucgugcagcccgggggcucccugcgccugagcugcgccgccuccggguucaccuucagcaacuaccucaugaacugggugcggcaggcgcccggcaagggccuggaguggcuggccaacauccaggaggacgggaucgagaaguacuacgucgacuccgugaagggccgcuucaccaucagccgggacaacgccaagaacucccucuaccugcagaugaacagccugcgcgccgaggacacggccguguacuacugcgcgcgggagcccucccacuacgacauccucaccggguacgacuacuacuacggcauggacgucugggggcagggcaccaccgugacggugagcuccgccagcaccaagggccccuccgucuucccccuggccccgugcagccgcuccaccagcgaguccaccgccgcgcuggggugccucgugaaggacuacuuccccgagcccgugacggucagcaacaacuccggcgcccugaccagcggggugcacaccuuccccgccgugcugcagagcuccggccucuacagccuguccagcgucgugaccgugccguccagcucccugggcacgaagaccuacacgugcaacgucgaccacaagcccagcaacaccaagguggacaagcggguggaguccaaguacgggccgcccugcccgcccugccccgcccccgaguuccucggcgggccgagcgucuuccuguucccgcccaagcccaaggacacccugaugaucucccgcacccccgaggugaccugcguggucguggacgucagccaggaggaccccgaggugcaguucaacugguacguggacggcgucgaggugcacaacgccaagaccaagccccgggaggagcaguucaacuccacguaccgcguggucagcgugcucaccgugcugcaccaggacuggcugaacgggaaggaguacaagugcaaggucuccaacaagggccuccccagcuccaucgagaagaccaucagcaaggcgaagggccagccgcgggagccccagguguacacccugccgcccucccaggaggagaugacgaagaaccaggugagccugaccugccucgucaagggguucuaccccagcgacaucgccguggagugggaguccaacggccagcccgagaacaacuacaagaccaccccgcccgugcuggacagcgacggguccuucuuccuguacagccgccucacggucgacaagucccgguggcaggagggcaacguguucagcugcuccgugaugcacgaggcccugcacaaccacuacacccagaagucccugagccucagccuggggaag

SEQ ID NO: 7823 - RNA, 1365 nt, Artificial Sequence
  derived and/or modified sequence opt1 from Crotedumab_HeavyChain2
gaggugcagcuggucgagagcggcgggggccucgugcagcccgggggcucccugcaccugagcugcgccgccuccggguucaccuucagcaacuaccucaugaacugggugcgccaggcgcccggcaagggccuggaguggcuggccaacauccaggaggacgggaucgagaaguacuacgucgacuccgugaagggccgguucaccaucagccgcgacaacgccaagaacucccucuaccugcagaugaacagccugcgggccgaggacacggccguguacuacugcgcgcgcgagcccucccacuacgacauccucaccggguacgacuacuacuacggcauggacgucugggggcagggcaccaccgugacggugagcuccgccagcaccaagggccccuccgucuucccccuggccccgugcagccgguccaccagcgaguccaccgccgcgcuggggugccucgugaaggacuacuuccccgagcccgugacggucagcaacaacuccggcgcccugaccagcggggugcacaccuuccccgccgugcugcagagcuccggccucuacagccuguccagcgucgugaccgugccguccagcucccugggcacgaagaccuacacgugcaacgucgaccacaagcccagcaacaccgagguggacgagcgcguggaguccaaguacgggccgcccugcccgcccugccccgcccccgaguuccucggcgggccgagcgucuuccuguucccgcccaagcccaaggacacccugaugaucucccggacccccgaggugaccugcguggucguggacgucagccaggaggaccccgaggugcaguucaacugguacguggacggcgucgaggugcacaacgccaagaccaagccccgcgaggagcaguucugguccacguaccggguggucagcgugcucaccgugcugcaccaggacuggcugaacgggaaggaguacaagugcaaggucuccaacaagggccuccccagcuccaucgagaagaccaucagcaaggcgaagggccagccgcgcgagccccagguguacacccugccgcccucccaggaggagaugacgaagaaccaggugagccugaccugccucgucaagggguucuaccccagcgacaucgccguggagugggaguccaacggccagcccgagaacaacuacaagaccaccccgcccgugcuggacagcgacggguccuucuuccuguacagccggcucacggucgacgagucccgcuggcaggagcacaacguguucagcugcuccgugaugcacgaggcccugcacaaccacuacacccagaagucccugagccucagccugggcaag

SEQ ID NO: 7824 - RNA, 642 nt, Artificial Sequence
  derived and/or modified sequence opt1 from Crotedumab_LightChain1
gacauccagaugacccagagccccuccagccuguccgccagcgugggcgaccgcgucaccaucacgugccgggccucccaggggauccgcaacgaccucggcugguaccagcagaagccggggaaggcgcccaagcggcugaucuacgccgccagcucccugcagagcggcgugcccucccgcuucagcggguccggcagcggcaccgaguucauccucaccguguccagccugcagcccgaggacuucgccaccuacuacugccugcaguacaacgagaacccguucacguucgggcccggcaccaaggucgacaucaagcggaccguggccgcgcccuccguguucaucuucccgcccagcgacgagcagcucaaguccgggaccgccagcgucgugugccugcugaacaacuucuacccccgcgaggccaaggugcaguggaaggucgacaacgcccuccaguccggcaacagccaggagagcgugacggagcaggacuccaaggacagcaccuacucccugagcuccacccugacccucagcaaggcggacuacgaggagcacaagguguacgccugcgaggucacgcaccaggggcuguccagccccgugaccaaguccuucaaccggggcgagugc

SEQ ID NO: 7825 - RNA, 642 nt, Artificial Sequence
  derived and/or modified sequence opt1 from Crotedumab_LightChain2
gacauccagaugacccagagccccuccagccuguccgccagcgugggcgaccgcgucaccaucacgugccgggccucccaggggauccgcaacgaccucggcugguaccagcagaagccggggaaggcgcccaagcggcugaucuacgccgccagcucccugcagagcggcgugcccucccgcuucagcggguccggcagcggcaccgaguucauccucaccguguccagccugcagcccgaggacuucgccaccuacuacugccugcaguacaacuccaacccguucacguucgggcccggcaccaaggucgacaucaagcggaccguggccgcgcccagcguguucaucuucccgcccuccgacgagcagcucaagagcgggaccgccuccgucgugugccugcugaacaacuucuacccccgcgaggccaaggugcagaacaaggucgacaacgcccuccagagcggcaacagccaggaguccgugacggagcaggacagcaaggacuccaccuacagccuguccagcacccugacccucuccgaggcggacuacgagaagcacaagguguacgccugcgaggucacgcaccaggggcugagcucccccgugaccaagagcuucaaccggggcgagugc

SEQ ID NO: 7826 - RNA, 1332 nt, Artificial Sequence
  derived and/or modified sequence opt1 from Dacetuzumab_HeavyChain1
gaggugcagcuggucgagagcggcgggggccucgugcagcccgggggcucccugcgccugagcugcgccgccuccggguacagcuucaccggcuacuacauccacugggugcggcaggcgccgggcaaggggcucgagugggucgcccgcgugauccccaacgccggcgggaccuccuacaaccagaaguucaagggccgguucacgcugagcguggacaacuccaagaacaccgccuaccugcagaugaacagccuccgcgccgaggacaccgcggucuacuacugcgcccgggaggggaucuacugguggggccagggcacccuggugacgguguccagcgccuccaccaaggggcccagcgucuucccccuggccccguccagcaaguccaccagcggcgggaccgcggcccucggcugccuggugaaggacuacuuccccgagcccgugacggucuccuggaacagcggcgcccugaccuccggggugcacaccuuccccgccgugcuccagagcagcggccuguacucccugagcuccgucgugaccgugccgagcuccagccucgggacgcagaccuacaucugcaacgucaaccacaagcccuccaacaccaagguggacaagaagguggagcccaagagcugcgacaagacccacacgugcccgcccugccccgcccccgagcugcugggcgggcccuccgucuuccucuucccgcccaagcccaaggacacccugaugaucagccgcacccccgaggugaccugcguggucguggacgucucccacgaggacccggaggugaaguucaacugguacguggacggcgucgaggugcacaacgcgaagacgaagccccgggaggagcaguacaacagcaccuaccgcguggucuccgugcugaccgugcuccaccaggacuggcugaacggcaaggaguacaagugcaaggucagcaacaaggcccugcccgcccccaucgagaagaccaucuccaaggccaaggggcagccgcgggagccccagguguacacgcucccgcccagccgcgaggagaugaccaagaaccaggugucccugaccugccuggucaagggcuucuaccccagcgacaucgccguggagugggaguccaacgggcagcccgagaacaacuacaagaccacgcccccggugcucgacagcgacggcagcuucuuccuguacuccaagcugaccgucgacaagagccgguggcagcaggggaacguguucuccugcagcgugaugcacgaggcgcuccacaaccacuacacccagaagucccugagccugucccccggcaag

SEQ ID NO: 7827 - RNA, 657 nt, Artificial Sequence
  derived and/or modified sequence opt1 from Dacetuzumab_LightChain1
gacauccagaugacccagagccccuccagccuguccgccagcgugggcgaccgcgucaccaucacgugccgguccagccagucccucgugcacagcaacgggaacaccuuccugcacugguaccagcagaagccgggcaaggcccccaagcugcucaucuacaccguguccaaccgcuucagcgggguccccucccgguucagcggcuccgggagcggcaccgacuucacgcugaccaucuccagccugcagcccgaggacuucgcgaccuacuucugcucccagaccacgcacgugccguggaccuucggccaggggaccaagguggagaucaagcgcaccgucgccgcccccagcguguucaucuucccgcccuccgacgagcagcucaagagcggcacggccagcguggucugccugcugaacaacuucuacccccgggaggccaaggugcaguggaagguggacaacgcgcuccaguccgggaacagccaggaguccgucaccgagcaggacagcaaggacuccaccuacagccuguccagcacccugacgcucuccaaggccgacuacgagaagcacaagguguacgccugcgaggugacccaccagggccugagcucccccgucaccaagagcuucaaccgcggggagugc

SEQ ID NO: 7828 - RNA, 318 nt, Artificial Sequence
  derived and/or modified sequence opt1 from Dacliximab_LightChain_VJ-Region
gacauccagaugacccagagccccuccacccugagcgccuccgugggcgaccgcgucacgaucacgugcagcgccuccagcuccaucagcuacaugcacugguaccagcagaagccggggaaggcgcccaagcuccugaucuacaccaccuccaaccuggccagcggcgugcccgcccgguucuccgggagcggcuccgggaccgaguucacccucaccaucagcucccugcagcccgacgacuucgccaccuacuacugccaccagcgcagcacguacccgcugaccuucggccagggcaccaagguggaggucaag

SEQ ID NO: 7829 - RNA, 348 nt, Artificial Sequence
  derived and/or modified sequence opt1 from Dacliximab_gamma2-Chain_VDJ-Region
caggugcagcugguccagagcggcgccgaggugaagaagcccggguccagcgugaaggucuccugcaaggccagcggcuacaccuucaccuccuaccgcaugcacugggugcggcaggcgccggggcagggccucgaguggaucggguacaucaaccccagcacgggcuacaccgaguacaaccagaaguucaaggacaaggccaccaucaccgccgacgaguccacgaacaccgccuacauggagcugagcucccugcgcagcgaggacaccgccguguacuacugcgcgcggggcgggggcgucuucgacuacugggggcagggcacccucgugacgguguccagc

SEQ ID NO: 7830 - RNA, 1326 nt, Artificial Sequence
  derived and/or modified sequence opt1 from Daclizumab_HeavyChain
caggugcagcugguccagagcggcgccgaggugaagaagcccggguccagcgugaaggucuccugcaaggccagcggcuacaccuucaccuccuaccgcaugcacugggugcggcaggcgccggggcagggccucgaguggaucggguacaucaaccccagcacgggcuacaccgaguacaaccagaaguucaaggacaaggccaccaucaccgccgacgaguccacgaacaccgccuacauggagcugagcucccugcgcagcgaggacaccgccguguacuacugcgcgcggggcgggggcgucuucgacuacugggggcagggcaccacgcucaccguguccagcgggcccuccguguucccccuggccccgagcuccaagagcaccuccggcggcaccgccgcccuggggugccucgucaaggacuacuuccccgagcccgugacggugagcuggaacuccggcgcgcugaccagcgggguccacaccuuccccgccgugcugcagagcuccggccucuacagccuguccagcguggucaccgugccguccagcucccugggcacgcagaccuacaucugcaacgugaaccacaagcccagcaacaccaaggucgacaagaaggccgagcccaaguccugcgacaagacccacacgugcccgcccugccccgcccccgagcuccucgggggccccagcguguuccuguucccgcccaagcccaaggacacccugaugaucucccgcacccccgaggugaccugcgucgugguggacgucagccacgaggacccggaggugaaguucaacugguacgucgacgggguggaggugcacaacgccaagacgaagccccgggaggagcaguacaacuccaccuaccgcgucgugagcgugcugaccguccugcaccaggacuggcucaacggcaaggaguacaagugcaagguguccaacaaggcgcugcccgcccccaucgagaagaccaucagcaaggccaaggggcagccgcgggagccccagguguacacgcugccgcccucccgcgacgagcucaccaagaaccaggucagccugaccugccuggugaagggcuucuaccccuccgacaucgccguggagugggagagcaacggccagcccgagaacaacuacaagaccacgcccccgguccucgacagcgacggguccuucuuccuguacagcaagcugaccguggacaagucccgguggcagcagggcaacguguucagcugcuccgucaugcacgaggcccuccacaaccacuacacccagaagucccugagccugagccccgggaag

SEQ ID NO: 7831 - RNA, 630 nt, Artificial Sequence
  derived and/or modified sequence opt1 from Daclizumab_LightChain
gacauccagaugacccagagccccuccacccugagcgccuccgugggcgaccgcgucacgaucacgugcagcgccuccagcuccaucagcuacaugcacugguaccagcagaagccggggaaggcgcccaagcuccugaucuacaccaccuccaaccuggccagcggcgugcccgcccgguucuccgggagcggcuccgggaccgaguucacccucaccaucagcucccugcagcccgacgacuucgccaccuacuacugccaccagcgcagcacguacccgcugaccuucggcuccggcaccaagguggaggucaagcggaccguggccgcgcccagcguguucaucuucccgcccuccgacgagcagcucaagagcgggacggccagcgucgugugccugcugaacaacuucuacccccgcgaggccaaggugcaguggaaggucgacaacgcccuccaguccggcaacagccaggaguccgugaccgagcaggacagcaaggacuccaccuacagccuguccagcacccugacgcucuccaaggcggacuacgagaagcacaagguguacgccugcgaggucacccaccaggggcugagcucccccgugaccaagagcuucaaccgg

SEQ ID NO: 7832 - RNA, 1341 nt, Artificial Sequence
  derived and/or modified sequence opt1 from Dalotuzumab_HeavyChain1
caggugcagcugcagcagagcggccccgggcucgucaagcccucccagacccugagccugaccugcacgguguccggcuggagcaucuccgggggcuggcucuggaacuggauccgccagccgcccgggaagggccugcaguggaucggcuggaucagcugggacgggaccaacaacuggaagcccucccugaaggaccgggugaccaucagcgucgacaccuccaagaaccaguucagccucaagcuguccagcgugacggccgccgacaccgcggugugguggugcgcccgcuggggccgggucuucuucgacuggugggggcagggcacccuggugaccguguccagcgccuccacgaaggggccgagcgucuucccccucgcccccuccagcaaguccaccagcggcggcaccgccgcgcuggggugccuggugaaggacuacuuccccgagccggugaccgucagcuggaacuccggcgcccucacgagcggggugcacaccuuccccgccgugcugcaguccagcggccuguacucccucagcuccgucgugaccgugcccagcuccagccugggcacccagacguacaucugcaacgucaaccacaagcccuccaacaccaagguggacaagcgcguggagcccaagagcugcgacaagacccacacgugcccgcccugccccgcccccgagcugcucgggggccccuccgucuuccuguucccgcccaagcccaaggacacccugaugaucagccggacccccgaggugaccugcguggucguggacgucucccacgaggaccccgaggugaaguucaacugguacguggacggggucgaggugcacaacgcgaagaccaagccccgcgaggagcaguacaacagcacguaccggguggucuccgugcucaccgugcugcaccaggacuggcugaacggcaaggaguacaagugcaaggucagcaacaaggcccucccggcccccaucgagaagaccaucuccaaggccaaggggcagccccgcgagccccagguguacacccugccgcccagccgggaggagaugacgaagaaccaggugagccugaccugccucgucaagggcuucuaccccuccgacaucgccguggagugggagagcaacggccagccggagaacaacuacaagaccaccccgcccgugcuggacuccgacgggagcuucuuccuguacuccaagcucacggucgacaagagccgcuggcagcagggcaacguguucuccugcagcgugaugcacgaggcgcugcacaaccacuacacccagaagucccugagccucucccccgggaag

SEQ ID NO: 7833 - RNA, 657 nt, Artificial Sequence
  derived and/or modified sequence opt1 from Dalotuzumab_LightChain1
gacaucgugaugacccagagcccccugucccucccggucacccccggccagcccgccagcaucuccugccgcagcucccagagcaucgugcacuccaacgggaacacguggcugcagugguggcugcagaagcccggccagagcccgcagcuccugaucuggaagguguccaaccggcuguggggcguccccgaccgcuucagcggguccgggagcggcaccgacuucacccucaagaucucccgggugcaggcccaggacgugggcgucugguggugcuuccaggggagccacgugcccuggaccuucggccaggggacgaaggugcagaucaagcgcaccgucgcggcccccuccguguucaucuucccgcccagcgacgagcagcugaaguccggcaccgccagcguggucugccugcucaacaacuucuacccccgggaggccaaggugcaguggaagguggacaacgcccugcaguccgggaacagccaggagagcgucaccgagcaggacuccaaggacagcacguacucccugagcuccacccucacccugagcaaggcggacuacgagaagcacaagguguacgccugcgaggugacccaccagggccuguccagccccgucacgaaguccuucaaccgcggcgagugc

SEQ ID NO: 7834 - RNA, 687 nt, Artificial Sequence
  derived and/or modified sequence opt1 from Dapirolizumab_pegol_HeavyChain1
gaggugcagcuggucgagagcggcgggggccucgugcagcccgggggcucccugcgccugagcugcgccguguccggguucagcuccaccaacuaccacguccacugggugcggcaggccccgggcaagggccucgaguggaugggggugaucuggggcgacggggacaccagcuacaacuccguccucaagagccgcuucaccaucucccgggacaccagcaagaacaccguguaccugcagaugaacucccugcgcgcggaggacaccgccguguacuacugcgcccggcagcugacgcacuacuacguccuggccgccuggggccaggggacccucgugaccgugagcuccgcgagcaccaagggccccuccgucuucccccuggcccccagcuccaagagcacguccggcgggaccgccgcccugggcugccucgugaaggacuacuucccggagcccgugaccgucagcuggaacagcggggcgcugaccuccggcgugcacacguuccccgccgugcugcagagcuccggccucuacagccuguccagcgucgugaccgugcccuccagcucccuggggacccagaccuacaucugcaacgucaaccacaagccgagcaacacgaagguggacaagaagguggagcccaaguccugcgacaagacccacacgugcgccgcc

SEQ ID NO: 7835 - RNA, 642 nt, Artificial Sequence
  derived and/or modified sequence opt1 from Dapirolizumab_pegol_LightChain1
gacauccagaugacccagagccccuccagccuguccgccagcgugggcgaccgcgucaccaucacgugccgggccuccgaggaccucuacuacaaccuggcgugguaccagcgcaagccggggaaggcccccaagcugcucaucuacgacaccuaccggcuggccgacggcgugcccagccgcuucuccgggagcggcuccgggaccgacuacacccugacgaucagcucccuccagcccgaggacuucgccagcuacuacugccagcaguacuacaaguucccguucaccuucggccagggcaccaagguggagaucaagcggaccgucgccgcgcccuccguguucaucuucccgcccagcgacgagcagcugaaguccgggacggccagcguggucugccugcucaacaacuucuacccccgcgaggccaaggugcaguggaagguggacaacgcccugcaguccggcaacagccaggaguccgucaccgagcaggacagcaaggacagcaccuacucccugagcuccacccucacgcugagcaaggcggacuacgagaagcacaagguguacgccugcgaggugacccaccaggggcuguccagccccgucaccaaguccuucaaccggggcgagugc

SEQ ID NO: 7836 - RNA, 1356 nt, Artificial Sequence
  derived and/or modified sequence opt1 from Daratumumab_HeavyChain1
gaggugcagcugcucgagagcggcgggggccugguccagcccgggggcucccugcgccucagcugcgccguguccggguucaccuucaacagcuucgccauguccugggugcggcaggcgccgggcaagggccuggagugggucagcgccaucuccgggagcggcgggggcaccuacuacgccgacuccgugaaggggcgcuucacgaucagccgggacaacuccaagaacacccuguaccuccagaugaacagccugcgcgccgaggacaccgccguguacuucugcgcgaaggacaagauccugugguucggcgagcccgucuucgacuacuggggccaggggacccucgugacgguguccagcgccuccaccaagggccccagcgucuucccccuggccccguccagcaaguccaccagcgggggcaccgccgcgcugggcugccucgugaaggacuacuuccccgagcccgugacggucagcuggaacuccggggcccugaccagcggcgugcacaccuuccccgccgugcugcaguccagcgggcucuacucccugagcuccgucgugaccgugccgagcuccagccugggcacgcagaccuacaucugcaacgucaaccacaagcccuccaacaccaagguggacaagcggguggagcccaagagcugcgacaagacccacacgugcccgcccugccccgcccccgagcuccucgggggccccuccgucuuccuguucccgcccaagcccaaggacacccucaugaucagccgcacccccgaggugaccugcguggucguggacgucucccacgaggacccggaggugaaguucaacugguacguggacggcgucgaggugcacaacgccaagacgaagccccgggaggagcaguacaacagcaccuaccgcguggucuccgugcugaccgugcugcaccaggacuggcucaacgggaaggaguacaagugcaaggucagcaacaaggcgcugcccgcccccaucgagaagaccaucuccaaggccaagggccagccgcgggagccccagguguacacgcugccgcccagccgcgaggagaugaccaagaaccaggugagccugaccugccuggucaagggguucuaccccuccgacaucgccguggagugggagagcaacggccagcccgagaacaacuacaagaccacgcccccggugcuggacuccgacgggagcuucuuccucuacuccaagcugaccgucgacaagagccgguggcagcagggcaacguguucuccugcagcgugaugcacgaggcccugcacaaccacuacacccagaagucccucagccugucccccggcaag

SEQ ID NO: 7837 - RNA, 642 nt, Artificial Sequence
  derived and/or modified sequence opt1 from Daratumumab_LightChain1
gagaucgugcugacccagagccccgccacccucucccugagccccggcgagcgcgccacgcuguccugccgggcgagccaguccgucagcuccuaccucgccugguaccagcagaagcccgggcaggcgccccgccugcugaucuacgacgccagcaaccgggccaccggcauccccgcccgcuucuccgggagcggcuccgggaccgacuucacccucacgaucagcucccuggagccggaggacuucgccguguacuacugccagcagcggagcaacuggccgcccaccuucggccagggcaccaagguggagaucaagcgcaccgucgccgcccccuccguguucaucuucccgcccagcgacgagcagcugaaguccgggacggcgagcguggucugccuccugaacaacuucuacccccgggaggccaaggugcaguggaagguggacaacgcccugcaguccggcaacagccaggagagcgucaccgagcaggacuccaaggacagcaccuacucccucagcuccacccugacgcugagcaaggccgacuacgagaagcacaagguguacgccugcgaggugacccaccaggggcucuccagccccgucaccaaguccuucaaccgcggcgagugc

SEQ ID NO: 7838 - RNA, 1350 nt, Artificial Sequence
  derived and/or modified sequence opt1 from Dectrekumab_HeavyChain1
gaggugcagcuggucgagagcggcgggggcguggugcagcccgggcgcucccuccggcugagcugcgccgccuccggcuucaccuucagcuccuacgggaugcacuggguccgccaggcgccgggcaagggccuggaguggguggccaucaucugguacgacgggagcaacaaguacuacgccgacuccgugaagggccgguucaccaucagccgcgacaacuccaagaacacgcucuaccugcagaugaacagccugcgggccgaggacaccgccgucuacuacugcgcgcgccucugguucggggaccuggacgccuucgacaucuggggccaggggaccauggugaccguguccagcgccuccacgaagggccccagcgucuucccccuggcccccuccagcaaguccaccagcggcgggaccgcggcccucggcugccuggugaaggacuacuucccggagcccgugaccgucuccuggaacagcggggcccugacgagcggcgugcacaccuuccccgccgugcuccaguccagcggccuguacucccugagcuccgucgugaccgugcccagcuccagccucgggacccagacguacaucugcaacgucaaccacaagccguccaacaccaagguggacaagcggguggagcccaagagcugcgacaagacccacacgugcccgcccugcccggcccccgagcugcugggcgggcccuccgucuuccucuucccgcccaagcccaaggacacccugaugaucagccgcacccccgaggugaccugcguggucguggacgucucccacgaggaccccgaggugaaguucaacugguacguggacggcgucgaggugcacaacgcgaagaccaagccgcgggaggagcaguacaacagcacguaccgcguggucuccgugcugaccgugcuccaccaggacuggcugaacgggaaggaguacaagugcaaggucagcaacaaggcccugcccgcccccaucgagaagaccaucuccaaggccaagggccagccccgggagccccagguguacacccucccgcccagccgcgaggagaugacgaagaaccaggugucccugaccugccuggucaagggcuucuaccccagcgacaucgccguggagugggagagcaacgggcagcccgagaacaacuacaagaccaccccgcccgugcucgacuccgacggcagcuucuuccuguacuccaagcugacggucgacaagagccgguggcagcaggggaacguguucuccugcagcgugaugcacgaggcgcuccacaaccacuacacccagaagucccugagccugucccccggcaag

SEQ ID NO: 7839 - RNA, 648 nt, Artificial Sequence
  derived and/or modified sequence opt1 from Dectrekumab_LightChain1
gagaucgugcugacccagagccccgccacccucucccugagccccggcgagcgcgccauccuguccugccgggcggggcagagcgucuccagcuaccucgugugguaccagcagaagcccggccaggcgccccgccugcugaucuacgacgccuccaaccgggccacggggauccccgcccgcuucagcggcuccgggagcggcaccgacuucacccucaccaucuccagccuggagccggaggacuucgccguguacuacugccagcagcgguccagcuggccgcccgucuacacguucggccaggggaccaagcuggagaucaagcgcaccguggccgcccccuccguguucaucuucccgcccagcgacgagcagcucaaguccggcaccgccagcgucgugugccugcugaacaacuucuacccccgggaggcgaaggugcaguggaaggucgacaacgcccuccaguccgggaacagccaggagagcgugacggagcaggacuccaaggacagcaccuacucccugagcuccacccugacccucagcaaggccgacuacgagaagcacaagguguacgccugcgaggucacgcaccagggccuguccagccccgugaccaaguccuucaaccgcggggagugc

SEQ ID NO: 7840 - RNA, 1332 nt, Artificial Sequence
  derived and/or modified sequence opt1 from Demcizumab_HeavyChain1
caggugcagcugguccagagcggcgccgaggugaagaagcccggggccuccgugaagaucagcugcaaggcguccggcuacagcuucaccgccuacuacauccacugggucaagcaggccccggggcagggccucgaguggaucggguacaucuccagcuacaacggcgccaccaacuacaaccagaaguucaagggccgcgugacguucaccaccgacaccuccacgagcaccgccuacauggagcugcggucccugcgcagcgacgacaccgcgguguacuacugcgcccgggacuacgacuacgacgucgggauggacuacuggggccaggggacccucgugacgguguccagcgccuccaccaagggccccagcgucuucccccuggcccccugcucccgcagcaccuccgagagcaccgcggcccuggggugccucgugaaggacuacuucccggagcccgugacggucuccuggaacagcggcgcccugaccagcggcgugcacaccuuccccgccgugcugcaguccagcgggcucuacucccugagcuccgucgugaccgugcccagcuccaacuucggcacgcagaccuacacgugcaacgucgaccacaagccgagcaacaccaagguggacaagaccguggagcggaagugcugcgucgagugcccgcccugccccgccccgcccguggcggggcccuccguguuccuguucccgcccaagcccaaggacacccucaugaucagccgcacccccgaggugaccugcgucgucguggacgugucccacgaggaccccgagguccaguucaacugguacguggacggcguggagguccacaacgccaagacgaagccgcgggaggagcaguucaacagcaccuuccgcgugguguccguccugaccguggugcaccaggacuggcugaacggcaaggaguacaagugcaaggucagcaacaaggggcuccccgcccccaucgagaagaccaucuccaagacgaagggccagccccgggagccccagguguacacccugccgcccagccgcgaggagaugaccaagaaccaggugucccugaccugccucgucaagggguucuaccccagcgacaucgccguggagugggaguccaacggccagcccgagaacaacuacaagacgaccccgcccaugcuggacagcgacgggagcuucuuccuguacuccaagcucaccguggacaagagccgguggcagcagggcaacgucuucuccugcagcgugaugcacgaggcccugcacaaccacuacacccagaagucccugagccucucccccggc

SEQ ID NO: 7841 - RNA, 654 nt, Artificial Sequence
  derived and/or modified sequence opt1 from Demcizumab_LightChain1
gacaucgugaugacccagagccccgacucccuggccgucagccucggcgagcgcgccaccaucuccugccgggcgagcgaguccguggacaacuacgggaucagcuucaugaagugguuccagcagaagccgggccagccgcccaagcugcugaucuacgccgccuccaaccaggggagcggcgugcccgaccgcuucuccgggagcggcuccggcacggacuucacccucaccaucagcucccugcaggccgaggacgucgccguguacuacugccagcagagcaaggaggugcccuggaccuucgggggcgggacgaaggucgagaucaagcggaccguggcggcccccuccguguucaucuucccgcccagcgacgagcagcugaaguccggcaccgccagcgucgugugccuccugaacaacuucuacccccgcgaggccaaggugcaguggaaggucgacaacgcgcugcaguccgggaacagccaggagagcgugaccgagcaggacuccaaggacagcacguacucccucagcuccacccugacccugagcaaggccgacuacgagaagcacaagguguacgccugcgaggucacccaccagggccucuccagccccgugacgaaguccuucaaccggggcgagugc

SEQ ID NO: 7842 - RNA, 1350 nt, Artificial Sequence
  derived and/or modified sequence opt1 from Denintuzumab_mafodotin_HeavyChain1
caggugcagcugcaggagagcggccccgggcucgucaagccgucccagacccugagccugaccugcacgguguccggcgggagcaucuccaccagcggcaugggggugggcuggauccgccagcaccccggcaaggggcucgaguggaucggccacaucuggugggacgacgacaagcgguacaaccccgcccugaagucccgcgucaccaucagcguggacaccuccaagaaccaguucagccugaagcucuccagcgugacggccgcggacaccgccgucuacuacugcgcccggauggagcugugguccuacuacuucgacuacugggggcagggcacccuggugaccgugagcuccgccagcacgaaggggcccuccgucuucccgcucgcccccagcuccaagagcaccagcggcggcaccgcggcccuggggugccuggugaaggacuacuuccccgagcccgugaccgucuccuggaacagcggcgcccucacguccggggugcacaccuucccggccgugcugcagagcuccggccuguacagccucuccagcgucgugaccgugcccuccagcucccugggcacccagacguacaucugcaacgucaaccacaagcccagcaacaccaagguggacaagaagguggagcccaaguccugcgacaagacccacacgugcccgcccugccccgcgcccgagcugcucgggggcccgagcgucuuccuguucccgcccaagcccaaggacacccugaugaucucccgcacccccgaggugaccugcguggucguggacgucagccacgaggaccccgaggugaaguucaacugguacguggacggggucgaggugcacaacgccaagaccaagccccgggaggagcaguacaacuccacguaccgcguggucagcgugcucaccgugcugcaccaggacuggcugaacggcaaggaguacaagugcaaggucuccaacaaggcccuccccgccccgaucgagaagaccaucagcaaggccaaggggcagccccgggagccccagguguacacccugcccccgagccgcgacgagcugacgaagaaccaggugucccugaccugccucgucaagggcuucuaccccagcgacaucgcgguggagugggaguccaacggccagcccgagaacaacuacaagaccaccccgcccgugcuggacagcgacggguccuucuuccucuacagcaagcugacggucgacaagucccgguggcagcagggcaacguguucagcugcuccgugaugcacgaggcccugcacaaccacuacacccagaagucccucagccugagccccgggaag

SEQ ID NO: 7843 - RNA, 639 nt, Artificial Sequence
  derived and/or modified sequence opt1 from Denintuzumab_mafodotin_LightChain1
gagaucgugcugacccagagccccgccacccucucccugagcccgggcgagcgggccacgcuguccugcagcgcguccagcuccgucagcuacaugcacugguaccagcagaagcccgggcaggcgccccggcuccugaucuacgacaccuccaagcuggccagcggcauccccgcccgcuucuccgggagcggcuccgggaccgacuucacccucacgaucagcucccuggagccggaggacguggccguguacuacugcuuccagggcagcgucuaccccuucaccuucggccaggggaccaagcuggagaucaagcggaccguggccgcccccuccguguucaucuucccgcccagcgacgagcagcucaaguccggcacggccagcgucgugugccugcugaacaacuucuacccccgcgaggccaaggugcaguggaaggucgacaacgcgcuccagagcgggaacucccaggagagcgugaccgagcaggacuccaaggacagcaccuacucccugagcuccacccugacgcucagcaaggccgacuacgagaagcacaagguguacgccugcgaggucacccaccagggccuguccagccccgugaccaaguccuucaaccgcggggagugc

SEQ ID NO: 7844 - RNA, 1356 nt, Artificial Sequence
  derived and/or modified sequence opt1 from Denosumab_HeavyChain
gaggugcagcugcucgagagcggcgggggccugguccagcccgggggcucccugcgccucagcugcgccgccuccggguucaccuucagcuccuacgcgaugagcugggugcggcaggccccgggcaagggccuggaguggguguccgggaucaccggcagcgggggcuccacguacuacgccgacagcgucaaggggcgcuucaccaucucccgggacaacagcaagaacacccuguaccuccagaugaacucccugcgcgccgaggacaccgccguguacuacugcgcgaaggaccccggcacgaccgugaucaugagcugguucgaccccuggggccaggggacccuggucaccguguccagcgccuccacgaagggccccagcguguucccgcucgcccccuccagcaagagcaccuccgggggcaccgccgcgcugggcugccuggucaaggacuacuuccccgagcccgugaccgugagcuggaacuccggggcccucacgagcggcguccacaccuucccggccgugcugcaguccagcgggcuguacucccucagcuccguggucaccgugcccagcuccagccugggcacccagacguacaucugcaacgugaaccacaagcccuccaacaccaaggucgacaagaagguggagcccaagagcugcgacaagacccacacgugcccgcccugccccgcccccgagcugcucgggggcccguccguguuccuguucccgcccaagcccaaggacacccugaugaucagccggacccccgaggugaccugcgucguggucgacgugucccacgaggaccccgaggucaaguucaacugguacguggacggcguggagguccacaacgccaagaccaagccccgcgaggagcaguacaacagcacguaccgggugguguccguccucaccgugcugcaccaggacuggcugaacgggaaggaguacaagugcaaggugagcaacaaggcgcuccccgccccgaucgagaagaccaucagcaaggccaagggccagccccgcgagccccaggucuacacccugcccccgucccgggacgagcugacgaagaaccaggugagccugaccugccucgugaagggguucuaccccuccgacaucgccgucgagugggagagcaacggccagcccgagaacaacuacaagaccaccccgcccgugcuggacuccgacgggagcuucuuccucuacuccaagcugacgguggacaagagccgcuggcagcagggcaacgucuucuccugcagcgugaugcacgaggcccugcacaaccacuacacccagaagucccucagccugucccccggcaag

SEQ ID NO: 7845 - RNA, 645 nt, Artificial Sequence
  derived and/or modified sequence opt1 from Denosumab_LightChain
gagaucgugcugacccagagccccggcacccucucccugagcccgggggagcgggccacgcuguccugccgggccagccaguccguccgcggccgguaccucgcgugguaccagcagaagcccgggcaggcgccccgccugcugaucuacggcgccagcucccgggccaccgggauccccgaccgcuucagcggcuccggcagcgggaccgacuucacccucacgaucucccggcuggagccggaggacuucgccguguucuacugccagcaguacggcagcagcccccgcaccuucgggcagggcaccaagguggagaucaagcggaccgucgccgcccccagcguguucaucuucccgcccuccgacgagcagcugaaguccgggacggccuccguggucugccuccugaacaacuucuacccccgcgaggccaaggugcaguggaagguggacaacgcgcugcagagcggcaacucccaggagagcgucaccgagcaggacagcaaggacuccaccuacagccucuccagcacccugacgcuguccaaggccgacuacgagaagcacaagguguacgccugcgaggugacccaccagggccucagcucccccgucaccaagagcuucaaccgcggggagugc

SEQ ID NO: 7846 - RNA, 1338 nt, Artificial Sequence
  derived and/or modified sequence opt1 from Depatuxizumab_HeavyChain1
caggugcagcugcaggagagcggccccgggcucgucaagccgucccagacccugagccugaccugcacgguguccggcuacagcaucuccagcgacuucgccuggaacuggauccgccagccgcccgggaagggccucgaguggaugggguacaucuccuacagcggcaacacccgguaccagcccucccucaagagccgcaucaccaucucccgggacaccagcaagaaccaguucuuccugaagcugaacuccgugacggccgcggacaccgccaccuacuacugcgucaccgccggccgcggguucccguacuggggccaggggacgcuggugaccgugagcuccgccagcaccaagggccccuccgucuucccccuggcccccagcuccaagagcaccagcgggggcacggcggcccucggcugccuggugaaggacuacuucccggagcccgugaccgucuccuggaacagcggggcccugaccuccggcgugcacaccuuccccgccgugcuccagagcuccgggcuguacagccuguccagcgucgugacggugcccuccagcucccucggcacccagaccuacaucugcaacgucaaccacaagccgagcaacaccaagguggacaagaagguggagcccaaguccugcgacaagacgcacacgugcccgcccugccccgcgcccgagcugcugggcgggcccagcgucuuccucuucccgcccaagcccaaggacacccugaugaucucccggacccccgaggugaccugcguggucguggacgugagccacgaggaccccgaggucaaguucaacugguacguggacggcgucgaggugcacaacgccaagaccaagccgcgcgaggagcaguacaacuccaccuaccggguggucagcgugcugaccgugcuccaccaggacuggcugaacgggaaggaguacaagugcaaggucuccaacaaggcccugcccgcccccaucgagaagacgaucagcaaggccaagggccagccccgcgagccccagguguacacccucccgcccagccgggacgagcugaccaagaaccaggugucccugaccugccucgucaagggguucuaccccagcgacaucgcgguggagugggaguccaacggccagcccgagaacaacuacaagacgaccccgcccgugcuggacagcgacggcuccuucuuccuguacagcaagcucaccgucgacaagucccgcuggcagcaggggaacguguucagcugcuccgugaugcacgaggcccugcacaaccacuacacccagaagucccugagccucagccccggcaag

SEQ ID NO: 7847 - RNA, 642 nt, Artificial Sequence
  derived and/or modified sequence opt1 from Depatuxizumab_LightChain1
gacauccagaugacccagagccccuccagcauguccgugagcgucggcgaccgcgugaccaucacgugccacuccagccaggacaucaacuccaacaucggguggcugcagcagaagccgggcaagagcuucaaggggcucaucuaccacggcaccaaccuggacgacggggugcccucccgguucagcggcuccggcagcgggaccgacuacacccugacgaucuccagccuccagcccgaggacuucgccaccuacuacugcguccaguacgcccaguuccccuggaccuucggcgggggcaccaagcuggagaucaagcgcacgguggcggccccguccguguucaucuucccgcccagcgacgagcagcugaaguccgggaccgccagcgucgugugccuccugaacaacuucuacccccgggaggccaaggugcaguggaaggucgacaacgcccugcaguccggcaacagccaggagagcgugaccgagcaggacuccaaggacagcaccuacucccucagcuccacgcugacccugagcaaggcggacuacgagaagcacaagguguacgccugcgaggucacccaccagggccucuccagccccgugaccaaguccuucaaccgcggggagugc

SEQ ID NO: 7848 - RNA, 1338 nt, Artificial Sequence; identical to SEQ ID NO: 7846
  derived and/or modified sequence opt1 from Depatuxizumab_mafodotin_HeavyChain1

SEQ ID NO: 7849 - RNA, 642 nt, Artificial Sequence; identical to SEQ ID NO: 7847
  derived and/or modified sequence opt1 from Depatuxizumab_mafodotin_LightChain1

SEQ ID NO: 7850 - RNA, 1329 nt, Artificial Sequence
  derived and/or modified sequence opt1 from Dinutuximab_beta_HeavyChain1
gaggugcagcugcuccagagcggccccgagcuggagaagccgggggccuccgucaugaucagcugcaaggccuccggcagcuccuucaccggguacaacaugaacugggugcgccagaacaucggcaagagccuggaguggaucggggcgaucgaccccuacuacggcggcaccuccuacaaccagaaguucaaggggcgggccacccucaccguggacaagagcuccagcaccgccuacaugcaccugaagucccugaccagcgaggacuccgccgucuacuacugcgugagcggcauggaguacugggggcagggcacguccgugaccgucagcuccgccagcaccaaggggcccuccguguucccccucgcgccgagcagcaaguccaccagcggcggcacggccgcccuggggugccuggugaaggacuacuuccccgagcccgucaccguguccuggaacagcggcgcccucaccuccggggugcacaccuuccccgcgguccugcagagcuccggccuguacagccucuccagcguggugacggucccguccagcucccugggcacccagaccuacaucugcaacgugaaccacaagcccagcaacaccaagguggacaagcgcgucgagcccaaguccugcgacaagacgcacacgugcccgcccugccccgcccccgagcugcucgggggccccagcguguuccuguucccgcccaagcccaaggacacccugaugaucucccggacccccgaggugaccugcgucgugguggacgucagccacgaggacccggaggugaaguucaacugguacgucgacgggguggaggugcacaacgccaagaccaagccccgcgaggagcaguacaacuccaccuaccgggucgugagcgugcucaccguccugcaccaggacuggcugaacggcaaggaguacaagugcaaggugagcaacaaggcccuccccgcccccaucgagaagacgaucuccaaggcgaaggggcagccgcgcgagccccagguguacacccugccgcccagccgggaggagaugaccaagaaccaggucucccugaccugccucgugaagggcuucuaccccagcgacaucgccguggagugggaguccaacggccagcccgagaacaacuacaagacgacgcccccgguccuggacagcgacggguccuucuuccuguacagcaagcucaccguggacaagucccgcuggcagcagggcaacguguucagcugcuccgucaugcacgaggcccugcacaaccacuacacccagaagucccugagccucagccccgggaag

SEQ ID NO: 7851 - RNA, 660 nt, Artificial Sequence
  derived and/or modified sequence opt1 from Dinutuximab_beta_LightChain1
gagaucgugaugacccagagccccgccacccuguccgucagcccgggcgagcgcgccacgcucuccugccggagcucccagagccuggugcaccgcaacgggaacaccuaccugcacugguaccuccagaagcccggccagucccccaagcugcugauccacaaggugagcaaccgguucuccgggguccccgaccgcuucagcggcuccgggagcggcaccgacuucacccucaagaucucccggguggaggcggaggaccugggcguguacuucugcagccaguccacgcacgucccgccccugaccuucggggccggcaccaagcucgagcugaagcgcaccguggccgcccccagcguguucaucuucccgcccuccgacgagcagcucaagagcgggacggccuccgucgugugccugcugaacaacuucuacccccgggaggcgaaggugcaguggaaggucgacaacgcccugcagagcggcaacagccaggaguccgugaccgagcaggacagcaaggacuccaccuacagccucuccagcacccugacgcuguccaaggccgacuacgagaagcacaagguguacgccugcgaggucacccaccaggggcucagcucccccgugaccaagagcuucaaccgcggcgagugc

SEQ ID NO: 7852 - RNA, 1329 nt, Artificial Sequence; identical to SEQ ID NO: 7850
  derived and/or modified sequence opt1 from Dinutuximab_HeavyChain1

SEQ ID NO: 7853 - RNA, 660 nt, Artificial Sequence; identical to SEQ ID NO: 7851
  derived and/or modified sequence opt1 from Dinutuximab_LightChain1

SEQ ID NO: 7854 - RNA, 660 nt, Artificial Sequence; identical to SEQ ID NO: 7851
  derived and/or modified sequence opt1 from Dinutuximab_LightChain

SEQ ID NO: 7855 - RNA, 1350 nt, Artificial Sequence
  derived and/or modified sequence opt1 from Diridavumab_HeavyChain1
gaggugcagcuggucgagagcggcgccgaggugaagaagcccggguccagcgugaaggucuccugcaaggccagcggcgggccguuccgcuccuacgcgaucagcugggugcggcaggcccccggccaggggcccgaguggaugggcggcaucauccccaucuucgggaccaccaaguacgccccgaaguuccagggccgcgugacgaucaccgccgacgacuucgccgggaccgucuacauggagcucuccagccugcgguccgaggacaccgcgauguacuacugcgccaagcacaugggcuaccaggugcgcgagacgauggacgugugggggaagggcaccaccgucaccgugagcuccgccagcacgaagggccccuccguguucccccuggcccccagcuccaagagcaccuccgggggcaccgcggcccucgggugccuggucaaggacuacuucccggagcccgugaccgugagcuggaacuccggcgcccugacgagcggcguccacaccuuccccgccgugcuccagagcuccgggcuguacagccuguccagcguggucaccgugcccuccagcucccucggcacccagacguacaucugcaacgugaaccacaagccgagcaacaccaaggucgacaagcggguggagcccaaguccugcgacaagacccacacgugcccgcccugccccgcccccgagcugcucgggggccccagcguguuccuguucccgcccaagcccaaggacacccugaugaucucccgcacccccgaggugaccugcgucgucguggacgugagccacgaggaccccgaggucaaguucaacugguacguggacgggguggagguccacaacgcgaagaccaagccgcgggaggagcaguacaacuccacguaccgcguggugagcguccugaccgugcuccaccaggacuggcugaacggcaaggaguacaagugcaagguguccaacaaggcccugcccgcccccaucgagaagaccaucagcaaggccaagggccagccccgggagccgcaggucuacacccucccgcccucccgcgaggagaugacgaagaaccaggugagccugaccugccuggugaagggguucuaccccuccgacaucgccgucgagugggagagcaacggccagcccgagaacaacuacaagaccaccccgcccgugcucgacagcgacggguccuucuuccuguacagcaagcugacgguggacaagucccgguggcagcagggcaacgucuucagcugcuccgugaugcacgaggcgcuccacaaccacuacacccagaagucccugagccugagccccggg

SEQ ID NO: 7856 - RNA, 651 nt, Artificial Sequence
  derived and/or modified sequence opt1 from Diridavumab_LightChain1
cagagcgugcugacccagcccccguccgucagcgccgcccccggccagaaggugaccaucuccugcagcggguccagcuccaacaucggcaacgacuacgugagcugguaccagcagcuccccgggacggcgcccaagcugcugaucuacgacaacaacaagcgcccguccggcauccccgaccgguucagcggguccaagagcggcaccuccgccacccucggcaucaccgggcugcagacgggcgacgaggccaacuacuacugcgccaccugggaccgccggcccaccgccuacgucguguucgggggcgggaccaagcugacggugcucggccagcccaaggcggccccgagcgucacccuguucccgcccuccagcgaggagcugcaggccaacaaggccacccucgugugccugaucuccgacuucuaccccggcgcggugaccgucgccuggaaggccgacagcucccccgugaaggccgggguggagacgaccacccccagcaagcagagcaacaacaaguacgccgcguccagcuaccugucccucacccccgagcaguggaagucccaccgcagcuacagcugccaggucacgcacgagggcuccaccguggagaagaccguggcccccaccgagugcagc

SEQ ID NO: 7857 - RNA, 1338 nt, Artificial Sequence
  derived and/or modified sequence opt1 from Domagrozumab_HeavyChain1
gaggugcagcugcucgagagcggcgggggccugguccagcccgggggcucccugcgccucagcugcgccgccuccggguucaccuucagcuccuacgcgaugagcugggugcggcaggccccgggcaagggccuggaguggguguccaccaucagcuccgggggcagcuacaccuccuaccccgacagcgucaaggggcgcuucaccaucucccgggacaacagcaagaacacccuguaccuccagaugaacucccugcgcgccgaggacaccgccguguacuacugcgccaagcaggacuacgcgaugaacuacuggggccaggggacgcuggugaccgucagcuccgccagcaccaagggccccuccguguucccccucgccccgagcagcaaguccaccagcggcgggacggccgcgcugggcugccuggugaaggacuacuuccccgagcccgucaccguguccuggaacagcggggcccucaccuccggcgugcacaccuuccccgccguccugcagagcuccggccuguacagccucuccagcguggugacggucccguccagcucccuggggacccagaccuacaucugcaacgugaaccacaagcccagcaacaccaagguggacaagaaggucgagcccaaguccugcgacaagacgcacacgugcccgcccugccccgcccccgaggccgcgggcgcccccagcguguuccuguucccgcccaagcccaaggacacccucaugaucucccggacccccgaggugaccugcgucgugguggacgucagccacgaggacccggaggugaaguucaacugguacgucgacgggguggaggugcacaacgccaagaccaagccccgcgaggagcaguacaacuccaccuaccgggucgugagcgugcugaccguccugcaccaggacuggcucaacggcaaggaguacaagugcaaggugagcaacaaggcccugcccgcccccaucgagaagacgaucuccaaggcgaaggggcagccgcgcgagccccagguguacacccugccgcccagccgggaggagaugaccaagaaccaggucucccugaccugccucgugaagggcuucuaccccagcgacaucgccguggagugggaguccaacggccagcccgagaacaacuacaagacgacgcccccgguccuggacagcgacggguccuucuuccucuacagcaagcugaccguggacaagucccgcuggcagcagggcaacguguucagcugcuccgucaugcacgaggcccugcacaaccacuacacccagaagucccucagccugagccccgggaag

SEQ ID NO: 7858 - RNA, 1335 nt, Artificial Sequence
  derived and/or modified sequence opt1 from Domagrozumab_HeavyChain
gaggugcagcugcucgagagcggcgggggccugguccagcccgggggcucccugcgccucagcugcgccgccuccggguucaccuucagcuccuacgcgaugagcugggugcggcaggccccgggcaagggccuggaguggguguccaccaucagcuccgggggcagcuacaccuccuaccccgacagcgucaaggggcgcuucaccaucucccgggacaacagcaagaacacccuguaccuccagaugaacucccugcgcgccgaggacaccgccguguacuacugcgccaagcaggacuacgcgaugaacuacuggggccaggggacgcuggugaccgucagcuccgccagcaccaagggccccuccguguucccccucgccccgagcagcaaguccaccagcggcgggacggccgcgcugggcugccuggugaaggacuacuuccccgagcccgucaccguguccuggaacagcggggcccucaccuccggcgugcacaccuuccccgccguccugcagagcuccggccuguacagccucuccagcguggugacggucccguccagcucccuggggacccagaccuacaucugcaacgugaaccacaagcccagcaacaccaagguggacaagaaggucgagcccaaguccugcgacaagacgcacacgugcccgcccugccccgcccccgaggccgcgggcgcccccagcguguuccuguucccgcccaagcccaaggacacccucaugaucucccggacccccgaggugaccugcgucgugguggacgucagccacgaggacccggaggugaaguucaacugguacgucgacgggguggaggugcacaacgccaagaccaagccccgcgaggagcaguacaacuccaccuaccgggucgugagcgugcugaccguccugcaccaggacuggcucaacggcaaggaguacaagugcaaggugagcaacaaggcccugcccgcccccaucgagaagacgaucuccaaggcgaaggggcagccgcgcgagccccagguguacacccugccgcccagccgggaggagaugaccaagaaccaggucucccugaccugccucgugaagggcuucuaccccagcgacaucgccguggagugggaguccaacggccagcccgagaacaacuacaagacgacgcccccgguccuggacagcgacggguccuucuuccucuacagcaagcugaccguggacaagucccgcuggcagcagggcaacguguucagcugcuccgucaugcacgaggcccugcacaaccacuacacccagaagucccucagccugagccccggg

SEQ ID NO: 7859 - RNA, 642 nt, Artificial Sequence
  derived and/or modified sequence opt1 from Domagrozumab_LightChain1
gacauccagaugacccagagccccuccagccuguccgccagcgugggcgaccgggucaccaucacgugcaaggccucccaggacgugagcaccgcgguggccugguaccagcagaagccggggaaggcccccaagcuccugaucuacuccgccagcuaccgguacaccggcguccccucccgcuucagcggguccggcagcgggaccgacuucacgcugaccaucuccagccuccagcccgaggacuucgccaccuacuacugccagcagcacuacuccaccccguggacguucggcggcgggaccaagguggagaucaagcggaccguggcggcccccagcgucuucaucuucccgcccuccgacgagcagcucaagagcggcaccgccuccguggugugccugcugaacaacuucuacccccgcgaggccaagguccaguggaagguggacaacgcgcugcagagcgggaacagccaggaguccgugacggagcaggacagcaaggacuccaccuacagccuguccagcacccucacccuguccaaggccgacuacgagaagcacaaggucuacgccugcgaggugacgcaccagggccugagcucccccgugaccaagagcuucaaccgcggggagugc

SEQ ID NO: 7860 - RNA, 1335 nt, Artificial Sequence
  derived and/or modified sequence opt1 from Drozituab_HeavyChain1
gaggugcagcugguccagagcggcgggggcguggagcgccccgggggcucccuccggcugagcugcgccgccuccggguucaccuucgacgacuacgcgagcugggugcgccaggccccgggcaagggccuggagugggucuccgggaucaacuggcagggcgggagcaccggcuacgccgacuccgugaaggggcgggugacgaucagccgcgacaacgccaagaacucccucuaccugcagaacagccugcgggccgaggacaccgcggucuacuacugcgccaagauccucggcgccggccgcgggugguacuucgacuacuggggcaaggggaccaccgugacgguguccagcgccuccaccaagggccccagcgucuucccccuggcgcccuccagcaaguccaccagcggcgggaccgccgcccugggcugccucgugaaggacuacuucccggagcccgugacggucuccuggaacagcggggcccugaccagcggcgugcacaccuuccccgccgugcugcaguccagcgggcucuacucccugagcuccgucgugaccgugcccagcuccagccugggcacgcagaccuacaucugcaacgucaaccacaagccguccaacaccaagguggacaagaagguggagcccaagagcugcgacaagacccacacgugcccgcccugcccggcgcccgagcuccugggcgggcccuccgucuuccuguucccgcccaagcccaaggacacccucaucagccggacccccgaggugaccugcguggucguggacgucucccacgaggaccccgaggugaaguucaacugguacguggacggcgucgaggugcacaacgccaagacgaagccgcgcgaggagcaguacaacagcaccuaccggguggucuccgugcugaccgugcugcaccaggacuggcucaacgggaaggaguacaagugcaaggucagcaacaaggcccugcccgcccccaucgagaagaccaucuccaaggccaagggccagccccgcgagccccagguguacacgcugccgcccagccgggaggagaccaagaaccaggugucccugaccugccucgucaagggguucuaccccagcgacaucgcgguggagugggagagcaacggccagcccgagaacaacuacaagaccacgccgcccgugcuggacuccgacggcagcuucuuccucuacuccaagcugaccgucgacaagagccgcuggcagcaggggaacguguucuccugcagcgugcacgaggcccugcacaaccacuacacccagaagucccucagccugucccccggc

SEQ ID NO: 7861 - RNA, 639 nt, Artificial Sequence
  derived and/or modified sequence opt1 from Drozituab_LightChain1
agcgagcugacccaggaccccgccguguccgucgcccucggccagaccgugcgcaucacgugcagcggggacucccugcggagcuacuacgcguccugguaccagcagaagccgggccaggcccccgugcuggucaucuacggggccaacaaccgccccagcggcauccccgaccgguucuccgggagcuccagcggcaacaccgccucccucaccaucaccggcgcccaggcggaggacgaggccgacuacuacugcaacagcgccgacuccagcgggaaccacgugguguucggcgggggcacgaagcugaccguccuggggcagccgaaggccgcgcccuccgugacccucuucccgcccagcuccgaggagcugcaggccaacaaggccacccuggugugccucaucagcgacuucuaccccggcgccgucacgguggccuggaaggcggacuccagccccgugaaggccggcgucgagaccaccacccccagcaagcaguccaacaacaaguacgccgccagcuccuaccugagccugacgcccgagcaguggaagucccacaagagcuacuccugccaggugacccacgaggggagcaccguggagaagaccgucgccccgacggagugcucc

SEQ ID NO: 7862 - RNA, 1353 nt, Artificial Sequence
  derived and/or modified sequence opt1 from Drozitumab_HeavyChain1
gaggugcagcugguccagagcggcgggggcguggagcgccccgggggcucccuccggcugagcugcgccgccuccggguucaccuucgacgacuacgcgaugagcugggugcgccaggccccgggcaagggccuggagugggucuccgggaucaacuggcagggcgggagcaccggcuacgccgacuccgugaaggggcgggugacgaucagccgcgacaacgccaagaacucccucuaccugcagaugaacagccugcgggccgaggacaccgcggucuacuacugcgccaagauccucggcgccggccgcgggugguacuucgacuacuggggcaaggggaccaccgugacgguguccagcgccuccaccaagggccccagcgucuucccccuggcgcccuccagcaaguccaccagcggcgggaccgccgcccugggcugccucgugaaggacuacuucccggagcccgugacggucuccuggaacagcggggcccugaccagcggcgugcacaccuuccccgccgugcugcaguccagcgggcucuacucccugagcuccgucgugaccgugcccagcuccagccugggcacgcagaccuacaucugcaacgucaaccacaagccguccaacaccaagguggacaagaagguggagcccaagagcugcgacaagacccacacgugcccgcccugcccggcgcccgagcuccugggcgggcccuccgucuuccuguucccgcccaagcccaaggacacccucaugaucagccggacccccgaggugaccugcguggucguggacgucucccacgaggaccccgaggugaaguucaacugguacguggacggcgucgaggugcacaacgccaagacgaagccgcgcgaggagcaguacaacagcaccuaccggguggucuccgugcugaccgugcugcaccaggacuggcucaacgggaaggaguacaagugcaaggucagcaacaaggcccugcccgcccccaucgagaagaccaucuccaaggccaagggccagccccgcgagccccagguguacacgcugccgcccagccgggaggagaugaccaagaaccaggugucccugaccugccucgucaagggguucuaccccagcgacaucgcgguggagugggagagcaacggccagcccgagaacaacuacaagaccacgccgcccgugcuggacuccgacggcagcuucuuccucuacuccaagcugaccgucgacaagagccgcuggcagcaggggaacguguucuccugcagcgugaugcacgaggcccugcacaaccacuacacccagaagucccucagccugucccccggcaag

SEQ ID NO: 7863 - RNA, 639 nt, Artificial Sequence; identical to SEQ ID NO: 7861
  derived and/or modified sequence opt1 from Drozitumab_LightChain1

SEQ ID NO: 7864 - RNA, 1353 nt, Artificial Sequence
  derived and/or modified sequence opt1 from Duligotumab_HeavyChain1
gaggugcagcuggucgagagcggcgggggccucgugcagcccgggggcucccugcgccugagcugcgccgccuccggguucacccucagcggcgacuggauccacugggugcggcaggcgccgggcaaggggcuggagugggucggcgagaucuccgccgccgggggcuacaccgacuacgccgacagcgugaaggggcgcuucacgaucuccgccgacaccagcaagaacaccgcguaccugcagaugaacucccuccgggccgaggacaccgccguguacuacugcgcccgcgagagccgggucuccuucgaggcggccauggacuacuggggccagggcacgcuggugaccgugagcuccgccagcaccaaggggcccuccgucuucccccuggcccccagcuccaagagcaccuccggcgggacggccgcgcucggcugccuggugaaggacuacuucccggagcccgugaccgucagcuggaacagcggcgcccugaccuccggggugcacaccuuccccgccgugcuccagagcuccggccuguacagccuguccagcgucgugacggugcccuccagcucccucgggacccagaccuacaucugcaacgucaaccacaagccgagcaacaccaagguggacaagaagguggagcccaaguccugcgacaagacgcacacgugcccgcccugcccggcccccgagcugcugggcgggcccagcgucuuccucuucccgcccaagcccaaggacacccugaugaucucccgcacccccgaggugaccugcguggucguggacgucagccacgaggaccccgaggugaaguucaacugguacguggacggcgucgaggugcacaacgccaagaccaagccgcgggaggagcaguacaacuccaccuaccgcguggucagcgugcugaccgugcuccaccaggacuggcugaacggcaaggaguacaagugcaaggucuccaacaaggcgcugcccgcccccaucgagaagacgaucagcaaggccaaggggcagccccgggagccccagguguacacccucccgcccucccgcgaggagaugaccaagaaccaggugagccugaccugccuggucaagggcuucuaccccagcgacaucgccguggagugggaguccaacgggcagcccgagaacaacuacaagacgaccccgcccgugcucgacagcgacggcuccuucuuccuguacagcaagcugaccgucgacaagucccgguggcagcaggggaacguguucagcugcuccgugaugcacgaggcccuccacaaccacuacacccagaagucccugagccugagccccggcaag

SEQ ID NO: 7865 - RNA, 642 nt, Artificial Sequence
  derived and/or modified sequence opt1 from Duligotumab_LightChain1
gacauccagaugacccagagccccuccagccuguccgccagcgugggcgaccgcgucaccaucacgugccgggccucccagaacaucgcgaccgacguggccugguaccagcagaagccggggaaggcccccaagcuccugaucuacagcgccuccuuccuguacagcggcgugcccucccgcuucagcggguccggcagcgggaccgacuucacccucacgaucuccagccugcagcccgaggacuucgccaccuacuacugccagcaguccgagccggagcccuacaccuucggccagggcaccaaggucgagaucaagcggacgguggcggcccccagcguguucaucuucccgcccuccgacgagcagcucaagagcgggaccgccuccgucgugugccugcugaacaacuucuacccccgcgaggccaaggugcaguggaaggucgacaacgcgcugcagagcggcaacagccaggaguccgugaccgagcaggacagcaaggacuccaccuacagccucuccagcacgcugacccuguccaaggccgacuacgagaagcacaagguguacgccugcgaggucacccaccaggggcucagcucccccgugaccaagagcuucaaccggggcgagugc

SEQ ID NO: 7866 - RNA, 1353 nt, Artificial Sequence; identical to SEQ ID NO: 7864
  derived and/or modified sequence opt1 from Duligotuzumab_HeavyChain1

SEQ ID NO: 7867 - RNA, 642 nt, Artificial Sequence; identical to SEQ ID NO: 7865
  derived and/or modified sequence opt1 from Duligotuzumab_LightChain1

SEQ ID NO: 7868 - RNA, 1353 nt, Artificial Sequence
  derived and/or modified sequence opt1 from Dupilumab_HeavyChain1
gaggugcagcuggucgagagcggcgggggccucgagcagcccgggggcucccugcgccugagcugcgccggguccggcuucaccuuccgggacuacgccaugaccugggugcgccaggcgcccggcaaggggcucgagugggugagcuccaucagcggcuccgggggcaacacguacuacgccgacagcgucaaggggcgguucaccaucucccgcgacaacagcaagaacacccuguaccugcagaugaacucccuccgggccgaggacaccgccguguacuacugcgccaaggaccgccugagcaucacgauccggccccgcuacuacggccuggacguguggggccaggggaccaccgucaccguguccagcgcguccacgaagggccccagcguguucccccucgccccgugcucccggagcaccuccgagagcaccgccgcccuggggugccuggucaaggacuacuuccccgagcccgugaccgugagcuggaacuccggcgcgcucacgagcggcguccacaccuuccccgccgugcugcaguccagcgggcuguacucccucagcuccguggucaccgugccgagcuccagccugggcaccaagacguacacgugcaacguggaccacaagcccuccaacaccaaggucgacaagcgcguggagagcaaguacgggccgcccugcccgcccugccccgcccccgaguuccugggcgggccguccguguuccucuucccgcccaagcccaaggacacccugaugaucagccggacccccgaggugaccugcgucguggucgacgugucccaggaggaccccgagguccaguucaacugguacguggacggcguggagguccacaacgccaagaccaagccccgcgaggagcaguucaacagcaccuaccgggugguguccguccugacggugcuccaccaggacuggcugaacggcaaggaguacaagugcaaggugagcaacaaggggcugcccuccagcaucgagaagaccaucagcaaggccaagggccagccgcgcgagccccaggucuacacccucccgcccucccaggaggagaugaccaagaaccaggugagccugacgugccuggugaagggguucuaccccuccgacaucgcggucgagugggagagcaacggccagcccgagaacaacuacaagaccaccccgcccgugcucgacuccgacgggagcuucuuccuguacucccggcugaccguggacaagagccgcuggcaggagggcaacgucuucuccugcagcgugaugcacgaggcccuccacaaccacuacacgcagaagucccugagccugucccucggc

SEQ ID NO: 7869 - RNA, 657 nt, Artificial Sequence
  derived and/or modified sequence opt1 from Dupilumab_LightChain1
gacaucgugaugacgcagagcccccugucccucccggucacccccggcgagcccgccagcaucuccugccgcagcucccagagccugcuguacuccaucggguacaacuaccucgacugguaccugcagaaguccggccagagcccccagcugcucaucuaccuggggagcaaccgggccuccggcgugccggaccgcuucagcggguccggcagcggcacggacuucacccugaagaucucccggguggaggcggaggacgucggguucuacuacugcaugcaggcccuccagacccccuacaccuucggccaggggacgaagcuggagaucaagcgcaccguggccgcccccagcguguucaucuucccgcccuccgacgagcagcucaagagcggcaccgccuccgucgugugccugcugaacaacuucuacccccgggaggcgaaggugcaguggaaggucgacaacgcccugcagagcgggaacagccaggaguccgugaccgagcaggacagcaaggacuccacguacagccucuccagcacccugacccuguccaaggccgacuacgagaagcacaagguguacgccugcgaggucacccaccagggccucagcucccccgugaccaagagcuucaaccgcggcgagugc

SEQ ID NO: 7870 - RNA, 1353 nt, Artificial Sequence
  derived and/or modified sequence opt1 from Durvalumab_HeavyChain1
gaggugcagcuggucgagagcggcgggggccucgugcagcccgggggcucccugcgccugagcugcgccgccuccggguucaccuucagccgguacuggauguccugggugcgccaggcgccgggcaagggccucgagugggucgccaacaucaagcaggacgggagcgagaaguacuacguggacuccgugaagggccgguucaccaucagccgcgacaacgccaagaacucccuguaccugcagaugaacagccuccgggccgaggacacggccgucuacuacugcgcgcgcgagggcgggugguucggggagcuggccuucgacuacuggggccagggcacccuggugaccguguccagcgccuccaccaaggggcccagcgucuucccccucgcccccuccagcaaguccacgagcggcgggaccgcggcccugggcugccuggugaaggacuacuucccggagcccgugaccgucuccuggaacagcggcgcccucaccagcggggugcacacguuccccgccgugcugcaguccagcggccuguacucccucagcuccgucgugaccgugcccagcuccagccuggggacccagaccuacaucugcaacgucaaccacaagccguccaacacgaagguggacaagcggguggagcccaagagcugcgacaagacccacacgugcccgcccugccccgcccccgaguucgagggcgggcccuccgucuuccuguucccgcccaagcccaaggacacccucaugaucagccgcacccccgaggugaccugcguggucguggacgucucccacgaggaccccgaggugaaguucaacugguacguggacggcgucgaggugcacaacgcgaagaccaagccgcgggaggagcaguacaacagcaccuaccgcguggucuccgugcugacggugcugcaccaggacuggcucaacggcaaggaguacaagugcaaggucagcaacaaggcccugcccgccuccaucgagaagaccaucagcaaggccaaggggcagccccgggagccccagguguacacccugccgcccucccgcgaggagaugaccaagaaccaggugagccucacgugccuggucaagggcuucuaccccagcgacaucgccguggagugggaguccaacgggcagcccgagaacaacuacaagaccaccccgcccgugcuggacagcgacggcuccuucuuccucuacagcaagcugaccgucgacaagucccgguggcagcaggggaacguguucagcugcuccgugaugcacgaggcgcugcacaaccacuacacgcagaagucccucagccugagccccggcaag

SEQ ID NO: 7871 - RNA, 645 nt, Artificial Sequence
  derived and/or modified sequence opt1 from Durvalumab_LightChain1
gagaucgugcugacccagagccccggcacccucucccugagcccgggggagcgcgccacgcuguccugccgggccagccagcgcgucuccagcuccuaccucgcgugguaccagcagaagcccggccaggcgccccggcugcugaucuacgacgccagcucccgcgccaccgggauccccgaccgguucagcggcuccgggagcggcaccgacuucacccucacgaucucccgccuggagccggaggacuucgccguguacuacugccagcaguacggcagccugcccuggaccuucgggcagggcaccaagguggagaucaagcggaccgucgccgcccccuccguguucaucuucccgcccagcgacgagcagcucaaguccgggacggccagcguggucugccugcugaacaacuucuacccccgcgaggccaaggugcaguggaagguggacaacgcgcuccaguccggcaacagccaggagagcgucaccgagcaggacuccaaggacagcaccuacucccugagcuccacccugacgcucagcaaggccgacuacgagaagcacaagguguacgccugcgaggugacccaccaggggcuguccagccccgucaccaaguccuucaaccggggcgagugc

SEQ ID NO: 7872 - RNA, 1338 nt, Artificial Sequence
  derived and/or modified sequence opt1 from Dusigitumab_HeavyChain1
caggugcagcugguccagagcggcgccgaggugaagaagcccggggccuccgugaaggucagcugcaaggcguccggcuacaccuucaccagcuacgacaucaacugggugcgccaggccacggggcagggccucgaguggaugggguggaugaacccgaacuccggcaacaccggcuacgcccagaaguuccaggggcgggugaccaugacccgcaacacgagcaucuccaccgccuacauggagcugagcucccugcggagcgaggacaccgccgucuacuacugcgcgcgcgaccccuacuacuacuacuacggcauggacgugugggggcagggcaccacggugaccgucuccagcgccuccaccaaggggcccagcguguucccccucgccccgugcucccggagcaccuccgagagcacggccgcgcugggcugccuggugaaggacuacuuccccgagcccgucaccguguccuggaacagcggcgcccucaccagcggggugcacaccuuccccgccguccugcaguccagcggccuguacucccucagcuccguggugacggucccgagcuccaacuucgggacccagaccuacacgugcaacguggaccacaagcccagcaacaccaagguggacaagaccgucgagcgcaagugcugcguggagugcccgcccugccccgccccgcccguggccggccccuccgucuuccuguucccgcccaagcccaaggacacccugaugaucagccggacccccgaggugacgugcgucgugguggacgucucccacgaggaccccgaggugcaguucaacugguacguggacggcgucgaggugcacaacgcgaagaccaagccccgcgaggagcaguucaacagcaccuuccggguggucuccgugcucaccgugguccaccaggacuggcugaacgggaaggaguacaagugcaaggugagcaacaagggccugcccgcccccaucgagaagacgaucuccaagaccaaggggcagccgcgcgagccccagguguacacccucccgcccagccgggaggagaugaccaagaaccaggucucccugacgugccuggugaagggcuucuaccccagcgacaucgccguggagugggaguccaacgggcagcccgagaacaacuacaagaccacgcccccgaugcucgacagcgacggcagcuucuuccuguacuccaagcugaccgucgacaagagccgcuggcagcagggcaacguguucuccugcagcgugaugcacgaggcccuccacaaccacuacacccagaagucccugagccugucccccgggaag

SEQ ID NO: 7873 - RNA, 651 nt, Artificial Sequence
  derived and/or modified sequence opt1 from Dusigitumab_LightChain1
cagagcgugcugacccagcccccguccgucagcgccgcccccggccagaaggugaccaucuccugcagcggguccagcuccaacaucgagaacaaccacgugagcugguaccagcagcuccccggcacggcgcccaagcugcugaucuacgacaacaacaagcgcccguccgggauccccgaccgguucagcggcuccaagagcgggaccuccgccacccucggcaucaccggccugcagacgggggacgaggccgacuacuacugcgagaccugggacaccagccuguccgccggccgcgucuucgggggcgggaccaagcucacggugcugggccagcccaaggccgcgcccagcgugacccuguucccgcccuccagcgaggagcuccaggccaacaaggccacccuggucugccugaucuccgacuucuaccccggcgccgugaccguggcguggaaggccgacagcagccccgucaaggccgggguggagacgaccaccccguccaagcagagcaacaacaaguacgccgccuccagcuaccucucccugacccccgagcaguggaagucccaccggagcuacagcugccaggugacgcacgagggcuccaccgucgagaagaccguggcgcccaccgagugcagc

SEQ ID NO: 7874 - RNA, 1347 nt, Artificial Sequence
  derived and/or modified sequence opt1 from Ecromeximab_HeavyChain1
gaggugacccuggucgagagcggcggggacuucgugaagcccggcgggucccucaaggugagcugcgccgccuccggcuucgcguucagccacuacgccauguccuggguccgccagaccccggccaagcggcuggaguggguggccuacaucagcuccgggggcagcggcacguacuacuccgacagcgugaaggggcgcuucaccaucucccgggacaacgccaagaacacccuguaccuccagaugcgcagccugcgguccgaggacagcgcgauguacuucugcacccgcgucaagcugggcacguacuacuucgacuccugggggcagggcaccacccucaccgugagcuccgccagcacgaaggggcccuccguguucccccuggcccccagcagcaaguccaccagcggcggcaccgccgcgcuggggugccucgucaaggacuacuucccggagcccgugaccguguccuggaacagcggcgcccugacguccgggguccacaccuuccccgccgugcugcagagcuccggccucuacagccuguccagcguggucaccgugcccuccagcucccugggcacccagacguacaucugcaacgugaaccacaagccgagcaacaccaaggucgacaagaagguggagcccaaguccugcgacaagacccacacgugcccgcccugccccgcccccgagcuccucgggggccccagcguguuccuguucccgcccaagcccaaggacacccugaugaucucccggacccccgaggugaccugcgucguggucgacgugagccacgaggaccccgaggucaaguucaacugguacguggacgggguggagguccacaacgccaagaccaagccgcgcgaggagcaguacaacuccacguaccggguggugagcguccugaccgugcugcaccaggacuggcucaacggcaaggaguacaagugcaaggugagcaacaaggcgcugcccgcccccaucgagaagaccaucuccaaggccaaggggcagccccgcgagccgcaggucuacacccugccgcccagccgggacgagcucacgaagaaccaggugucccugaccugccuggugaagggcuucuaccccagcgacaucgccgucgagugggaguccaacggccagcccgagaacaacuacaagaccaccccgcccgugcucgacagcgacggguccuucuuccuguacagcaagcugacgguggacaagucccgcuggcagcagggcaacgucuucagcugcuccgugaugcacgaggcccuccacaaccacuacacccagaagucccugagccugagccccgggaag

SEQ ID NO: 7875 - RNA, 642 nt, Artificial Sequence
  derived and/or modified sequence opt1 from Ecromeximab_LightChain1
gacauccagaugacccagaccgccagcucccugcccgccagccucggcgaccgcgugacgaucuccugcagcgcgucccaggacaucagcaacuaccugaacugguaccagcagaagccggacgggaccgucaagcugcucaucuucuacuccagcaaccugcacuccggcgugcccagccgguucuccgggggcgggagcggcaccgacuacucccugaccaucagcaaccucgagcccgaggacaucgccacguacuucugccaccaguacuccaagcugcccuggaccuucggcgggggcaccaagcuggagaucaagcgcaccguggccgccccgagcgucuucaucuucccgcccuccgacgagcagcucaagagcgggacggccuccguggugugccugcugaacaacuucuacccccgggaggcgaagguccaguggaagguggacaacgcccuccagagcggcaacagccaggaguccgugaccgagcaggacagcaaggacuccaccuacagccuguccagcacccugacgcucuccaaggccgacuacgagaagcacaaggucuacgccugcgaggugacccaccaggggcugagcucccccgugaccaagagcuucaaccgcggcgagugc

SEQ ID NO: 7876 - RNA, 1341 nt, Artificial Sequence
  derived and/or modified sequence opt1 from Eculizumab_HeavyChain1
gugcagcugguccagagcggcgccgaggugaagaagcccggggccuccgugaaggucagcugcaaggcguccggcuacaucuucagcaacuacuggauccagugggugcgccaggccccggggcagggccucgaguggaugggggagauccugcccggcuccggcagcaccgaguacaccgagaacuucaaggaccgggugacgaugacccgcgacaccuccaccagcacggucuacauggagcuguccagccuccgguccgaggacaccgccguguacuacugcgcccgcuacuucuucgggagcucccccaacugguacuucgacguguggggccaggggacccuggucaccgugagcuccgccagcacgaagggccccuccguguucccgcuggcgcccugcagccgguccaccagcgagagcaccgccgcccucgggugccuggucaaggacuacuuccccgagcccgugaccguguccuggaacagcggcgcccugacguccggcguccacaccuucccggcggugcuccagagcuccgggcuguacagccuguccagcguggucaccgugcccuccagcaacuucggcacccagacguacacgugcaacguggaccacaagcccuccaacaccaaggucgacaagaccguggagcgcaagugcugcguggagugcccgcccugccccgccccgcccgucgccgggcccagcguguuccucuucccgcccaagcccaaggacacccugaugaucucccggacccccgaggugaccugcgucguggucgacgugagccaggaggaccccgaggugcaguucaacugguacgucgacggcguggaggugcacaacgccaagaccaagccccgcgaggagcaguucaacuccacguaccgggucgugagcgugcugaccguccuccaccaggacuggcugaacggcaaggaguacaagugcaagguguccaacaaggggcugcccagcuccaucgagaagaccaucagcaaggccaagggccagccgcgcgagccccagguguacacccucccgcccagccaggaggagaugacgaagaaccaggucucccugaccugccuggugaagggguucuaccccagcgacaucgcgguggagugggaguccaacggccagcccgagaacaacuacaagaccacgcccccgguccucgacagcgacggguccuucuuccuguacagccggcugaccguggacaagucccgcuggcaggagggcaacguguucagcugcuccgucaugcacgaggcccuccacaaccacuacacccagaagucccugagccugagccucggcaag

SEQ ID NO: 7877 - RNA, 642 nt, Artificial Sequence
  derived and/or modified sequence opt1 from Eculizumab_LightChain1
gacauccagaugacgcagagccccuccagccuguccgccagcgugggcgaccgcgucaccaucacgugcggggccuccgagaacaucuacggcgcgcucaacugguaccagcagaagccggggaaggcccccaagcugcugaucuacggcgccaccaaccucgccgacggggugcccagccgguucuccggcagcggcuccgggaccgacuucacccugacgaucagcucccugcagcccgaggacuucgccaccuacuacugccagaacgugcucaacaccccgcugaccuucggccaggggacgaaggucgagaucaagcgcaccguggcggcccccagcguguucaucuucccgcccuccgacgagcagcucaagagcggcaccgccuccgucgugugccugcugaacaacuucuacccccgggaggccaaggugcaguggaaggucgacaacgcgcugcagagcgggaacucccaggagagcgugaccgagcaggacuccaaggacagcacguacagccucuccagcacccugacccuguccaaggccgacuacgagaagcacaagguguacgccugcgaggucacccaccagggccucagcucccccgugaccaagagcuucaaccgcggcgagugc

SEQ ID NO: 7878 - RNA, 375 nt, Artificial Sequence
  derived and/or modified sequence opt1 from Efalizumab_HeavyChain
gaggugcagcuggucgagagcggcgggggccucgugcagcccgggggcucccugcgccugagcugcgccgccuccggguacagcuucaccggccacuggaugaacugggugcggcaggcgccgggcaaggggcucgagugggucggcaucaugauccaccccuccgacagcgagacccgcuacaaccagaaguucaaggacauccgguucacgaucuccguggacaagagcaagaacacccuguaccugcagaugaacucccuccgcgccgaggacaccgccguguacuacugcgcccggaucgggaucuacuucuacggcaccacguacuucgacuacaucugggggcagggcacccuggucaccgugagcucc

SEQ ID NO: 7879 - RNA, 324 nt, Artificial Sequence
  derived and/or modified sequence opt1 from Efalizumab_LightChain
gacauccagaugacccagagccccuccagccuguccgccagcgugggcgaccgcgucaccaucacgugccgggccuccaagaccaucagcaaguaccucgcgugguaccagcagaagccggggaaggcccccaagcugcugaucuacuccggcagcacccuccaguccggggugcccagccgcuucuccggcagcggguccggcaccgacuucacgcugaccaucagcucccugcagcccgaggacuucgccaccuacuacugccagcagcacaacgaguacccgcucaccuucggccaggggacgaagguggagaucaagcgg

SEQ ID NO: 7880 - RNA, 768 nt, Artificial Sequence
  derived and/or modified sequence opt1 from Efungumab_SingleChain_variable_fragment
auggccgaggugcagcuggucgagagcggcgccgaggugaagaagcccggggagucccuccgcaucagcugcaagggcuccgggugcaucaucagcuccuacuggaucagcugggugcggcagaugccgggcaaggggcuggaguggaugggcaagaucgaccccggcgacuccuacaucaacuacagccccuccuuccaggggcacgucaccaucagcgcggacaaguccaucaacaccgccuaccugcaguggaacagccucaaggccuccgacacggccauguacuacugcgcccgcggcgggcgggacuucggcgacagcuucgacuacugggggcagggcacccuggugaccguguccagcggcgggggcggguccggcggcgggggcagcgggggcgggggcuccgacgucgugaugacccagagccccagcuuccuguccgcguucgugggcgaccgcaucacgaucacgugccgggccagcuccgggaucagccgcuaccucgccugguaccagcaggccccgggcaaggcgcccaagcugcugaucuacgccgccuccacccuccagaccgggguccccagccgguucuccggcagcggguccggcaccgaguucacccugaccaucaacagccugcagcccgaggacuucgccaccuacuacugccagcaccucaacuccuacccgcugacguucggcgggggcaccaagguggacaucaagcgcgccgcggcccuggagcaccaccaccaccaccac

SEQ ID NO: 7881 - RNA, 1362 nt, Artificial Sequence
  derived and/or modified sequence opt1 from Eldelumab_HeavyChain1
cagaugcagcugguggagagcggcgggggcgucgugcagcccgggcgcucccuccggcugagcugcaccgccuccggcuucaccuucagcaacaacgggaugcacugggugcgccaggccccgggcaagggccuggagugggucgcggugaucugguucgacgggaugaacaaguucuacguggacuccgucaagggccgguucacgaucagccgcgacaacuccaagaacacccucuaccuggagaugaacagccugcgggccgaggacaccgccaucuacuacugcgcccgcgagggggacggcuccgggaucuacuacuacuacggcauggacguguggggccaggggaccacggugaccgucagcuccgccagcaccaagggccccuccguguucccccucgcgcccagcuccaagagcaccuccgggggcacggccgcccugggcugccuggugaaggacuacuucccggagcccgucaccgugagcuggaacuccggggcccucaccagcggcgugcacaccuuccccgcgguccugcagagcuccgggcuguacagccucuccagcguggugacgguccccuccagcucccugggcacccagaccuacaucugcaacgugaaccacaagccgagcaacaccaagguggacaagcgggucgagcccaaguccugcgacaagacgcacacgugcccgcccugcccggcccccgagcugcucgggggccccagcguguuccuguucccgcccaagcccaaggacacccugaugaucucccgcacccccgaggugaccugcgucguggucgacgugagccacgaggaccccgaggugaaguucaacugguacgucgacggcguggaggugcacaacgccaagaccaagccgcgggaggagcaguacaacuccaccuaccgcgucgugagcgugcucaccguccugcaccaggacuggcugaacgggaaggaguacaagugcaagguguccaacaaggcccuccccgcccccaucgagaagacgaucagcaaggcgaagggccagccccgggagccccagguguacacccugccgcccucccgcgaggagaugaccaagaaccaggucagccugaccugccucgugaagggguucuaccccuccgacaucgccguggagugggagagcaacggccagcccgagaacaacuacaagacgaccccgcccguccuggacagcgacggguccuucuuccuguacagcaagcucaccguggacaagucccgguggcagcagggcaacguguucagcugcuccgucaugcacgaggcccugcacaaccacuacacccagaagucccugagccucagccccggcaag

SEQ ID NO: 7882 - RNA, 648 nt, Artificial Sequence
  derived and/or modified sequence opt1 from Eldelumab_LightChain1
gagaucgugcugacccagagccccggcacccucucccugagcccgggggagcgcgccacgcuguccugccgggccagccaguccgucagcuccagcuaccucgcgugguaccagcagaagcccggccaggcgccccgccugcugaucuacggggccuccagccgggccaccggcauccccgaccgcuucuccgggagcggcuccggcaccgacuucacccucacgaucagccggcuggagccggaggacuucgccguguacuacugccagcaguacggguccagccccaucuucaccuucggccccgggaccaagguggacaucaagcgcaccgucgccgcccccuccguguucaucuucccgcccagcgacgagcagcugaaguccggcacggccagcguggucugccuccugaacaacuucuacccccgggaggccaaggugcaguggaagguggacaacgcgcugcagagcgggaacucccaggagagcgucaccgagcaggacuccaaggacagcaccuacucccucagcuccacccugacgcugagcaaggccgacuacgagaagcacaagguguacgccugcgaggugacccaccagggccucuccagccccgucaccaaguccuucaaccgcggcgagugc

SEQ ID NO: 7883 - RNA, 1341 nt, Artificial Sequence
  derived and/or modified sequence opt1 from Elgemtumab_HeavyChain1
gaggugcagcugcucgagagcggcgggggccugguccagcccgggggcucccugcgccucagcugcgccgccuccggguucaccuucagcuccuacgcgaugagcugggugcggcaggccccgggcaagggccuggaguggguguccgccaucaacagccaggggaaguccaccuacuacgccgacagcgucaagggccgcuucacgaucucccgggacaacagcaagaacacccuguaccuccagaugaacucccugcgcgccgaggacaccgcgguguacuacugcgcccgguggggcgacgagggguucgacaucugggggcagggcacccuggugacggucagcuccgccagcaccaagggccccuccguguucccccucgcccccagcuccaagagcaccagcgggggcaccgcggcccuggggugccuggugaaggacuacuucccggagcccgucacgguguccuggaacagcggcgcccucaccuccggcgugcacaccuuccccgccguccugcagagcuccgggcuguacagccucuccagcguggugaccguccccuccagcucccugggcacgcagaccuacaucugcaacgugaaccacaagccgagcaacaccaagguggacaagcgcgucgagcccaaguccugcgacaagacccacacgugcccgcccugcccggcccccgagcugcucgggggccccagcguguuccuguucccgcccaagcccaaggacacccugaugaucucccggacccccgaggugaccugcgucgugguggacgucagccacgaggaccccgaggugaaguucaacugguacgucgacgggguggaggugcacaacgcgaagacgaagccgcgcgaggagcaguacaacuccaccuaccgggucgugagcgugcucaccguccugcaccaggacuggcugaacggcaaggaguacaagugcaagguguccaacaaggcccuccccgcccccaucgagaagaccaucagcaaggccaagggccagccccgcgagccccagguguacacgcugccgcccagccgggaggagaugaccaagaaccaggucucccugaccugccucgugaagggguucuaccccagcgacaucgccguggagugggaguccaacggccagcccgagaacaacuacaagaccacgccgcccguccuggacagcgacggguccuucuuccuguacagcaagcucaccguggacaagucccgcuggcagcagggcaacguguucagcugcuccgucaugcacgaggcgcugcacaaccacuacacccagaagucccugagccucagccccgggaag

SEQ ID NO: 7884 - RNA, 642 nt, Artificial Sequence
  derived and/or modified sequence opt1 from Elgemtumab_LightChain1
gacauccagaugacccagagccccuccagccuguccgccagcgugggcgaccgcgucaccaucacgugccgggccucccaggggaucagcaacuggcucgcgugguaccagcagaagccgggcaaggcccccaagcugcugaucuacggggccuccagccuccaguccggcgugcccagccgcuucuccgggagcggcuccggcaccgacuucacccugaccaucagcucccugcagcccgaggacuucgccacguacuacugccagcaguacagcuccuucccgaccaccuucgggcagggcaccaagguggagaucaagcggacggucgccgcgcccagcguguucaucuucccgcccuccgacgagcagcucaagagcgggaccgccagcguggucugccugcugaacaacuucuacccccgcgaggccaaggugcaguggaagguggacaacgcccuccaguccggcaacagccaggaguccgucaccgagcaggacagcaaggacuccaccuacagccuguccagcacgcugacccucuccaaggcggacuacgagaagcacaagguguacgccugcgaggugacccaccaggggcugagcucccccgucaccaagagcuucaaccggggcgagugc

SEQ ID NO: 7885 - RNA, 1347 nt, Artificial Sequence
  derived and/or modified sequence opt1 from Elotuzumab_HeavyChain1
gaggugcagcuggucgagagcggcgggggccucgugcagcccgggggcucccugcgccugagcugcgccgccuccggguucgacuucagccgguacuggauguccugggugcgccaggcgcccggcaagggccucgaguggaucggggagaucaaccccgacagcuccaccaucaacuacgcccccagccugaaggacaaguucaucaucucccgggacaacgccaagaacagccuguaccuccagaugaacucccugcgcgccgaggacaccgccgucuacuacugcgcgcggcccgacggcaacuacugguacuucgacgugugggggcagggcacgcuggugaccgucagcuccgccagcaccaaggggccguccguguucccccucgcccccagcuccaagagcaccuccggcggcacggccgcgcuggggugccuggugaaggacuacuuccccgagccggucaccgugagcuggaacagcggcgcccucaccuccggggugcacaccuuccccgccguccugcagagcuccggccuguacagccucuccagcguggugacgguccccuccagcucccugggcacccagaccuacaucugcaacgugaaccacaagcccagcaacaccaagguggacaagaaggucgagccgaaguccugcgacaagacgcacacgugcccgcccugccccgcccccgagcugcucgggggccccagcguguuccuguucccgcccaagcccaaggacacccugaugaucucccgcacccccgaggugaccugcgucgugguggacgucagccacgaggaccccgaggugaaguucaacugguacgucgacgggguggaggugcacaacgccaagaccaagccccgggaggagcaguacaacuccaccuaccgcgucgugagcgugcucaccguccugcaccaggacuggcugaacggcaaggaguacaagugcaagguguccaacaaggcgcucccggcccccaucgagaagacgaucagcaaggccaaggggcagccccgggagccccagguguacacccugccgcccucccgcgacgagcugaccaagaaccaggucagccugaccugccucgugaagggcuucuaccccagcgacaucgccguggagugggaguccaacggccagccggagaacaacuacaagacgaccccgcccguccuggacagcgacggguccuucuuccucuacagcaagcugaccguggacaagucccgguggcagcagggcaacguguucagcugcuccgucaugcacgaggcccugcacaaccacuacacccagaagucccucagccugagccccgggaag

SEQ ID NO: 7886 - RNA, 642 nt, Artificial Sequence
  derived and/or modified sequence opt1 from Elotuzumab_LightChain1
gacauccagaugacgcagagccccuccagccuguccgccagcgugggcgaccgggucaccaucacgugcaaggccucccaggacguggggaucgcgguggccugguaccagcagaagccgggcaagguccccaagcuccugaucuacugggccagcacccggcacaccggggugcccgaccgcuucuccggcagcggguccggcaccgacuucacgcugaccaucagcucccuccagcccgaggacguggccaccuacuacugccagcaguacagcuccuacccguacaccuucggccaggggacgaaggucgagaucaagcggaccguggccgcgcccagcguguucaucuucccgcccuccgacgagcagcucaagagcggcaccgccuccgucgugugccugcugaacaacuucuacccccgcgaggccaaggugcaguggaaggucgacaacgcccugcagagcgggaacucccaggagagcgugaccgagcaggacagcaaggacuccacguacagccuguccagcacccucacccuguccaaggcggacuacgagaagcacaagguguacgccugcgaggucacccaccagggccugagcucccccgugaccaagagcuucaaccgcggggagugc

SEQ ID NO: 7887 - RNA, 1338 nt, Artificial Sequence
  derived and/or modified sequence opt1 from Emactuzumab_HeavyChain1
caggugcagcugguccagagcggcgccgaggugaagaagcccggggccuccgugaaggucagcugcaaggcguccggcuacaccuucaccagcuacgacaucuccugggugcgccaggccccggggcagggccucgaguggaugggggugaucuggacggacggcggcaccaacuacgcccagaagcugcaggggcgggucaccaugaccacggacaccagcaccuccaccgccuacauggagcugcgcagccuccgguccgacgacacggccguguacuacugcgcgcgcgaccagcggcuguacuucgacguguggggccaggggaccaccgucaccgugagcuccgccagcacgaagggccccuccguguucccccuggcccccagcuccaagagcaccuccgggggcaccgccgcgcucggcugccuggucaaggacuacuucccggagcccgugaccgugagcuggaacuccggggcccugacgagcggcguccacaccuuccccgccgugcuccagagcuccgggcuguacagccuguccagcguggucaccgugcccuccagcucccucggcacccagacguacaucugcaacgugaaccacaagccgagcaacaccaaggucgacaagaagguggagcccaaguccugcgacaagacccacacgugcccgcccugccccgcccccgagcugcugggcgggcccagcguguuccucuucccgcccaagcccaaggacacccugaugaucucccgcacccccgaggugaccugcgucgucguggacgugagccacgaggaccccgaggucaaguucaacugguacguggacggcguggagguccacaacgccaagaccaagccgcgggaggagcaguacaacuccacguaccgcguggugagcguccugaccgugcuccaccaggacuggcugaacgggaaggaguacaagugcaagguguccaacaaggcgcugcccgcccccaucgagaagaccaucagcaaggccaagggccagccccgggagccgcaggucuacacccucccgcccucccgcgacgagcugacgaagaaccaggugagccugaccugccucgugaagggguucuaccccuccgacaucgccgucgagugggagagcaacggccagcccgagaacaacuacaagaccaccccgcccgugcuggacagcgacggcuccuucuuccuguacagcaagcucacgguggacaagucccgguggcagcaggggaacgucuucagcugcuccgugaugcacgaggcccugcacaaccacuacacccagaagucccugagccucagccccggcaag

SEQ ID NO: 7888 - RNA, 639 nt, Artificial Sequence
  derived and/or modified sequence opt1 from Emactuzumab_LightChain1
gacauccagaugacgcagagccccuccagccuguccgccagcgugggcgaccgcgucaccaucacgugccgggccuccgaggacgugaacaccuacgugagcugguaccagcagaagccggggaaggcgcccaagcuccugaucuacgccgccuccaaccgcuacaccggcguccccagccgguucuccgggagcggcuccgggaccgacuucacgcugaccaucagcucccuccagcccgaggacuucgccaccuacuacugccagcagagcuucuccuacccgaccuucggccagggcacgaagcuggagaucaagcgcaccguggccgcgcccagcguguucaucuucccgcccuccgacgagcagcucaagagcgggaccgccuccgucgugugccugcugaacaacuucuacccccgggaggccaaggugcaguggaaggucgacaacgcccugcagagcggcaacagccaggaguccgugaccgagcaggacagcaaggacuccacguacagccucuccagcacccugacccuguccaaggcggacuacgagaagcacaagguguacgccugcgaggucacccaccaggggcucagcucccccgugaccaagagcuucaaccgcggcgagugc

SEQ ID NO: 7889 - RNA, 1323 nt, Artificial Sequence
  derived and/or modified sequence opt1 from Emibetuzumab_HeavyChain1
caggugcagcugguccagagcggcgccgaggugaagaagcccggggccuccgugaaggucagcugcaaggcguccggcuacaccuucaccgacuacuacaugcacugggugcgccaggcccccgggcagggccucgaguggauggggcgggugaaccccaaccgccggggcacgaccuacaaccagaaguucgagggccgcgucaccaugaccacggacaccagcaccuccaccgccuacauggagcugcggagccugcgcuccgacgacacggccguguacuacugcgcccgggcgaacuggcucgacuacugggggcagggcaccaccgugaccgucagcuccgccagcacgaaggggcccuccguguucccccuggccccgugcagccgcuccaccagcgaguccaccgccgcgcugggcugccucgugaaggacuacuuccccgagcccgucaccgugagcuggaacuccggggcccugacgagcggcgugcacaccuuccccgccguccugcaguccagcggccucuacagccuguccagcguggugaccgucccguccagcucccuggggaccaagacguacacgugcaacguggaccacaagcccagcaacaccaagguggacaagcgggucgaguccaaguacggcccgcccugcccgcccugccccgcccccgaggccgccgggggcccgagcguguuccucuucccgcccaagcccaaggacacccugaugaucucccgcacccccgaggugaccugcgucguggucgacgugagccaggaggaccccgaggugcaguucaacugguacgucgacggcguggaggugcacaacgcgaagaccaagccccgggaggagcaguucaacuccaccuaccgcgucgugagcgugcugacgguccuccaccaggacuggcugaacgggaaggaguacaagugcaagguguccaacaagggccugcccagcuccaucgagaagaccaucagcaaggccaaggggcagccgcgggagccccagguguacacccucccgcccucccaggaggagaugaccaagaaccaggucagccugacgugccuggugaagggcuucuaccccuccgacaucgccguggagugggagagcaacgggcagcccgagaacaacuacaagaccaccccgcccguccucgacagcgacggcuccuucuuccuguacagccgccugaccguggacaagucccgguggcaggagggcaacguguucagcugcuccgucaugcacgaggcccuccacaaccacuacacgcagaagucccugagccugagccucggg

SEQ ID NO: 7890 - RNA, 645 nt, Artificial Sequence
  derived and/or modified sequence opt1 from Emibetuzumab_LightChain1
gacauccagaugacccagagccccuccagccuguccgccagcgugggcgaccgcgucaccaucacgugcuccgugagcuccagcguguccagcaucuaccuccacugguaccagcagaagccggggaaggcccccaagcugcugaucuacuccaccagcaaccucgcguccggcguccccagccgguucuccgggagcggcuccgggaccgacuucacccugacgaucagcucccugcagcccgaggacuucgccaccuacuacugccagguguacagcggcuacccgcucaccuucggcgggggcaccaagguggagaucaagcgcacggucgccgcccccagcguguucaucuucccgcccuccgacgagcagcucaagagcgggaccgccuccguggucugccugcugaacaacuucuacccccgggaggcgaaggugcaguggaagguggacaacgcccugcagagcggcaacucccaggagagcgucaccgagcaggacuccaaggacagcaccuacucccugagcuccacgcucacccugagcaaggccgacuacgagaagcacaagguguacgccugcgaggugacccaccaggggcuguccagccccgucaccaaguccuucaaccgcggcgagugc

SEQ ID NO: 7891 - RNA, 1344 nt, Artificial Sequence
  derived and/or modified sequence opt1 from Emicizumab_HeavyChain1
caggugcagcuggucgagagcggcgggggccucgugcagcccgggggcucccugcgccugagcugcgccgccuccggguucaccuucagcuacuacgacauccagugggugcggcaggcgccgggcaagggccucgagugggucuccagcaucucccccagcgggcaguccaccuacuaccgccgggaggugaagggccgcuucacgaucagccgggacaacuccaagaacacccuguaccugcagaugaacagccuccgcgccgaggacaccgccguguacuacugcgcccggcgcaccgggcgggaguacggcgggggcugguacuucgacuacuggggccaggggacgcuggucaccguguccagcgccuccaccaagggccccagcguguucccccuggcgccgugcucccgcagcaccuccgagagcacggccgcccucgggugccuggucaaggacuacuuccccgagcccgugaccgugagcuggaacuccggcgcccugaccagcggcguccacaccuuccccgcggugcuccaguccagcgggcuguacucccugagcuccguggucacggugccgagcuccagccucggcacccagaccuacacgugcaacguggaccacaagcccuccaacaccaaggucgacaagcggguggagagcaaguacgggccgcccugcccgcccugccccgcccccgaguuccugggcgggcccuccguguuccuguucccgcccaagcccaaggacacccucaugaucagccgcacccccgaggugaccugcgucguggucgacgugucccaggaggaccccgagguccaguucaacugguacguggacggcguggagguccacaacgccaagacgaagccccgggaggagcaguacaacagcaccuaccgcgugguguccguccugaccgugcugcaccaggacuggcucaacggcaaggaguacaagugcaaggugagcaacaaggggcugcccuccagcaucgagaagaccaucagcaaggccaagggccagccgcgggagccccaggucuacacgcugccgcccucccagaaggagaugaccaagaaccaggugagccugaccugccucgugaagggguucuaccccuccgacaucgccgucgagugggagagcaacggccagcccgagaacaacuacaagaccacgcccccggugcuggacuccgacgggagcuucuuccucuacuccaagcugaccguggacaagagccgcuggcaggagggcaacgucuucuccugcagcgugaugcacgaggcgcugcacaaccgguacacccagaagucccucagccuguccccc

SEQ ID NO: 7892 - RNA, 1332 nt, Artificial Sequence
  derived and/or modified sequence opt1 from Emicizumab_HeavyChain2
caggugcagcugguccagagcggcuccgagcucaagaagcccggggccagcgugaagguguccugcaaggccagcggcuacaccuucaccgacaacaacauggacuggguccgccaggcgccggggcagggccuggaguggaugggggacaucaacacgcgguccggcggcagcaucuacaacgaggaguuccaggaccgcgugaucaugaccguggacaaguccaccgacaccgccuacauggagcugagcucccuccggagcgaggacacggccaccuaccacugcgcccgccggaaguccuacggguacuaccuggacgaguggggcgaggggacccuggucaccgugagcuccgccagcacgaagggccccuccguguucccccucgcgcccugcagccgcuccaccagcgaguccaccgccgcccuggggugccuggucaaggacuacuucccggagcccgugaccgugagcuggaacagcggcgcccucacguccggcguccacaccuuccccgcggugcugcagagcuccgggcuguacagccucuccagcguggucaccgugcccuccagcucccugggcacccagacguacacgugcaacguggaccacaagccgagcaacaccaaggucgacaagcggguggaguccaaguacgggccgcccugcccgcccugccccgcccccgaguuccugggcggccccagcguguuccucuucccgcccaagcccaaggacacccugaugaucucccgcacccccgaggugaccugcgucguggucgacgugagccaggaggaccccgagguccaguucaacugguacguggacgggguggagguccacaacgccaagaccaagccccgggaggagcaguacaacuccaccuaccgcguggugagcguccugacggugcuccaccaggacuggcugaacggcaaggaguacaagugcaagguguccaacaaggggcugcccagcuccaucgagaagaccaucagcaaggccaagggccagccccgggagccgcaggucuacacccucccgcccagccaggaggagaugaccaagaaccaggugucccugacgugccuggugaagggguucuaccccagcgacaucgccgucgagugggaguccaacggccagcccgagaacaacuacaagaccaccccgcccgugcucgacagcgacggcuccuucuuccuguacagcaagcugaccguggacaagucccgcuggcaggaggggaacgucuucagcugcuccgugaugcacgaggcgcuccacaaccacuacacgcaggagagccugucccugagcccc

SEQ ID NO: 7893 - RNA, 642 nt, Artificial Sequence
  derived and/or modified sequence opt1 from Emicizumab_LightChain1
gacauccagaugacccagagccccuccagccuguccgccagcgugggcgaccgcgucaccaucacgugcaaggccucccggaacaucgagcgccagcucgcgugguaccagcagaagccggggcaggcccccgagcugcugaucuaccaggccagccggaaggaguccggcgugcccgaccgcuucagcgggucccgguacggcaccgacuucacccucaccaucagcucccugcagcccgaggacaucgccacguacuacugccagcaguacagcgacccgccccugaccuucgggggcggcaccaagguggagaucaagcgcaccgucgccgcgcccuccguguucaucuucccgcccagcgacgagcagcucaaguccgggacggccagcguggucugccugcugaacaacuucuacccccgggaggccaaggugcaguggaagguggacaacgcccuccaguccggcaacagccaggaguccgucaccgagcaggacagcaaggacagcaccuacucccugagcuccacccugacgcucagcaaggcggacuacgagaagcacaagguguacgccugcgaggugacccaccaggggcuguccagccccgucaccaaguccuucaaccgcggcgagugc

SEQ ID NO: 7894 - RNA, 1347 nt, Artificial Sequence
  derived and/or modified sequence opt1 from Enavatuzumab_HeavyChain1
gaggugcagcuggucgagagcggcgggggccucgugcagcccgggggcucccugcgccugagcugcgccgccuccggguucaccuucagcuccuacuggaugagcugggugcggcaggcgccgggcaagggccucgagugggucgccgagauccgccugaaguccgacaacuacgccacccacuacgccgagagcgugaaggggcgguucacgaucucccgcgacgacagcaagaacucccuguaccuccagaugaacagccugcgggccgaggacaccgcgguguacuacugcaccggcuacuacgccgacgccauggacuacugggggcagggcacccuggucacgguguccagcgccuccaccaaggggcccagcguguucccccucgcgcccuccagcaaguccaccagcggcggcaccgccgcccuggggugccuggucaaggacuacuucccggagcccgugacggugagcuggaacuccggcgcccucaccagcgggguccacaccuuccccgccgugcugcaguccagcggccuguacucccucagcuccguggucaccgugcccagcuccagccugggcacgcagaccuacaucugcaacgugaaccacaagccguccaacaccaaggucgacaagaagguggagcccaagagcugcgacaagacccacacgugcccgcccugccccgcgcccgagcugcucgggggccccuccguguuccuguucccgcccaagcccaaggacacccugaugaucagccgcacccccgaggugaccugcgucguggucgacgugucccacgaggaccccgaggucaaguucaacugguacguggacgggguggagguccacaacgccaagacgaagccgcgggaggagcaguacaacagcaccuaccgcgugguguccguccucaccgugcugcaccaggacuggcugaacggcaaggaguacaagugcaaggugagcaacaaggcccuccccgcccccaucgagaagaccaucuccaaggccaaggggcagccccgggagccgcaggucuacacgcugccgcccagccgcgaggagaugaccaagaaccaggugagccugaccugccucgugaagggcuucuaccccuccgacaucgcggucgagugggagagcaacggccagcccgagaacaacuacaagaccacgccgcccgugcuggacuccgacgggagcuucuuccuguacuccaagcucaccguggacaagagccgguggcagcagggcaacgucuucuccugcagcgugaugcacgaggcccugcacaaccacuacacccagaagucccugagccucucccccgggaag

SEQ ID NO: 7895 - RNA, 654 nt, Artificial Sequence
  derived and/or modified sequence opt1 from Enavatuzumab_LightChain1
gacauccagaugacccagagccccuccagccuguccgccagcgugggcgaccgggucaccaucacgugccgggccucccagagcguguccaccagcuccuacagcuacaugcacugguaccagcagaagccggggaaggcgcccaagcuccugaucaaguacgccuccaaccuggagagcggcgugcccucccgcuucagcggguccggcagcgggaccgacuucacccucacgaucuccagccugcagcccgaggacuucgccaccuacuacugccagcacuccugggagaucccguacaccuucggcggcgggaccaaggucgagaucaagcggacgguggccgcccccagcguguucaucuucccgcccagcgacgagcagcugaaguccggcaccgcgagcgucgugugccuccugaacaacuucuacccccgcgaggccaaggugcaguggaaggucgacaacgcccugcaguccgggaacagccaggaguccgugaccgagcaggacagcaaggacuccaccuacagccucuccagcacgcugacccuguccaaggccgacuacgagaagcacaagguguacgcgugcgaggucacccaccagggccucagcucccccgugaccaagagcuucaaccgcggggagugc

SEQ ID NO: 7896 - RNA, 1341 nt, Artificial Sequence
  derived and/or modified sequence opt1 from Enfortumab_HeavyChain
gaggugcagcuggucgagagcggcgggggccucgugcagcccgggggcucccugcgccugagcugcgccgccuccggguucaccuucagcuccuacaacaugaacugggugcggcaggcgccgggcaagggccucgagugggucagcuacaucuccagcuccagcuccaccaucuacuacgccgacagcgugaaggggcgcuucacgaucucccgggacaacgccaagaacagccugucccugcagaugaacagccuccgcgacgaggacaccgccguguacuacugcgcccgggcguacuacuacggcauggacgucugggggcagggcaccaccgugacgguguccagcgccuccaccaaggggcccagcgucuucccccuggcccccagcuccaagagcaccuccggcggcaccgccgcgcuggggugccucgugaaggacuacuucccggagcccgugacggucagcuggaacuccggcgcccugaccagcggggugcacaccuuccccgccgugcugcaguccagcggccucuacucccugagcuccgucgugaccgugcccagcuccagccugggcacgcagaccuacaucugcaacgucaaccacaagccguccaacaccaagguggacaagcgcguggagcccaagagcugcgacaagacccacacgugcccgcccugcccggcccccgagcuccucgggggccccuccgucuuccuguucccgcccaagcccaaggacacccucaugaucagccggacccccgaggugaccugcguggucguggacgucucccacgaggaccccgaggugaaguucaacugguacguggacggggucgaggugcacaacgccaagacgaagccgcgcgaggagcaguacaacagcaccuaccggguggucagcgugcugaccgugcugcaccaggacuggcucaacggcaaggaguacaagugcaaggucuccaacaaggcgcugcccgcccccaucgagaagaccaucagcaaggccaaggggcagccccgcgagccccagguguacacgcugccgcccucccgggaggagaugaccaagaaccaggugagccugaccugccuggucaagggcuucuaccccuccgacaucgccguggagugggagagcaacggccagcccgagaacaacuacaagaccacgccgcccgugcuggacuccgacgggagcuucuuccucuacuccaagcugaccgucgacaagagccgcuggcagcagggcaacguguucuccugcagcgugaugcacgaggcccugcacaaccacuacacccagaagucccucagccugucccccgggaag

SEQ ID NO: 7897 - RNA, 642 nt, Artificial Sequence
  derived and/or modified sequence opt1 from Enfortumab_LightChain
gacauccagaugacccagagccccuccagcguguccgccagcgucggcgaccgcgugaccaucacgugccgggccucccaggggaucagcggcuggcuggcgugguaccagcagaagccggggaaggcccccaaguuccucaucuacgccgccuccacccugcagagcggcgugcccucccgcuucagcggguccggcagcggcaccgacuucacccugacgaucuccagccuccagcccgaggacuucgccaccuacuacugccagcaggcgaacuccuucccgcccaccuucgggggcgggaccaaggucgagaucaagcggacgguggccgcccccagcguguucaucuucccgcccuccgacgagcagcucaagagcggcaccgccuccgucgugugccugcugaacaacuucuacccccgcgaggcgaaggugcaguggaaggucgacaacgcccugcagagcgggaacagccaggaguccgugaccgagcaggacagcaaggacuccaccuacagccuguccagcacgcucacccuguccaaggccgacuacgagaagcacaagguguacgccugcgaggucacccaccagggccugagcucccccgugaccaagagcuucaaccggggcgagugc

SEQ ID NO: 7898 - RNA, 1341 nt, Artificial Sequence; identical to SEQ ID NO: 7896
  derived and/or modified sequence opt1 from Enfortumab_vedotin_HeavyChain1

SEQ ID NO: 7899 - RNA, 642 nt, Artificial Sequence; identical to SEQ ID NO: 7897
  derived and/or modified sequence opt1 from Enfortumab_vedotin_LightChain1

SEQ ID NO: 7900 - RNA, 1356 nt, Artificial Sequence
  derived and/or modified sequence opt1 from Enoblituzumab_HeavyChain
gaggugcagcuggucgagagcggcgggggccucgugcagcccgggggcucccugcgccugagcugcgccgccuccggguucaccuucagcuccuucggcaugcacugggugcggcaggcgccgggcaaggggcucgagugggucgccuacaucagcuccgacagcuccgccaucuacuacgccgacaccgugaagggccgcuucacgaucagccgggacaacgccaagaacucccuguaccugcagaugaacagccuccgcgacgaggacaccgcgguguacuacugcgggcggggccgcgagaacaucuacuacgggucccggcuggacuacuggggccagggcaccaccgucacggugagcuccgccagcaccaaggggcccuccguguucccccuggcccccagcuccaagagcaccagcggcgggaccgccgcgcucggcugccuggucaaggacuacuucccggagcccgugacgguguccuggaacagcggcgcccugaccuccgggguccacaccuuccccgccgugcuccagagcuccggccuguacagccuguccagcguggucaccgugcccuccagcucccucgggacgcagaccuacaucugcaacgugaaccacaagccgagcaacaccaaggucgacaagcgcguggagcccaaguccugcgacaagacccacacgugcccgcccugccccgcccccgagcuggugggcgggcccagcgucuuccugcugcccccgaagcccaaggacacccucaugaucucccggacccccgaggugaccugcguggucguggacgucagccacgaggaccccgaggugaaguucaacugguacguggacggcgucgaggugcacaacgccaagacgaagccgcccgaggagcaguacaacuccacccugcgcguggucagcgugcucaccgugcugcaccaggacuggcugaacggcaaggaguacaagugcaaggucuccaacaaggcgcuccccgcccccaucgagaagaccaucagcaaggccaaggggcagccgcgggagccccagguguacacgcugccgcccagccgcgaggagaugaccaagaaccaggugucccugaccugccucgucaagggcuucuaccccagcgacaucgccguggagugggaguccaacgggcagcccgagaacaacuacaagaccacgccccuggugcuggacagcgacggcuccuucuuccucuacagcaagcugaccgucgacaagucccgguggcagcaggggaacguguucagcugcuccgugaugcacgaggcccugcacaaccacuacacccagaagucccucagccugagcccgggcaag

SEQ ID NO: 7901 - RNA, 642 nt, Artificial Sequence
  derived and/or modified sequence opt1 from Enoblituzumab_LightChain
gacauccagcugacccagagccccuccuuccucagcgccuccgugggcgaccgcgucaccaucacgugcaaggccagccagaacguggacaccaacguggcgugguaccagcagaagccggggaaggcccccaaggcccugaucuacuccgccagcuaccgguacuccggcguccccagccgcuucuccgggagcggcuccgggaccgacuucacccugacgaucagcucccuccagcccgaggacuucgccaccuacuacugccagcaguacaacaacuacccguucaccuucggccagggcaccaagcuggagaucaagcggacgguggcggcccccagcguguucaucuucccgcccuccgacgagcagcucaagagcgggaccgccuccgucgugugccugcugaacaacuucuacccccgcgaggccaaggugcaguggaaggucgacaacgcgcugcagagcggcaacucccaggagagcgugaccgagcaggacagcaaggacuccaccuacagccucuccagcacgcugacccuguccaaggccgacuacgagaagcacaagguguacgccugcgaggucacccaccaggggcucagcucccccgugaccaagagcuucaaccggggcgagugc

SEQ ID NO: 7902 - RNA, 1356 nt, Artificial Sequence
  derived and/or modified sequence opt1 from Enokizumab_HeavyChain1
caggugcagcugguccagagcggcgccgaggugaagaagcccggguccagcgugaaggucuccugcaaggccagcggcgggaccuucuccuacuacuggaucgagugggugcgccaggcgccgggccaggggcucgaguggaugggcgagauccugcccggcagcgggaccacgaaccccaacgagaaguucaagggccgggugaccaucaccgccgacgaguccaccagcacggccuacauggagcuguccagccuccgcuccgaggacaccgccgucuacuacugcgcccgggcggacuacuacgggagcgacuacgugaaguucgacuacuggggccaggggacccuggugaccgucuccagcgccuccacgaagggccccagcguguucccgcuggcccccuccagcaaguccaccagcggcgggaccgccgcgcucggcugccuggugaaggacuacuuccccgagcccgucaccgugagcuggaacuccggggcccugacgagcggcgugcacaccuucccggccguccuccaguccagcggccuguacucccugagcuccguggugaccguccccagcuccagccucgggacccagacguacaucugcaacgugaaccacaagcccuccaacaccaagguggacaagcgcgucgagcccaagagcugcgacaagacccacacgugcccgcccugccccgcccccgagcugcugggcgggccguccguguuccucuucccgcccaagcccaaggacacccugaugaucagccggacccccgaggugaccugcgucguggucgacgugucccacgaggaccccgaggugaaguucaacugguacgucgacggcguggaggugcacaacgccaagaccaagccccgcgaggagcaguacaacagcacguaccgggucguguccgugcugaccguccuccaccaggacuggcugaacgggaaggaguacaagugcaaggugagcaacaaggcgcugcccgccccgaucgagaagaccaucuccaaggccaagggccagccccgcgagccccagguguacacccucccgcccagccgggaggagaugacgaagaaccaggucagccugaccugccuggugaagggcuucuaccccuccgacaucgccguggagugggagagcaacgggcagcccgagaacaacuacaagaccaccccgcccguccucgacuccgacggcagcuucuuccuguacuccaagcugacgguggacaagagccgcuggcagcaggggaacguguucuccugcagcgucaugcacgaggcccuccacaaccacuacacccagaagucccugagccugucccccggcaag

SEQ ID NO: 7903 - RNA, 642 nt, Artificial Sequence
  derived and/or modified sequence opt1 from Enokizumab_LightChain1
gacauccagaugacccagagccccuccagccuguccgccagcgugggcgaccgcgucaccaucacgugcaaggccucccagcacgugaucacccacgugaccugguaccagcagaagccggggaaggcgcccaagcuccugaucuacggcaccagcuacuccuacagcgggguccccucccgguucagcggcuccgggagcggcacggacuucacccugaccaucuccagccuccagcccgaggacuucgccaccuacuacugccagcaguucuacgaguacccgcugacguucggcgggggcaccaagguggagaucaagcgcaccguggccgcccccuccgucuucaucuucccgcccagcgacgagcagcugaaguccgggaccgccagcguggugugccuccugaacaacuucuacccccgggaggcgaagguccaguggaagguggacaacgcccugcaguccggcaacagccaggagagcgugacggagcaggacuccaaggacagcaccuacucccucagcuccacccugacccugagcaaggccgacuacgagaagcacaaggucuacgccugcgaggugacgcaccaggggcucuccagccccgugaccaaguccuucaaccgcggcgagugc

SEQ ID NO: 7904 - RNA, 612 nt, Artificial Sequence
  derived and/or modified sequence opt1 from Enokizumab_LightChain
gacauccagaugacccagagccccuccagccuguccgccagcgugggcgaccgcgucaccaucacgugcaaggccucccagcacgugaucacccacgugaccugguaccagcagaagccggggaaggcgcccaagcuccugaucuacggcaccagcuacuccuacagcgggguccccucccgguucagcggcuccgggagcggcacggacuucacccugaccaucuccagccuccagcccgaggacuucgccaccuacuacugccagcaguucuacgaguacccgcugacguucggcgggggcaccaagguggagaucaagcgcaccguggccgcccccuccgucuucaucuucccgcccagcgacgagcagcugaaguccgggaccgccagcguggugugccuccugaacaacuucuacccccgggaggcgaagguccaguggaagguggaguccgugacggagcaggacagcaaggacagcaccuacucccugagcuccacccucacccugagcaaggccgacuacgagaagcacaaggucuacgccugcgaggugacgcaccagggccuguccagccccgugaccaaguccuucaaccgcggggagugc

SEQ ID NO: 7905 - RNA, 1356 nt, Artificial Sequence
  derived and/or modified sequence opt1 from Enoticumab_HeavyChain1
caggugcagcuggucgagagcggcgggggcguggugcagcccgggcgcucccuccggcugagcugcgccgccuccggcuucaccuucagcuccuacgggaugcacuggguccgccaggcgccgggcaagggccuggagugggugagcuuccucugguacgacgggaccaacaagaacuacguggaguccgucaagggccgguucacgaucagccgcgacaacuccaagaacaugcuguaccuggagaugaacagccuccgggccgaggacaccgccguguacuacugcgcccgcgaccacgacuuccgguccggguacgagggcugguucgaccccugggggcagggcacccuggugaccgucagcuccgccagcacgaagggccccuccguguucccccuggcgccgagcuccaagagcaccuccgggggcaccgccgcccucgggugccuggugaaggacuacuuccccgagcccgucaccgugagcuggaacagcggcgcccugacguccggcgugcacaccuuccccgcgguccuccagagcuccgggcuguacagccuguccagcguggugaccgucccguccagcucccucggcacccagacguacaucugcaacgugaaccacaagcccagcaacaccaagguggacaagaaggucgagcccaaguccugcgacaagacccacacgugcccgcccugccccgcccccgagcugcucgggggccccagcguguuccuguucccgcccaagcccaaggacacccugaugaucucccgcacccccgaggugaccugcgucguggucgacgugagccacgaggacccggaggugaaguucaacugguacgucgacgggguggaggugcacaacgccaagaccaagccccgggaggagcaguacaacuccacguaccgcgucgugagcgugcugaccguccuccaccaggacuggcugaacggcaaggaguacaagugcaagguguccaacaaggcccugcccgcccccaucgagaagaccaucagcaaggcgaagggccagccgcgggagccccagguguacacccucccgcccucccgcgacgagcugacgaagaaccaggucagccugaccugccucgugaagggguucuaccccagcgacaucgccguggagugggaguccaacggccagcccgagaacaacuacaagaccacgcccccgguccuggacagcgacggguccuucuuccuguacagcaagcucaccguggacaagucccgguggcagcagggcaacguguucagcugcuccgucaugcacgaggcccugcacaaccacuacacccagaagucccugagccucagccccggg

SEQ ID NO: 7906 - RNA, 642 nt, Artificial Sequence
  derived and/or modified sequence opt1 from Enoticumab_LightChain1
gagaucgugcugacccagagccccgccacccucucccugagccccggcgagcgcgccacgcuguccugccgggcgagccaguccgucagcuccuaccucgccugguaccagcagaagcccgggcaggcgccccgccugcugaucuacgacgccagcaaccgggccaccggcauccccgcccgcuucuccgggagcggcuccgggaccgacuucacccucacgaucagcucccuggagccggaggacuucgccguguacuacugccagcaccggagcaacuggccgcccaccuucggcggcgggaccaagguggagaucaagcgcaccgucgccgcccccuccguguucaucuucccgcccagcgacgagcagcugaaguccggcacggcgagcguggucugccuccugaacaacuucuacccccgggaggccaaggugcaguggaagguggacaacgcccugcaguccgggaacagccaggagagcgucaccgagcaggacuccaaggacagcaccuacucccucagcuccacccugacgcugagcaaggccgacuacgagaagcacaagguguacgccugcgaggugacccaccagggccucuccagccccgucaccaaguccuucaaccgcggggagugc

SEQ ID NO: 7907 - RNA, 1329 nt, Artificial Sequence
  derived and/or modified sequence opt1 from Ensituximab_HeavyChain1
caggugcagcugaaggagagcggccccgaccucgucgccccgucccagagccuguccaucacgugcaccgugagcggguucucccugagcaaguucggcgugaacuggguccgccagccgcccgggaagggccucgaguggcugggggugaucuggggcgacggcuccaccagcuacaacuccgggcugaucagccggcucuccaucagcaaggagaacuccaagagccagguguuccugaagcugaacucccuccaggccgacgacaccgcgaccuacuacugcgucaagcccggcggggacuacuggggccacgggaccagcgugacgguguccagcgccuccaccaagggcccgagcgucuucccccuggcccccagcuccaagagcaccuccggcgggaccgccgcccugggcugccucgugaaggacuacuuccccgagccggugacggucagcuggaacuccggggcgcugaccagcggcgugcacaccuuccccgccgugcugcaguccagcggccccuacucccucagcuccgucgugaccgugcccagcuccagccuggggacgcagaccuacaucugcaacgucaaccacaagccguccaacaccaagguggacaagaagguggagcccaagagcugcgacaagacccacacgugcccgcccugccccgcccccgagcugcucggcgggcccuccgucuuccuguucccgcccaagcccaaggacacccugaugaucagccgcacccccgaggugaccugcguggucguggacgucucccacgaggaccccgaggugaaguucaacugguacguggacggcgucgaggugcacaacgccaagacgaagccgcgggaggagcaguacaacagcaccuaccgcguggucagcgugcucaccgugcugcaccaggacuggcugaacgggaaggaguacaagugcaaggucuccaacaaggcgcuccccgcccccaucgagaagaccaucagcaaggccaagggccagccccgggagccccagguguacacgcugccgcccucccgcgacgagcugaccaagaaccaggugagccugaccugccucgucaagggcuucuaccccuccgacaucgccguggagugggagagcaacgggcagcccgagaacaacuacaagaccaugccgcccgugcuggacuccgacggcagcuucuuccucuacuccaagcugacggucgacaagagccgguggcagcaggggaacguguucuccugcagcgugaugcacgaggcccugcacaaccacuacacccagaagucccucagccugucccccggcaag

SEQ ID NO: 7908 - RNA, 639 nt, Artificial Sequence
  derived and/or modified sequence opt1 from Ensituximab_LightChain1
caggugguccugacccagagccccgugaucauguccgccagcccgggcgagaaggugaccaugacgugcuccgccagcuccagcaucuccuacauguacugguaccagcagaagcccgggaccagccccaagcgcuggaucuacgacaccuccaagcucgcgagcggcguccccgcccgguucuccgggagcggcuccgggaccagcuacucccugacgaucagcaacauggaggccggcgacgccgccaccuacuacugccaccagcgcgacuccuacccguggaccuucggcgggggcaccaaccuggagaucaagcggacgguggcggcccccagcguguucaucuucccgcccuccgacgagcagcucaagagcgggaccgccagcgucgugugccugcugaacaacuucuacccccgcgaggccaaggugcaguggaaggucgacaacgcgcuccaguccggcaacagccaggaguccgugaccgagcaggacagcaaggacuccaccuacagccuguccagcacgcugacccucuccaaggccgacuacgagaagcacaagguguacgccugcgaggucacccaccaggggcugagcucccccgugaccaagagcuucaaccggggcgagugc

SEQ ID NO: 7909 - RNA, 768 nt, Artificial Sequence; identical to SEQ ID NO: 7880
  derived and/or modified sequence opt1 from Ensituximab_SingleChain_variable_fragment

SEQ ID NO: 7910 - RNA, 987 nt, Artificial Sequence
  derived and/or modified sequence opt1 from Entolimod_chain1
augcgcggcagccaccaccaccaccaccacgggauggccuccaugaccggcgggcagcagaugggccgggaccuguacgacgacgacgacaaggaccccauggcccaggugaucaacaccaacagccucucccugcugacgcagaacaaccucaacaagagccaguccagccuguccagcgcgaucgagcgccuguccagcgggcuccggaucaacuccgccaaggacgacgccgccggccaggccaucgcgaaccgcuucaccagcaacaucaagggccugacccaggccucccggaacgccaacgacgggaucagcaucgcccagaccacggagggcgcgcugaacgagaucaacaacaaccuccagcgcguccgggagcuguccgugcaggccaccaacgggaccaacagcgacuccgaccucaagagcauccaggacgagauccagcagcgccuggaggagaucgaccggguguccaaccagacccaguucaacggcgucaaggugcugagccaggacaaccagaugaagauccaggugggggccaacgacggcgagacgaucaccaucgaccugcagaagaucgacgucaagagccucggccuggacggguucaacgugaacuccccgggcaucagcgggggcggcgggggcauccuggacuccauggggacccucaucaacgaggacgccgccgcggccaagaaguccaccgccaacccccuggccagcaucgacagcgcccuguccaagguggacgcgguccgcagcucccucggcgccauccagaaccgguucgacagcgccaucacgaaccuggggaacaccgugaccaaccugaacuccgcccgcagccggaucgaggacgccgacuacgcgaccgagguguccaacaugagcaaggcccagauccuccagcaggccggcacguccguccuggcccaggccaaccaggugccccagaacgugcugagccuccugcgc

SEQ ID NO: 7911 - RNA, 1338 nt, Artificial Sequence
  derived and/or modified sequence opt1 from Epratuzumab_HeavyChain
caggugcagcugguccagagcggcgccgaggugaagaagcccggguccagcgugaaggucuccugcaaggccagcggcuacaccuucaccuccuacuggcuccacugggugcgccaggcgccggggcagggccuggaguggaucggguacaucaacccccggaacgacuacaccgaguacaaccagaacuucaaggacaaggccaccaucaccgccgacgagagcaccaacacggccuacauggagcuguccagccuccgcuccgaggacaccgccuucuacuucugcgcgcggcgcgacaucaccaccuucuacuggggccagggcacgcuggugaccgucagcuccgccagcaccaaggggcccuccguguucccccuggccccgagcuccaagagcaccuccggcgggacggccgcgcucggcugccuggugaaggacuacuuccccgagcccgucaccgugagcuggaacuccggggcccugaccagcggcgugcacaccuuccccgccguccuccagagcuccggccuguacagccuguccagcguggugacggucccguccagcucccucgggacccagaccuacaucugcaacgugaaccacaagcccagcaacaccaagguggacaagaaggucgagcccaaguccugcgacaagacgcacacgugcccgcccugccccgcccccgagcugcugggcgggcccagcguguuccucuucccgcccaagcccaaggacacccugaugaucucccggacccccgaggugaccugcgucgugguggacgucagccacgaggacccggaggugaaguucaacugguacgucgacggcguggaggugcacaacgccaagaccaagccccgcgaggagcaguacaacuccaccuaccgggucgugagcgugcugaccguccuccaccaggacuggcugaacggcaaggaguacaagugcaagguguccaacaaggcgcugcccgcccccaucgagaagacgaucagcaaggccaaggggcagccgcgcgagccccagguguacacccucccgcccucccgggacgagcugaccaagaaccaggucagccugaccugccucgugaagggcuucuaccccuccgacaucgccguggagugggagagcaacgggcagcccgagaacaacuacaagacgacgcccccgguccuggacagcgacggcuccuucuuccuguacagcaagcucaccguggacaagucccgcuggcagcaggggaacguguucagcugcuccgucaugcacgaggcccugcacaaccacuacacccagaagucccugagccucagccccggcaag

SEQ ID NO: 7912 - RNA, 657 nt, Artificial Sequence
  derived and/or modified sequence opt1 from Epratuzumab_LightChain
gacauccagcugacccagagccccuccagccucuccgccagcgugggcgaccgcgucaccauguccugcaagagcucccagagcgugcuguacuccgccaaccacaagaacuaccuggcgugguaccagcagaagccggggaaggcccccaagcuccugaucuacugggccagcacgcgggaguccggcgugcccagccgcuucuccgggagcggcuccgggaccgacuucaccuucaccaucagcucccugcagcccgaggacaucgccacguacuacugccaccaguaccucagcuccuggaccuucggccagggcaccaaggucgagaucaagcggaccguggccgcgccgagcguguucaucuucccgcccagcgacgagcagcugaaguccgggacggccagcgucgugugccugcucaacaacuucuacccccgcgaggccaaggugcaguggaaggucgacaacgcccugcaguccggcaacagccaggaguccgugaccgagcaggacagcaaggacuccaccuacagccuguccagcacccucacgcuguccaaggcggacuacgagaagcacaagguguacgccugcgaggucacccaccaggggcugagcucccccgugaccaagagcuucaaccggggcgagugc

SEQ ID NO: 7913 - RNA, 762 nt, Artificial Sequence
  derived and/or modified sequence opt1 from Eptacog_beta_HeavyChain1
aucgugggcgggaaggucugccccaagggcgagugcccguggcagguccugcuccuggugaacggggcccagcugugcggcgggacccucaucaacaccaucuggguggugagcgccgcgcacugcuucgacaagaucaagaacuggcgcaaccugaucgccgugcugggcgagcacgaccucuccgagcacgacggcgacgagcagagccggcgcgucgcccaggugaucauccccuccacguacgugcccgggaccaccaaccacgacaucgcccugcugcggcuccaccagcccgucgugcugaccgaccacguggucccgcugugccuccccgagcgcacguucagcgagcggacccuggccuucgugcgcuucucccuggugagcggcugggggcagcuccuggaccggggcgcgaccgcccuggagcucaugguccugaacgugccccgccugaugacccaggacugccuccagcagucccggaaggugggggacagccccaacaucacggaguacauguucugcgccggcuacuccgacggcagcaaggacuccugcaagggggacagcggcgggccgcacgccacccacuaccgcggcaccugguaccugaccggcaucgucuccugggggcagggcugcgcgacgguggggcacuucggcguguacacccgggucagccaguacaucgaguggcugcagaagcucaugcgcuccgagccccggcccggggugcugcugcgcgcccccuucccg

SEQ ID NO: 7914 - RNA, 456 nt, Artificial Sequence
  derived and/or modified sequence opt1 from Eptacog_beta_LightChain1
gccaacgccuuccuggaggagcuccgccccggcagccuggagcgggagugcaaggaggagcagugcuccuucgaggaggcgcgcgagaucuucaaggacgccgagcggaccaagcuguucuggaucagcuacuccgacggggaccagugcgccagcuccccgugccagaacggcgggagcugcaaggaccagcuccaguccuacaucugcuucugccugcccgccuucgagggccgcaacugcgagacccacaaggacgaccagcugaucugcgugaacgagaacgggggcugcgagcaguacugcagcgaccacacgggcaccaagcgguccugccgcugccacgagggguacagccuccuggccgacggcgucuccugcacccccaccguggaguaccccugcgggaagaucccgauccuggagaagcggaacgcgagcaagccccagggccgc

SEQ ID NO: 7915 - RNA, 708 nt, Artificial Sequence
  derived and/or modified sequence opt1 from Erlizuab_HeavyChain1
gaggugcagcuggucgagagcggcgggggccucgugcagcccgggggcucccugcgccugagcugcgccaccuccggguacaccuucacggaguacacccacuggcggcaggccccgggcaagggccucgaguggguggcggggaucaaccccaagaacggcgggaccagccacaaccagcgcuucgaccgguucaccaucuccgucgacaagagcacguccaccgccuaccagaacagccugcgcgccgaggacaccgccguguacuacugcgcccgguggcgcggccugaacuacggguucgacgugcgguacuucgacgucuggggccagggcacccucgugacgguguccagcgcguccaccaaggggcccagcgucuucccccuggccccguccagcaaguccaccagcggcgggaccgccgcccugggcugccucgugaaggacuacuuccccgagcccgugacggucuccuggaacagcggcgcgcugaccuccggggugcacaccuuccccgccgugcugcagagcagcggccucuacucccugagcuccgucgugaccgugccgagcuccagccuggggacgcagaccuacaucugcaacgucaaccacaagcccuccaacaccaagguggacaagaagguggagcccaagagcugcgacaagacccacacgugcccgcccugccccgcccccgagcuc

SEQ ID NO: 7916 - RNA, 639 nt, Artificial Sequence
  derived and/or modified sequence opt1 from Erlizuab_LightChain1
gacauccagacccagagccccuccagccuguccgccagcgugggcgaccgggucaccaucacgugccgggccucccaggacaucaacaacuaccucaacugguaccagcagaagccggggaaggcgcccaagcugcugaucuacuacaccagcacccuccacuccggcgugcccagccgcuucuccgggagcggcuccgggaccgacuacacgcugaccaucagcucccugcagcccgaggacuucgccaccuacuacugccagcagggcaacacccucccgcccacguucggccaggggaccaagguggagaucaagcggaccgucgccgcccccagcguguucaucuucccgcccuccgacgagcagcucaagagcggcaccgccuccguggucugccugcugaacaacuucuacccccgcgaggcgaaggugcaguggaagguggacaacgcccugcagagcgggaacucccaggagagcgucacggagcaggacagcaaggacuccaccuacagccuguccagcacccucacccuguccaaggccgacuacgagaagcacaagguguacgccugcgaggugacgcaccagggccugagcucccccgucaccaagagcuucaaccgcggggagugc

SEQ ID NO: 7917 - RNA, 1341 nt, Artificial Sequence
  derived and/or modified sequence opt1 from Etaracizumab_HeavyChain1
caggugcagcuggucgagagcggcgggggcguggugcagcccgggcgcucccuccggcugagcugcgccgccuccggcuucaccuucagcuccuacgacaugagcuggguccgccaggcgccggggaagggccuggaguggguggccaagguguccagcggcgggggcuccaccuacuaccucgacacgguccaggggcgguucaccaucagccgcgacaacuccaagaacacccuguaccugcagaugaacagccuccgggccgaggacaccgccguguacuacugcgcccgccaccuccacggcuccuucgcgagcugggggcagggcacgaccgugaccgucuccagcgccuccaccaagggccccagcguguucccccuggcccccuccagcaagagcacguccgggggcaccgccgcgcuggggugccuggugaaggacuacuucccggagcccgucaccgugagcuggaacuccggcgcccugaccagcggcgugcacacguuccccgccguccuccaguccagcgggcuguacucccugagcuccguggugaccguccccagcuccagccucggcacccagaccuacaucugcaacgugaaccacaagccguccaacacgaagguggacaagcgggucgagcccaagagcugcgacaagacccacacgugcccgcccugcccggcccccgagcugcucgggggccccuccguguuccuguucccgcccaagcccaaggacacccugaugaucagccgcacccccgaggugaccugcgucguggucgacgugucccacgaggaccccgaggugaaguucaacugguacgucgacgggguggaggugcacaacgccaagaccaagccgcgggaggagcaguacaacagcaccuaccgcgucguguccgugcugacgguccuccaccaggacuggcugaacggcaaggaguacaagugcaaggugagcaacaaggcgcugcccgcccccaucgagaagaccaucagcaaggccaagggccagccccgggagccccagguguacacccucccgcccucccgcgaggagaugaccaagaaccaggucagccugacgugccuggugaagggguucuaccccuccgacaucgccguggagugggagagcaacggccagcccgagaacaacuacaagaccaccccgcccguccucgacuccgacgggagcuucuuccuguacuccaagcugaccguggacaagagccgguggcagcagggcaacguguucuccugcagcgucaugcacgaggcccuccacaaccacuacacgcagaagucccugagccugucccccgggaag

SEQ ID NO: 7918 - RNA, 642 nt, Artificial Sequence
  derived and/or modified sequence opt1 from Etaracizumab_LightChain1
gagaucgugcugacccagagccccgccacccucucccugagcccgggcgagcgcgccacgcuguccugccaggcgagccaguccaucagcaacuuccuccacugguaccagcagcggcccgggcaggcgccccgccugcugauccgguaccgcucccagagcaucuccggcauccccgcccgguucagcggguccggcagcgggaccgacuucacccucaccaucuccagccuggagccggaggacuucgccgucuacuacugccagcaguccggcagcuggccccugacguucggcgggggcaccaagguggagaucaagcgcaccguggccgcccccuccgucuucaucuucccgcccagcgacgagcagcucaaguccgggaccgccagcguggugugccugcugaacaacuucuacccccgggaggccaagguccaguggaagguggacaacgcccuccagagcggcaacucccaggagagcgugacggagcaggacuccaaggacagcaccuacucccugagcuccacccugacccucagcaaggcggacuacgagaagcacaaggucuacgccugcgaggugacgcaccaggggcuguccagccccgugaccaaguccuucaaccgcggcgagugc

SEQ ID NO: 7919 - RNA, 1326 nt, Artificial Sequence
  derived and/or modified sequence opt1 from Etrolizuab_HeavyChain1
gaggugcagcuggucgagagcggcgggggccucgugcagcccgggggcucccugcgccugagcugcgccgccuccggguucuucaucaccaacaacuacuggggcugggugcggcaggcgccgggcaaggggcucgagugggucggcuacaucagcuacuccgggagcaccuccuacaaccccagccugaagucccgcuucacgaucagccgggacaccuccaagaacaccuucuaccugcagaacagccuccgcgccgaggacaccgccguguacuacugcgcccggacgggcuccagcggguacuucgacuucuggggccagggcacccuggugaccgucuccagcgccuccaccaaggggcccagcguguucccccuggcgccguccagcaagagcacguccggcgggaccgccgcccucggcugccuggugaaggacuacuuccccgagcccgucaccgugagcuggaacuccggcgcccugaccagcggggugcacacguuccccgcgguccuccaguccagcggccuguacucccugagcuccguggugaccgucccgagcuccagccucgggacccagaccuacaucugcaacgugaaccacaagcccuccaacacgaagguggacaagaaggucgagcccaagagcugcgacaagacccacacgugcccgcccugccccgcccccgagcugcugggcgggcccuccguguuccucuucccgcccaagcccaaggacacccugaucagccgcacccccgaggugaccugcgucgugguggacgucucccacgaggacccggaggugaaguucaacugguacgucgacggcguggaggugcacaacgccaagaccaagccccgggaggagcaguacaacagcaccuaccgcgucguguccgugcugacgguccuccaccaggacuggcugaacggcaaggaguacaagugcaaggugagcaacaaggcccugcccgcccccaucgagaagaccaucagcaaggcgaaggggcagccgcgggagccccagguguacacccucccgcccucccgcgaggagaccaagaaccaggucagccugacgugccuggugaagggcuucuaccccuccgacaucgccguggagugggagagcaacgggcagcccgagaacaacuacaagaccacgcccccgguccucgacuccgacggcagcuucuuccuguacuccaagcugaccguggacaagagccgguggcagcaggggaacguguucuccugcagcguccacgaggcccuccacaaccacuacacccagaagucccugagccugucccccggc

SEQ ID NO: 7920 - RNA, 1326 nt, Artificial Sequence
  derived and/or modified sequence opt1 from Etrolizuab_HeavyChain2
gaggugcagcuggucgagagcggcgggggccucgugcagcccgggggcucccugcgccugagcugcgccgccuccggguucuucaucaccaacaacuacuggggcugggugcggcaggcgccgggcaaggggcucgagugggucggcuacaucagcuacuccgggagcaccuccuacaaccccagcaagcugucccgcuucacgaucagccgggacaccuccaagaacaccuucuaccugcagaacagccuccgcgccgaggacaccgccguguacuacugcgcccggacgggcuccagcggguacuucgacuucuggggccagggcacccuggugaccgucuccagcgccuccaccaaggggcccagcguguucccccuggcgccguccagcaagagcacguccggcgggaccgccgcccucggcugccuggugaaggacuacuuccccgagcccgucaccgugagcuggaacuccggcgcccugaccagcggggugcacacguuccccgcgguccuccaguccagcggccuguacucccugagcuccguggugaccgucccgagcuccagccucgggacccagaccuacaucugcaacgugaaccacaagcccuccaacacgaagguggacaagaaggucgagcccaagagcugcgacaagacccacacgugcccgcccugccccgcccccgagcugcugggcgggcccuccguguuccucuucccgcccaagcccaaggacacccugaucagccgcacccccgaggugaccugcgucgugguggacgucucccacgaggacccggaggugaaguucaacugguacgucgacggcguggaggugcacaacgccaagaccaagccccgggaggagcaguacaacagcaccuaccgcgucguguccgugcugacgguccuccaccaggacuggcugaacggcaaggaguacaagugcaaggugagcaacaaggcccugcccgcccccaucgagaagaccaucagcaaggcgaaggggcagccgcgggagccccagguguacacccucccgcccucccgcgaggagaccaagaaccaggucagccugacgugccuggugaagggcuucuaccccuccgacaucgccguggagugggagagcaacgggcagcccgagaacaacuacaagaccacgcccccgguccucgacuccgacggcagcuucuuccuguacuccaagcugaccguggacaagagccgguggcagcaggggaacguguucuccugcagcguccacgaggcccuccacaaccacuacacccagaagucccugagccugucccccggc

SEQ ID NO: 7921 - RNA, 639 nt, Artificial Sequence
  derived and/or modified sequence opt1 from Etrolizuab_LightChain1
gacauccagacccagagccccuccagccuguccgccagcgugggcgaccgggucaccaucacgugccgggccuccgagagcguggacgaccuccugcacugguaccagcagaagccggggaaggcgcccaagcugcucaucaaguacgccucccagagcaucuccggcgugcccagccgcuucuccgggagcggcuccgggaccgacuucacccugaccaucagcucccugcagcccgaggacuucgccacguacuacugccagcagggcaacagccucccgaacaccuucggccaggggaccaaggucgagaucaagcggaccguggccgcccccuccguguucaucuucccgcccagcgacgagcagcugaaguccggcacggcgagcgucgugugccugcucaacaacuucuacccccgcgaggccaaggugcaguggaaggucgacaacgcccugcagagcgggaacucccaggagagcgugaccgagcaggacuccaaggacagcaccuacucccugagcuccacccucacgcugagcaaggccgacuacgagaagcacaagguguacgcgugcgaggucacccaccagggccuguccagccccgugaccaaguccuucaaccgcggggagugc

SEQ ID NO: 7922 - RNA, 1338 nt, Artificial Sequence
  derived and/or modified sequence opt1 from Etrolizumab_HeavyChain1
gaggugcagcuggucgagagcggcgggggccucgugcagcccgggggcucccugcgccugagcugcgccgccuccggguucuucaucaccaacaacuacuggggcugggugcggcaggcgccgggcaaggggcucgagugggucggcuacaucagcuacuccgggagcaccuccuacaaccccagccugaagucccgcuucacgaucagccgggacaccuccaagaacaccuucuaccugcagaugaacagccuccgcgccgaggacaccgccguguacuacugcgcccggacgggcuccagcggguacuucgacuucuggggccagggcacccuggugaccgucuccagcgccuccaccaaggggcccagcguguucccccuggcgccguccagcaagagcacguccggcgggaccgccgcccucggcugccuggugaaggacuacuuccccgagcccgucaccgugagcuggaacuccggcgcccugaccagcggggugcacacguuccccgcgguccuccaguccagcggccuguacucccugagcuccguggugaccgucccgagcuccagccucgggacccagaccuacaucugcaacgugaaccacaagcccuccaacacgaagguggacaagaaggucgagcccaagagcugcgacaagacccacacgugcccgcccugccccgcccccgagcugcugggcgggcccuccguguuccucuucccgcccaagcccaaggacacccugaugaucagccgcacccccgaggugaccugcgucgugguggacgucucccacgaggacccggaggugaaguucaacugguacgucgacggcguggaggugcacaacgccaagaccaagccccgggaggagcaguacaacagcaccuaccgcgucguguccgugcugacgguccuccaccaggacuggcugaacggcaaggaguacaagugcaaggugagcaacaaggcccugcccgcccccaucgagaagaccaucagcaaggcgaaggggcagccgcgggagccccagguguacacccucccgcccucccgcgaggagaugaccaagaaccaggucagccugacgugccuggugaagggcuucuaccccuccgacaucgccguggagugggagagcaacgggcagcccgagaacaacuacaagaccacgcccccgguccucgacuccgacggcagcuucuuccuguacuccaagcugaccguggacaagagccgguggcagcaggggaacguguucuccugcagcgucaugcacgaggcccuccacaaccacuacacccagaagucccugagccugucccccggc

SEQ ID NO: 7923 - RNA, 642 nt, Artificial Sequence
  derived and/or modified sequence opt1 from Etrolizumab_LightChain1
gacauccagaugacccagagccccuccagccuguccgccagcgugggcgaccgggucaccaucacgugccgggccuccgagagcguggacgaccuccugcacugguaccagcagaagccggggaaggcgcccaagcugcucaucaaguacgccucccagagcaucuccggcgugcccagccgcuucuccgggagcggcuccgggaccgacuucacccugaccaucagcucccugcagcccgaggacuucgccacguacuacugccagcagggcaacagccucccgaacaccuucggccaggggaccaaggucgagaucaagcggaccguggccgcccccuccguguucaucuucccgcccagcgacgagcagcugaaguccggcacggcgagcgucgugugccugcucaacaacuucuacccccgcgaggccaaggugcaguggaaggucgacaacgcccugcagagcgggaacucccaggagagcgugaccgagcaggacuccaaggacagcaccuacucccugagcuccacccucacgcugagcaaggccgacuacgagaagcacaagguguacgcgugcgaggucacccaccagggccuguccagccccgugaccaaguccuucaaccgcggggagugc

SEQ ID NO: 7924 - RNA, 1359 nt, Artificial Sequence
  derived and/or modified sequence opt1 from Evinacumab_HeavyChain1
gaggugcagcuggucgagagcggcgggggcgugauccagcccgggggcucccuccgccugagcugcgccgccuccggguucaccuucgacgacuacgcgaugaacugggugcggcagggccccggcaaggggcuggagugggucagcgccaucuccggcgacgggggcagcaccuacuacgccgacuccgugaaggggcgcuucacgaucagccgggacaacuccaagaacagccucuaccugcagaugaacucccugcgcgccgaggacaccgccuucuucuacugcgcgaaggaccuccggaacaccaucuucggcguggucauccccgacgccuucgacaucuggggccaggggaccauggugacggugagcuccgccagcaccaagggccccuccgucuucccccuggccccgugcagccgcuccaccagcgaguccaccgcggcccuggggugccucgugaaggacuacuuccccgagcccgugacggucagcuggaacagcggcgcccugaccuccggcgugcacaccuuccccgccgugcugcagagcuccgggcucuacagccuguccagcgucgugaccgugccguccagcucccugggcacgaagaccuacacgugcaacgucgaccacaagcccagcaacaccaagguggacaagcggguggaguccaaguacgggccgcccugcccgcccugccccgcccccgaguuccucggcgggccgagcgucuuccuguucccgcccaagcccaaggacacccugaugaucucccgcacccccgaggugaccugcguggucguggacgucagccaggaggaccccgaggugcaguucaacugguacguggacggcgucgaggugcacaacgcgaagaccaagccccgggaggagcaguucaacuccacguaccgcguggucagcgugcucaccgugcugcaccaggacuggcugaacggcaaggaguacaagugcaaggucuccaacaaggggcuccccagcuccaucgagaagaccaucagcaaggccaagggccagccgcgggagccccagguguacacccugccgcccagccaggaggagaugacgaagaaccaggugucccugaccugccucgucaagggguucuaccccagcgacaucgccguggagugggaguccaacggccagcccgagaacaacuacaagaccaccccgcccgugcuggacagcgacggguccuucuuccuguacagccgccucacggucgacaagucccgguggcaggagggcaacguguucagcugcuccgugaugcacgaggcccugcacaaccacuacacccagaagucccugagccucagccugggcaag

SEQ ID NO: 7925 - RNA, 642 nt, Artificial Sequence
  derived and/or modified sequence opt1 from Evinacumab_LightChain1
gacauccagaugacccagagccccuccacccugagcgccuccgugggcgaccgcgucacgaucacgugccgggccagccaguccauccgcagcuggcucgcgugguaccagcagaagccggggaaggcccccaagcugcugaucuacaaggccuccagccucgaguccggcgugcccagccgguucuccgggagcggcuccgggaccgaguucacccugaccaucagcucccugcagcccgacgacuucgccaccuacuacugccagcaguacaacagcuacuccuacaccuucggccagggcaccaagcucgagaucaagcgcacgguggccgcgccgagcgucuucaucuucccgcccuccgacgagcagcucaagagcgggaccgccagcguggugugccugcugaacaacuucuacccccgggaggccaagguccaguggaagguggacaacgcccugcaguccggcaacagccaggaguccgugaccgagcaggacagcaaggacuccaccuacagccuguccagcacgcucacccuguccaaggcggacuacgagaagcacaaggucuacgccugcgaggugacccaccaggggcugagcucccccgugaccaagagcuucaaccgcggcgagugc

SEQ ID NO: 7926 - RNA, 1323 nt, Artificial Sequence
  derived and/or modified sequence opt1 from Evolocumab_HeavyChain1
gaggugcagcugguccagagcggcgccgaggugaagaagcccggggccuccgugaaggucagcugcaaggcguccggcuacacccucaccagcuacgggaucuccugggugcgccaggccccgggccaggggcuggaguggaugggcugggugagcuucuacaacggcaacacgaacuacgcccagaagcugcaggggcggggcaccaugaccaccgaccccuccacgagcaccgccuacauggagcuccgcucccugcggagcgacgacaccgccgucuacuacugcgcgcgcggguacggcauggacgugugggggcagggcaccacggugaccgucuccagcgccuccaccaagggccccagcguguucccccuggccccgugcucccggagcaccuccgagagcacggccgcgcucgggugccuggugaaggacuacuuccccgagcccgucaccguguccuggaacagcggcgcccugaccagcggggugcacaccuuccccgccguccuccaguccagcggccuguacucccugagcuccguggugacggucccgagcuccaacuucggcacccagaccuacacgugcaacguggaccacaagcccagcaacaccaagguggacaagaccgucgagcgcaagugcugcguggagugcccgcccugccccgccccgcccguggccgggcccuccgucuuccucuucccgcccaagcccaaggacacccugaugaucagccggacccccgaggugacgugcgucgugguggacgucucccacgaggaccccgaggugcaguucaacugguacguggacggcgucgaggugcacaacgcgaagaccaagccccgcgaggagcaguucaacagcaccuuccggguggucuccgugcugaccgugguccaccaggacuggcucaacgggaaggaguacaagugcaaggugagcaacaagggccugcccgcccccaucgagaagacgaucuccaagaccaaggggcagccgcgcgagccccagguguacacccugccgcccagccgggaggagaugaccaagaaccaggucucccucacgugccuggugaagggcuucuaccccagcgacaucgccguggagugggaguccaacggccagcccgagaacaacuacaagaccacgcccccgaugcuggacagcgacgggagcuucuuccucuacuccaagcugaccgucgacaagagccgcuggcagcagggcaacguguucuccugcagcgugaugcacgaggcccugcacaaccacuacacccagaagucccucagccugucccccgggaag

SEQ ID NO: 7927 - RNA, 645 nt, Artificial Sequence
  derived and/or modified sequence opt1 from Evolocumab_LightChain1
gagagcgcccugacccagcccgccuccgugagcggcuccccggggcagagcaucaccaucuccugcacgggcaccagcuccgacgucgggggcuacaacagcguguccugguaccagcagcaccccgggaaggcgcccaagcucaugaucuacgaggugagcaaccgccccuccggcgucagcaaccgguucuccggcagcaaguccgggaacaccgccagccugaccaucuccggccugcaggccgaggacgaggccgacuacuacugcaacagcuacacguccaccagcaugguguucgggggcgggaccaagcucaccgugcugggccagccgaaggccgcgcccagcgucacgcuguucccgcccuccagcgaggagcuccaggccaacaaggccacccuggugugccugaucuccgacuucuaccccggcgccgugaccgucgcguggaaggccgacagcucccccgugaaggccgggguggagaccacgacccccagcaagcaguccaacaacaaguacgccgccagcuccuaccucagccugacccccgagcaguggaagucccaccgcagcuacuccugccaggucacccacgagggcagcacgguggagaagaccguggcgccgaccgagugcucc

SEQ ID NO: 7928 - RNA, 1353 nt, Artificial Sequence
  derived and/or modified sequence opt1 from Exbivirumab_HeavyChain1
caggugcagcuggucgagagcggcgggggcguggugcagcccgggggcucccuccgccugagcugcgccccguccggguucgucuuccggagcuacggcaugcacugggugcgccagacccccggcaaggggcuggagugggugucccucaucuggcacgacggcagcaaccgguucuacgccgacuccgucaaggggcgcuucaccaucagccgggacaacuccaagaacacgcuguaccugcagaugaacagccuccgcgcggaggacaccgccauguacuucugcgcccgggagcgccugaucgccgcccccgcggccuucgaccuguggggccaggggacccucgugaccguguccagcgccuccacgaagggccccagcgucuucccgcuggcccccuccagcaaguccaccagcggcgggaccgcggcccugggcugccucgugaaggacuacuuccccgagcccgugaccgucuccuggaacagcggggcccugacgagcggcgugcacaccuucccggccgugcugcaguccagcggccucuacucccugagcuccgucgugaccgugcccagcuccagccuggggacccagacguacaucugcaacgucaaccacaagcccuccaacaccaagguggacaagcggguggagcccaagagcugcgacaagacccacacgugcccgcccugccccgcccccgagcuccugggcgggccguccgucuuccuguucccgcccaagcccaaggacacccucaugaucagccgcacccccgaggugaccugcguggucguggacgucucccacgaggaccccgaggugaaguucaacugguacguggacggcgucgaggugcacaacgcgaagaccaagccccgggaggagcaguacaacagcacguaccgcguggucuccgugcugaccgugcugcaccaggacuggcucaacgggaaggaguacaagugcaaggucagcaacaaggcccugcccgccccgaucgagaagaccaucuccaaggccaagggccagccccgggagccccagguguacacccugcccccgagccgcgaggagaugacgaagaaccaggugucccugaccugccucgucaagggcuucuaccccagcgacaucgccguggagugggagagcaacgggcagcccgagaacaacuacaagaccaccccgcccgugcuggacuccgacggcagcuucuuccucuacuccaagcugacggucgacaagagccgguggcagcaggggaacguguucuccugcagcgugaugcacgaggcgcugcacaaccacuacacccagaagucccucagccugucccccggcaag

SEQ ID NO: 7929 - RNA, 642 nt, Artificial Sequence
  derived and/or modified sequence opt1 from Exbivirumab_LightChain1
agcuacgugcugacccagcccccguccgucagcguggcccccggcaagaccgcccgcaucuccugcgggggcaacaacaucgggacgaagaacgugcacugguaccagcagaagcccggccaggcgcccguccucgugguguacgccgacagcgaccggccguccgggauccccgagcgcuucagcggcuccaacagcggcaacaccgccacccugaccaucucccgggucgaggccggggacgaggccgacuacuacugccaggugugggacagcguguccuaccacgucguguucggcgggggcacgacccugaccgugcucgggcagcccaaggcggcccccagcgucacccuguucccgcccuccagcgaggagcugcaggccaacaaggccacgcucgugugccugaucuccgacuucuaccccggcgcggugaccgucgccuggaaggccgacagcucccccgugaaggccggcguggagaccaccacgccgagcaagcaguccaacaacaaguacgccgcgagcagcuaccugucccucacccccgagcaguggaagucccaccgcagcuacagcugccaggucacccacgagggguccaccguggagaagacgguggcccccaccgagugcagc

SEQ ID NO: 7930 - RNA, 1347 nt, Artificial Sequence
  derived and/or modified sequence opt1 from Farletuzumab_HeavyChain1
gaggugcagcuggucgagagcggcgggggcguggugcagcccgggcgcucccuccggcugagcugcuccgccagcggcuucaccuucuccggguacggccugagcuggguccgccaggcccccggcaaggggcucgaguggguggcgaugaucuccagcggcggguccuacaccuacuacgccgacagcgugaagggccgguucgccaucucccgcgacaacgccaagaacacgcuguuccugcagauggacagccuccggcccgaggacaccggggucuacuucugcgcccgccacggcgacgaccccgcgugguucgccuacuggggccaggggacccccgugaccguguccagcgccuccacgaagggcccgagcgucuucccccuggcccccuccagcaaguccaccagcgggggcaccgcggcccugggcugccucgugaaggacuacuuccccgagccggugaccgucagcuggaacuccggggcccugacgagcggcgugcacaccuuccccgccgugcugcaguccagcgggcucuacucccugagcuccgucgugaccgugcccagcuccagccugggcacccagacguacaucugcaacgucaaccacaagcccuccaacaccaagguggacaagaagguggagcccaagagcugcgacaagacccacacgugcccgcccugccccgccccggagcuccucgggggccccuccgucuuccuguucccgcccaagcccaaggacacccugaugaucagccggacccccgaggugaccugcguggucguggacgucucccacgaggaccccgaggugaaguucaacugguacguggacggcgucgaggugcacaacgcgaagaccaagccccgcgaggagcaguacaacagcacguaccggguggucuccgugcugaccgugcugcaccaggacuggcucaacgggaaggaguacaagugcaaggucagcaacaaggcccugccggcccccaucgagaagaccaucuccaaggccaagggccagccccgcgagccccagguguacacccugccgcccagccgggacgagcucacgaagaaccaggugagccugaccugccuggucaagggguucuaccccuccgacaucgccguggagugggagagcaacggccagccggagaacaacuacaagaccaccccgcccgugcucgacuccgacgggagcuucuuccuguacuccaagcugacggucgacaagagccgcuggcagcagggcaacguguucuccugcagcgugaugcacgaggcgcuccacaaccacuacacccagaagucccugagccugucccccggcaag

SEQ ID NO: 7931 - RNA, 651 nt, Artificial Sequence
  derived and/or modified sequence opt1 from Farletuzumab_LightChain1
gacauccagcugacccagagccccuccagccucuccgccagcgugggcgaccgcgucaccaucacgugcuccgugagcuccagcaucuccagcaacaaccugcacugguaccagcagaagccggggaaggcccccaagcccuggaucuacggcaccuccaaccuggcgagcggggugcccucccgguucagcggcuccgggagcggcaccgacuacaccuucacgaucuccagccuccagccggaggacaucgccaccuacuacugccagcagugguccagcuaccccuacauguacaccuucggccaggggaccaaggucgagaucaagcgcacgguggccgcccccagcguguucaucuucccgcccuccgacgagcagcucaagagcggcaccgccuccgucgugugccugcugaacaacuucuacccccgggaggcgaaggugcaguggaaggucgacaacgcccugcagagcgggaacucccaggagagcgugaccgagcaggacuccaaggacagcaccuacucccugagcuccacgcucacccugagcaaggccgacuacgagaagcacaagguguacgccugcgaggucacccaccagggccuguccagccccgugaccaaguccuucaaccgcggggagugc

SEQ ID NO: 7932 - RNA, 1338 nt, Artificial Sequence
  derived and/or modified sequence opt1 from Fasinumab_HeavyChain1
caggugcagcugguccagagcggcgccgaggugaagaagcccggggccuccgugaaggucagcugcaagguguccggcuucacccucaccgagcugagcauccacugggugcgccaggcgcccgggaagggccuggaguggaugggcggguucgaccccgaggacggcgagacgaucuacgcccagaaguuccaggggcgggucaccaugaccgaggacaccuccacggacaccgccuacauggagcucaccagccugcgcuccgaggacaccgccguguacuacugcagcacgaucuucggcguggucaccaacuucgacaacugggggcagggcacccuggugaccguguccagcgccuccacgaaggggcccagcgucuucccccucgcgccgugcucccggagcaccuccgagagcaccgccgcccugggcugccuggugaaggacuacuuccccgagcccgugaccgucuccuggaacagcggcgcccucacguccggggugcacaccuuccccgcggugcugcagagcagcggccuguacucccucagcuccgucgugaccgugccgagcuccagccuggggaccaagacguacacgugcaacgucgaccacaagcccuccaacaccaagguggacaagcgcguggagagcaaguacggcccgcccugcccgcccugccccgcccccgaguuccugggcgggccguccgucuuccucuucccgcccaagcccaaggacacccugaugaucagccggacccccgaggugaccugcgucgugguggacgucucccaggaggaccccgaggugcaguucaacugguacguggacggcgucgaggugcacaacgccaagaccaagccccgcgaggagcaguucaacagcaccuaccggguggucuccgugcugacggugcuccaccaggacuggcugaacgggaaggaguacaagugcaaggucagcaacaagggccugcccuccagcaucgagaagaccaucuccaaggccaaggggcagccgcgcgagccccagguguacacccucccgcccagccaggaggagaugaccaagaaccaggugucccugacgugccuggucaagggcuucuaccccagcgacaucgccguggagugggagagcaacggccagcccgagaacaacuacaagaccaccccgcccgugcucgacuccgacgggagcuucuuccuguacucccggcugaccgucgacaagagccgcuggcaggagggcaacguguucuccugcagcgugaugcacgaggcgcuccacaaccacuacacgcagaagucccugagccugucccucgggaag

SEQ ID NO: 7933 - RNA, 642 nt, Artificial Sequence
  derived and/or modified sequence opt1 from Fasinumab_LightChain1
gacauccagaugacccagagccccuccagccuguccgccagcgccggcgaccgcgugaccaucacgugccgggcgucccaggccauccgcaacgaccucgggugguaccagcagaagccgggcaaggcccccaagcggcugaucuacgccgccuucaaccugcagagcgggguccccucccgcuucagcggcuccgggagcggcaccgaguucacccucaccaucuccagccugcagcccgaggaccuggcguccuacuacugccagcaguacaaccgguacccguggacguucggccaggggaccaagguggagaucaagcgcaccguggccgcccccagcgucuucaucuucccgcccuccgacgagcagcucaagagcggcaccgccuccguggugugccugcugaacaacuucuacccccgggaggcgaagguccaguggaagguggacaacgcccuccagagcgggaacucccaggagagcgugacggagcaggacagcaaggacuccaccuacagccuguccagcacccugacccucuccaaggccgacuacgagaagcacaaggucuacgccugcgaggugacgcaccagggccugagcucccccgugaccaagagcuucaaccgcggggagugc

SEQ ID NO: 7934 - RNA, 1350 nt, Artificial Sequence
  derived and/or modified sequence opt1 from Fezakinumab_HeavyChain1
caggugcagcugguccagagcggcgccgaggugaagaagcccggggccuccgugaaggucagcugcaaggcguccggcuacaccuucaccaacuacuacaugcacugggugcgccaggccccggggcagggccucgagugggugggguggaucaaccccuacacgggcagcgccuucuacgcccagaaguuccggggccgcgucaccaugacccgggacaccuccaucagcacggccuacauggagcugucccgccugcggagcgacgacaccgcgguguacuacugcgcccgcgagcccgagaaguucgacuccgacgacagcgacgugugggggcggggcacccucgucaccguguccagcgccuccacgaaggggcccagcguguucccgcuggcccccuccagcaaguccaccagcggcgggaccgcggcccugggcugccucgucaaggacuacuuccccgagcccgugaccguguccuggaacagcggcgcccugacgagcgggguccacaccuucccggccgugcugcaguccagcggccucuacucccugagcuccguggucaccgugcccagcuccagccuggggacccagacguacaucugcaacgugaaccacaagcccuccaacaccaaggucgacaagaagguggagcccaagagcugcgacaagacccacacgugcccgcccugccccgcccccgagcuccugggcggcccguccguguuccuguucccgcccaagcccaaggacacccucaugaucagccgcacccccgaggugaccugcgucgucguggacgugucccacgaggaccccgaggucaaguucaacugguacguggacgggguggagguccacaacgcgaagaccaagccccgggaggagcaguacaacagcacguaccgcgugguguccguccugaccgugcugcaccaggacuggcucaacggcaaggaguacaagugcaaggugagcaacaaggcccugcccgccccgaucgagaagaccaucuccaaggccaaggggcagccccgggagccccaggucuacacccugcccccgagccgcgaggagaugacgaagaaccaggugucccugaccugccucgugaagggcuucuaccccagcgacaucgccgucgagugggagagcaacgggcagcccgagaacaacuacaagaccaccccgcccgugcuggacuccgacggcagcuucuuccucuacuccaagcugacgguggacaagagccgguggcagcagggcaacgucuucuccugcagcgugaugcacgaggcgcugcacaaccacuacacccagaagucccucagccugucccccggg

SEQ ID NO: 7935 - RNA, 651 nt, Artificial Sequence
  derived and/or modified sequence opt1 from Fezakinumab_LightChain1
caggccgugcugacccagcccccgagcgucuccggcgcccccgggcagcgcgugaccaucagcugcacgggcuccagcuccaacaucggggcgggcuacggggugcacugguaccagcagcuccccggcaccgcccccaagcugcugaucuacggcgacagcaaccggccguccgggguccccgaccgcuucagcggcuccaagagcgggaccuccgccagccucgccaucaccggccugcaggccgaggacgaggcggacuacuacugccaguccuacgacaacagccuguccggguacguguucggcggcgggacgcagcucaccgugcugggccagcccaaggccgcccccagcgucacccuguucccgcccuccagcgaggagcuccaggccaacaaggcgacccuggugugccugaucuccgacuucuaccccggggccgugacggucgccuggaaggccgacagcagccccgugaaggccggcguggagaccaccaccccguccaagcagagcaacaacaaguacgcggccuccagcuaccucucccugacgcccgagcaguggaagucccaccggagcuacagcugccaggucacccacgagggcuccaccguggagaagaccguggcccccacggagugcagc

SEQ ID NO: 7936 - RNA, 1347 nt, Artificial Sequence
  derived and/or modified sequence opt1 from FG-3019_HeavyChain1
gagggccagcuggugcagagcgggggcgggcucguccaccccggcgggucccugcgccugagcugcgccggcuccggcuucaccuucagcuccuacgggaugcacugggugcggcaggccccgggcaaggggcucgagugggugagcggcaucgggaccggcggcgggacguacuccaccgacagcgucaagggccgcuucaccaucucccgggacaacgcgaagaacagccuguaccugcagaugaacucccuccgcgccgaggacauggccguguacuacugcgcccgcggggacuacuacggcagcggcuccuucuucgacugcugggggcagggcacccuggugacggucagcuccgccagcaccaaggggcccuccguguucccccuggcgcccagcuccaagagcaccagcggcgggaccgccgcccucggcugccuggugaaggacuacuucccggagcccgucacgguguccuggaacagcggcgcccugaccuccggggugcacaccuuccccgcgguccuccagagcuccggccuguacagccuguccagcguggugaccguccccuccagcucccucgggacgcagaccuacaucugcaacgugaaccacaagccgagcaacaccaagguggacaagcgggucgagcccaaguccugcgacaagacccacacgugcccgcccugcccggcccccgagcugcugggcgggcccagcguguuccucuucccgcccaagcccaaggacacccugaugaucucccggacccccgaggugaccugcgucgugguggacgucagccacgaggaccccgaggugaaguucaacugguacgucgacggcguggaggugcacaacgccaagacgaagccgcgcgaggagcaguacaacuccaccuaccgggucgugagcgugcugaccguccuccaccaggacuggcugaacggcaaggaguacaagugcaagguguccaacaaggcccugcccgcccccaucgagaagaccaucagcaaggcgaaggggcagccccgcgagccccagguguacacgcucccgcccagccgggaggagaugaccaagaaccaggucucccugaccugccuggugaagggcuucuaccccagcgacaucgccguggagugggaguccaacgggcagcccgagaacaacuacaagaccacgccgcccguccucgacagcgacggcuccuucuuccuguacagcaagcugaccguggacaagucccgcuggcagcaggggaacguguucagcugcuccgucaugcacgaggcccuccacaaccacuacacccagaagucccugagccugagccccggc

SEQ ID NO: 7937 - RNA, 642 nt, Artificial Sequence
  derived and/or modified sequence opt1 from FG-3019_LightChain1
gacauccagaugacccagagccccuccagccuguccgccagcgugggcgaccgcgucaccaucacgugccgggccucccaggggaucagcuccuggcucgcgugguaccagcagaagccggagaaggcccccaagagccugaucuacgccgccuccagccugcaguccggcgugcccagccgcuucuccgggagcggcuccgggaccgacuucacccucaccaucagcucccugcagcccgaggacuucgccacguacuacugccagcaguacaacagcuacccgcccaccuucggccagggcaccaagcuggagaucaagcggaccguggcggcccccuccgucuucaucuucccgcccagcgacgagcagcucaagagcgggacggccuccguggugugccugcugaacaacuucuacccccgcgaggccaagguccaguggaagguggacaacgcgcuccagagcggcaacucccaggagagcgugaccgagcaggacuccaaggacagcaccuacucccugagcuccacccugacgcucagcaaggccgacuacgagaagcacaaggucuacgccugcgaggugacccaccaggggcuguccagccccgugaccaaguccuucaaccggggcgagugc

SEQ ID NO: 7938 - RNA, 1344 nt, Artificial Sequence
  derived and/or modified sequence opt1 from Fibatuzumab_HeavyChain1
caggugcagcugguccagagcggcgccgaggugaagaagcccggggccuccgugaaggucagcugcaaggcguccggcuacaccuucaccggguacuggaugaacugggugcgccaggccccgggccaggggcucgaguggaugggcgacaucuaccccggcagcgggaacacgaacuacgacgagaaguuccagggccgggugaccaugacccgcgacaccuccaucagcacggccuacauggagcugucccggcugcgcagcgacgacaccgccgucuacuacugcgcccgcgggggcuacuacgaggacuucgacuccugggggcagggcaccaccgugacggugagcuccgcgagcaccaagggccccuccgucuucccccucgccccgagcuccaagagcaccuccgggggcaccgccgcccuggggugccuggugaaggacuacuuccccgagcccgugacggucagcuggaacuccggcgcgcucaccagcggcgugcacaccuuccccgccgugcugcagagcuccgggcuguacagccucuccagcgucgugaccgugccguccagcucccugggcacgcagaccuacaucugcaacgucaaccacaagcccagcaacaccaagguggacaagcggguggagcccaaguccugcgacaagacccacacgugcccgcccugccccgcccccgagcugcucgggggccccagcgucuuccuguucccgcccaagcccaaggacacccugaugaucucccggacccccgaggugaccugcguggucguggacgucagccacgaggacccggaggugaaguucaacugguacguggacggggucgaggugcacaacgccaagacgaagccccgcgaggagcaguacaacuccaccuaccggguggucagcgugcucaccgugcugcaccaggacuggcugaacggcaaggaguacaagugcaaggucuccaacaaggcccuccccgcgcccaucgagaagaccaucagcaaggccaagggccagccgcgcgagccccagguguacacgcugccgcccucccgggaggagaugaccaagaaccaggugagccugaccugccucgucaagggguucuaccccuccgacaucgccguggagugggagagcaacggccagcccgagaacaacuacaagaccacgcccccggugcuggacagcgacggguccuucuuccuguacagcaagcucaccgucgacaagucccgcuggcagcagggcaacguguucagcugcuccgugaugcacgaggcccugcacaaccacuacacccagaagucccugagccucagccccgggaag

SEQ ID NO: 7939 - RNA, 642 nt, Artificial Sequence
  derived and/or modified sequence opt1 from Fibatuzumab_LightChain1
gacauccagaugacccagagccccuccuuccugagcgccuccgugggcgaccgcgucaccaucacgugccgggccagccaggggaucaucuccuaccucgcgugguaccagcagaagccggagaaggcccccaagcgccugaucuacgccgccagcucccugcagagcggcgugcccucccgguucagcggguccggcagcgggaccgaguucacccucaccaucuccagccugcagcccgaggacuucgccacguacuacugcggccaguacgcgaacuacccguacaccuucggccaggggaccaagcuggagaucaagcgcaccguggccgcccccuccgucuucaucuucccgcccagcgacgagcagcucaaguccggcacggccagcguggugugccugcugaacaacuucuacccccgggaggcgaagguccaguggaagguggacaacgcccuccaguccgggaacagccaggagagcgugaccgagcaggacuccaaggacagcaccuacucccugagcuccacccugacgcucagcaaggccgacuacgagaagcacaaggucuacgccugcgaggugacccaccagggccuguccagccccgugaccaaguccuucaaccgcggggagugc

SEQ ID NO: 7940 - RNA, 1344 nt, Artificial Sequence
  derived and/or modified sequence opt1 from Ficlatuzumab_HeavyChain1
caggugcagcugguccagcccggcgccgaggugaagaagccggggaccagcgugaagcucuccugcaaggccagcggcuacaccuucacgaccuacuggaugcacuggguccgccaggcgcccgggcagggccuggaguggaucggggagaucaaccccaccaacggccacaccaacuacaaccagaaguuccagggccgggccacgcugaccguggacaaguccaccagcaccgccuacauggagcucuccagccugcgcuccgaggacacggccguguacuacugcgcccggaacuacgucgggagcaucuucgacuacuggggccaggggacccugcucaccguguccagcgcguccaccaagggccccagcguguucccgcuggcccccuccagcaaguccacgagcgggggcaccgccgcccugggcugccucgucaaggacuacuuccccgagcccgugaccguguccuggaacagcggggcgcugaccuccggcguccacacguucccggccgugcugcagagcagcgggcucuacucccugagcuccguggucaccgugcccagcuccagccugggcacccagaccuacaucugcaacgugaaccacaagcccuccaacacgaaggucgacaagcgcguggagcccaagagcugcgacaagacccacacgugcccgcccugccccgcccccgagcuccugggcgggccguccguguuccuguucccgcccaagcccaaggacacccucaugaucagccggacccccgaggugaccugcgucguggucgacgugucccacgaggaccccgaggucaaguucaacugguacguggacggcguggagguccacaacgccaagaccaagccccgcgaggagcaguacaacagcaccuaccgggugguguccguccugacggugcugcaccaggacuggcucaacgggaaggaguacaagugcaaggugagcaacaaggcccugcccgcgccgaucgagaagaccaucuccaaggccaagggccagccccgcgagccccaggucuacacccugcccccgagccgggaggagaugaccaagaaccaggugucccucacgugccuggugaagggguucuaccccagcgacaucgccgucgagugggaguccaacggccagcccgagaacaacuacaagaccaccccgcccgugcuggacagcgacggcagcuucuuccucuacuccaagcugaccguggacaagagccgcuggcagcaggggaacgucuucuccugcagcgugaugcacgaggcccugcacaaccacuacacgcagaagucccucagccugucccccggcaag

SEQ ID NO: 7941 - RNA, 1341 nt, Artificial Sequence
  derived and/or modified sequence opt1 from Ficlatuzumab_HeavyChain
gugcagcugguccagcccggcgccgaggugaagaagccggggaccagcgugaagcucuccugcaaggccagcggcuacaccuucacgaccuacuggaugcacuggguccgccaggcgcccgggcagggccuggaguggaucggggagaucaaccccaccaacggccacaccaacuacaaccagaaguuccagggccgggccacgcugaccguggacaaguccaccagcaccgccuacauggagcucuccagccugcgcuccgaggacacggccguguacuacugcgcccggaacuacgucgggagcaucuucgacuacuggggccaggggacccugcucaccguguccagcgcguccaccaagggccccagcguguucccgcuggcccccuccagcaaguccacgagcgggggcaccgccgcccugggcugccucgucaaggacuacuuccccgagcccgugaccguguccuggaacagcggggcgcugaccuccggcguccacacguucccggccgugcugcagagcagcgggcucuacucccugagcuccguggucaccgugcccagcuccagccugggcacccagaccuacaucugcaacgugaaccacaagcccuccaacacgaaggucgacaagcgcguggagcccaagagcugcgacaagacccacacgugcccgcccugccccgcccccgagcuccugggcgggccguccguguuccuguucccgcccaagcccaaggacacccucaugaucagccggacccccgaggugaccugcgucguggucgacgugucccacgaggaccccgaggucaaguucaacugguacguggacggcguggagguccacaacgccaagaccaagccccgcgaggagcaguacaacagcaccuaccgggugguguccguccugacggugcugcaccaggacuggcucaacgggaaggaguacaagugcaaggugagcaacaaggcccugcccgcgccgaucgagaagaccaucuccaaggccaagggccagccccgcgagccccaggucuacacccugcccccgagccgggaggagaugaccaagaaccaggugucccucacgugccuggugaagggguucuaccccagcgacaucgccgucgagugggaguccaacggccagcccgagaacaacuacaagaccaccccgcccgugcuggacagcgacggcagcuucuuccucuacuccaagcugaccguggacaagagccgcuggcagcaggggaacgucuucuccugcagcgugaugcacgaggcccugcacaaccacuacacgcagaagucccucagccugucccccggcaag

SEQ ID NO: 7942 - RNA, 642 nt, Artificial Sequence
  derived and/or modified sequence opt1 from Ficlatuzumab_LightChain1
gacaucgugaugacccagagccccgacucccuggccaugagccucggcgagcgggucacccugaacugcaaggccuccgagaacguggugagcuacgucuccugguaccagcagaagccggggcagagccccaagcugcucaucuacggcgcguccaaccgggagagcggggugcccgaccgcuucuccggcagcggguccgccacggacuucacccugaccaucagcuccgugcaggccgaggacgucgccgacuaccacugcggccagagcuacaacuaccccuacaccuucggccaggggacgaagcuggagaucaagcggaccguggccgcgccguccguguucaucuucccgcccagcgacgagcagcucaaguccggcaccgccagcgucgugugccugcugaacaacuucuacccccgcgaggccaaggugcaguggaaggucgacaacgcccuccaguccgggaacagccaggagagcgugaccgagcaggacuccaaggacagcacguacucccugagcuccacccugacccucagcaaggcggacuacgagaagcacaagguguacgccugcgaggucacccaccagggccuguccagccccgugacgaaguccuucaaccgcggggagugc

SEQ ID NO: 7943 - RNA, 1350 nt, Artificial Sequence
  derived and/or modified sequence opt1 from Figitumumab_HeavyChain1
gaggugcagcugcucgagagcggcgggggccugguccagcccgggggcucccugcgccucagcugcaccgccuccggguucaccuucagcuccuacgccaugaacugggugcggcaggcgccgggcaagggccuggagugggugagcgccaucuccgggagcggcgggacgaccuucuacgccgacuccgucaagggccgcuucaccaucagccgggacaacucccgcaccacgcuguaccuccagaugaacagccugcgggccgaggacaccgccguguacuacugcgcgaaggaccuggggugguccgacagcuacuacuacuacuacggcauggacguguggggccaggggaccaccgucacgguguccagcgccuccaccaagggccccagcguguucccccucgcccccugcucccgcagcaccagcgaguccaccgccgcgcuggggugccuggucaaggacuacuucccggagcccgugacggugagcuggaacuccggcgcccucaccagcggcguccacaccuuccccgccgugcugcaguccagcgggcuguacucccucagcuccguggucaccgugcccagcuccaacuucggcacgcagaccuacacgugcaacguggaccacaagccgagcaacaccaaggucgacaagaccguggagcggaagugcugcguggagugcccgcccugccccgccccgcccgucgccgggcccuccguguuccuguucccgcccaagcccaaggacacccugaugaucagccgcacccccgaggugaccugcgucguggucgacgugucccacgaggaccccgaggugcaguucaacugguacgucgacggcguggaggugcacaacgcgaagacgaagccccgggaggagcaguucaacagcaccuuccgcgucguguccgugcucaccgucgugcaccaggacuggcugaacgggaaggaguacaagugcaaggugagcaacaagggccugcccgcccccaucgagaagaccaucuccaagacgaagggccagccccgggagccgcaggucuacacccucccgcccagccgcgaggagaugaccaagaaccaggugagccugaccugccuggugaagggguucuaccccuccgacaucgccgucgagugggagagcaacggccagcccgagaacaacuacaagacgaccccgcccaugcucgacuccgacgggagcuucuuccuguacuccaagcugaccguggacaagagccgguggcagcagggcaacguguucuccugcagcgucaugcacgaggcccuccacaaccacuacacccagaagucccugagccugucccccggg

SEQ ID NO: 7944 - RNA, 642 nt, Artificial Sequence
  derived and/or modified sequence opt1 from Figitumumab_LightChain1
gacauccagaugacccaguuccccagcucccugagcgccuccgugggcgaccgcgucaccaucacgugccgggccagccaggggauccgcaacgaccucggcugguaccagcagaagccggggaaggcgcccaagcggcugaucuacgccgccucccgccugcaccggggcgugcccagccgcuucuccgggagcggcuccggcaccgaguucacccucaccaucagcucccugcagcccgaggacuucgccacguacuacugccugcagcacaacagcuacccgugcuccuucgggcagggcaccaagcucgagaucaagcggaccguggccgcgcccagcgucuucaucuucccgcccuccgacgagcagcucaagagcgggaccgccuccguggugugccugcugaacaacuucuacccccgcgaggccaagguccaguggaagguggacaacgcccugcagagcggcaacucccaggagagcgugacggagcaggacagcaaggacuccaccuacagccuguccagcacccucacccuguccaaggcggacuacgagaagcacaaggucuacgccugcgaggugacgcaccaggggcugagcucccccgugaccaagagcuucaaccggggcgagugc

SEQ ID NO: 7945 - RNA, 1359 nt, Artificial Sequence
  derived and/or modified sequence opt1 from Firivumab_HeavyChain1
caggugcagcugguccagagcggcgccgaggugaagaugcccggguccagcgugaaggucuccugcaagaccagcggcguguucuucuccagccacgccaucuccugggugcgccaggcgcccgggcagggccucgaguggaugggcgggaucagccccauguucggcaccacgcacuacgcccagaaguuccaggggcgggucaccaucaccgccgaccaguccaccacgaccgccuacauggagcugaccagccugaccuccgaggacacggccguguacuacugcgcgcgcgacggcgccgggagcuacuacccccucaacugguucgaccccuggggccaggggacccuggugaccgucuccagcgccuccaccaagggcccgagcguguucccccuggcccccuccagcaaguccacgagcggcgggaccgcggcccucggcugccuggugaaggacuacuuccccgagccggucaccgugagcuggaacuccggggcccugaccagcggcgugcacacguuccccgccguccuccaguccagcggccuguacucccugagcuccguggugaccguccccagcuccagccucgggacccagaccuacaucugcaacgugaaccacaagcccuccaacacgaagguggacaagcgggucgagcccaagagcugcgacaagacccacacgugcccgcccugccccgccccggagcugcugggcgggcccuccguguuccucuucccgcccaagcccaaggacacccugaugaucagccgcacccccgaggugaccugcgucguggucgacgugucccacgaggaccccgaggugaaguucaacugguacgucgacggcguggaggugcacaacgcgaagaccaagccccgggaggagcaguacaacagcaccuaccgcgucguguccgugcugacgguccuccaccaggacuggcugaacgggaaggaguacaagugcaaggugagcaacaaggcccugccggcccccaucgagaagaccaucuccaaggccaagggccagccccgggagccccagguguacacccucccgcccagccgcgacgagcugaccaagaaccaggucagccugacgugccucgugaagggcuucuaccccuccgacaucgccguggagugggagagcaacgggcagccggagaacaacuacaagaccaccccgcccguccuggacuccgacggcagcuucuuccuguacuccaagcucaccguggacaagagccgguggcagcaggggaacguguucuccugcagcgucaugcacgagggccugcacaaccacuacacgcagaagucccugagccucucccccgggaag

SEQ ID NO: 7946 - RNA, 642 nt, Artificial Sequence
  derived and/or modified sequence opt1 from Firivumab_LightChain1
gagaucgugcugacccagagccccgccacccucucccugagcccgggcgagcgggccacgcuguccugccgggcgagcgagaacaucuggaacaaccucgccugguaccagcagaagcccgggcaggcgccccgccugcugaucuccggcgccagcaccggggccaccggcguccccucccgguuccgcgggagcggcucccggaccgaguucacgcucaccaucagcucccugcagagcgaggacuucgccaucuacuucugccagcaguacaacuccuggccgcgcaccuucggccccgggaccaagguggagaucaagcggacgguggccgcccccagcgucuucaucuucccgcccuccgacgagcagcucaagagcggcaccgccuccguggugugccugcugaacaacuucuacccccgcgaggcgaagguccaguggaagguggacaacgcccugcagagcgggaacucccaggagagcgugaccgagcaggacagcaaggacuccaccuacagccucuccagcacgcugacccuguccaaggccgacuacgagaagcacaaggucuacgccugcgaggugacccaccagggccucagcucccccgugaccaagagcuucaaccgcggggagugc

SEQ ID NO: 7947 - RNA, 1347 nt, Artificial Sequence
  derived and/or modified sequence opt1 from Flanvotumab_HeavyChain1
caggugcagcugguccagagcggcuccgagcucaagaagcccggggccagcgugaagaucuccugcaaggccagcggcuacaccuucaccuccuacgcgaugaacugggugcgccaggccccggggcagggccuggagagcaugggguggaucaacacgaacaccggcaaccccaccuacgcccagggcuucaccgggcgguucgucuucuccauggacacgagcguguccaccgccuaccugcagaucagcucccucaaggccgaggacaccgcgaucuacuacugcgcgccccgcuacagcuccagcugguaccuggacuacuggggccaggggacccuggugacggucuccagcgccuccaccaagggccccagcguguucccgcucgcccccuccagcaagagcaccuccgggggcaccgccgcccugggcugccuggugaaggacuacuuccccgagcccgucacggugagcuggaacuccggggcccucaccagcggcgugcacaccuucccggccguccugcaguccagcgggcuguacucccucagcuccguggugaccguccccagcuccagccugggcacgcagaccuacaucugcaacgugaaccacaagcccuccaacaccaagguggacaagcgggucgagcccaagagcugcgacaagacccacacgugcccgcccugccccgcccccgagcugcucggcgggccguccguguuccuguucccgcccaagcccaaggacacccugaugaucagccgcacccccgaggugaccugcgucgugguggacgucucccacgaggaccccgaggugaaguucaacugguacgucgacggcguggaggugcacaacgcgaagacgaagccccgggaggagcaguacaacagcaccuaccgcgucguguccgugcucaccguccugcaccaggacuggcugaacgggaaggaguacaagugcaaggugagcaacaaggcccuccccgccccgaucgagaagaccaucagcaaggccaagggccagccccgggagccccagguguacacgcugcccccgucccgcgaggagaugaccaagaaccaggucagccugaccugccucgugaagggguucuaccccuccgacaucgccguggagugggagagcaacggccagcccgagaacaacuacaagaccacgccgcccguccuggacuccgacggcagcuucuuccuguacuccaagcucaccguggacaagagccgguggcagcaggggaacguguucuccugcagcgucaugcacgaggcgcugcacaaccacuacacccagaagucccugagccucucccccggcaag

SEQ ID NO: 7948 - RNA, 645 nt, Artificial Sequence
  derived and/or modified sequence opt1 from Flanvotumab_LightChain1
gagaucgugcugacccagagccccgccacccucucccugagcccgggcgagcgcgccacgcuguccugccgggcgagccaguccgucagcuccuaccucgccugguaccagcagaagcccgggcaggcgccccgccugcugaucuacgacgccagcaaccgggccaccggcauccccgcccgcuucuccgggagcggcuccgggaccgacuucacccucacgaucagcucccuggagccggaggacuucgccguguacuacugccagcagcggagcaacuggcugauguacaccuucggccagggcaccaagcucgagaucaagcgcaccguggccgcccccuccgucuucaucuucccgcccagcgacgagcagcugaaguccgggacggcgagcguggugugccugcucaacaacuucuacccccgggaggccaagguccaguggaagguggacaacgcccugcaguccggcaacagccaggagagcgugaccgagcaggacuccaaggacagcaccuacucccugagcuccacccucacgcugagcaaggccgacuacgagaagcacaaggucuacgccugcgaggugacccaccaggggcuguccagccccgugaccaaguccuucaaccgcggcgagugc

SEQ ID NO: 7949 - RNA, 1362 nt, Artificial Sequence
  derived and/or modified sequence opt1 from Fletikumab_HeavyChain1
caggugcagcugguccagagcggcgccgaggugaagcgccccggggccuccgugaaggucagcugcaaggcguccggcuacaccuucaccaacgacaucauccacugggugcggcaggccccggggcagcgccucgaguggaugggcuggaucaacgccggguacggcaacacgcaguacagccagaacuuccaggaccggguguccaucacccgcgacaccagcgccuccaccgccuacauggagcugaucagccugcgguccgaggacacggcggucuacuacugcgcccgcgagccccucugguucggcgagagcagcccccacgacuacuacgggauggacguguggggccaggggaccaccgugaccgucagcuccgccagcacgaagggccccuccguguucccgcuggcccccugcagccgguccaccagcgaguccaccgcggcccuggggugccucgugaaggacuacuuccccgagcccgucaccgugagcuggaacagcggcgcccugacguccggcgugcacaccuucccggccguccugcagagcuccgggcucuacagccuguccagcguggugaccguccccuccagcucccugggcaccaagacguacacgugcaacguggaccacaagcccagcaacaccaagguggacaagcgcgucgaguccaaguacgggcccccgugcccgcccugccccgcccccgaguuccucggcggccccagcguguuccuguucccgcccaagcccaaggacacccugaugaucucccggacccccgaggugaccugcgucguggucgacgugagccaggaggaccccgaggugcaguucaacugguacgucgacgggguggaggugcacaacgcgaagaccaagccccgcgaggagcaguucaacuccaccuaccgggucgugagcgugcucacgguccugcaccaggacuggcugaacggcaaggaguacaagugcaagguguccaacaaggggcucccgagcuccaucgagaagaccaucagcaaggccaagggccagccccgcgagccccagguguacacccugcccccgagccaggaggagaugaccaagaaccaggucucccugacgugccucgugaagggguucuaccccagcgacaucgccguggagugggaguccaacggccagcccgagaacaacuacaagaccaccccgcccguccuggacagcgacggcuccuucuuccuguacagccggcucaccguggacaagucccgcuggcaggaggggaacguguucagcugcuccgucaugcacgaggcccugcacaaccacuacacgcagaagucccugucccucagccugggcaag

SEQ ID NO: 7950 - RNA, 642 nt, Artificial Sequence
  derived and/or modified sequence opt1 from Fletikumab_LightChain1
gccauccagcugacccagagccccuccagccucuccgccagcgugggcgaccgcgucaccaucacgugccgggcgucccaggggaucagcuccgcccuggccugguaccagcagaagccgggcaaggcccccaagcugcucaucuacgacgccagcucccuggagagcggggugcccucccgcuucagcggcuccgggagcggcaccgacuucacccugaccaucuccagccuccagcccgaggacuucgcgacguacuacugccagcaguucaacuccuacccgcugaccuucggcgggggcaccaagguggagaucaagcggaccgucgccgcccccagcguguucaucuucccgcccuccgacgagcagcucaagagcgggacggccagcguggucugccugcugaacaacuucuacccccgcgaggcgaaggugcaguggaagguggacaacgcccugcaguccggcaacagccaggaguccgucaccgagcaggacagcaaggacuccaccuacagccucuccagcacccugacgcuguccaaggccgacuacgagaagcacaagguguacgccugcgaggugacccaccaggggcucagcucccccgucaccaagagcuucaaccggggcgagugc

SEQ ID NO: 7951 - RNA, 1341 nt, Artificial Sequence
  derived and/or modified sequence opt1 from Fontolizumab_HeavyChain1
caggugcagcugguccagagcggcgccgagcucaagaagcccggguccagcgugaagguguccugcaaggccagcggcuacaucuucaccuccagcuggaucaacugggucaagcaggcgccggggcagggccuggaguggaucgggcgcaucgaccccuccgacggcgaggugcacuacaaccaggacuucaaggacaaggccacccugacgguggacaagagcaccaacaccgccuacauggagcucuccagccugcgguccgaggacaccgccgucuacuacugcgcccgcggcuuccugcccugguucgcggacugggggcagggcacgcucgugaccgugagcuccgccagcaccaaggggcccuccgucuucccgcuggcccccagcuccaagagcaccuccggcgggacggccgcgcugggcugccucgugaaggacuacuuccccgagcccgugaccgucagcuggaacagcggcgcccugaccuccggggugcacaccuucccggccgugcugcagagcuccggccucuacagccuguccagcgucgugacggugcccuccagcucccuggggacccagaccuacaucugcaacgucaaccacaagcccagcaacaccaagguggacaagaagguggagcccaaguccugcgacaagacgcacacgugcccgcccugccccgcccccgagcuccugggcggcccgagcgucuuccuguucccgcccaagcccaaggacacccucaugaucucccggacccccgaggugaccugcguggucguggacgucagccacgaggaccccgaggugaaguucaacugguacguggacggggucgaggugcacaacgccaagaccaagccccgcgaggagcaguacaacuccaccuaccggguggucagcgugcugaccgugcugcaccaggacuggcucaacggcaaggaguacaagugcaaggucuccaacaaggcgcugcccgccccgaucgagaagacgaucagcaaggccaaggggcagccccgcgagccccagguguacacccugcccccgucccgggacgagcucaccaagaaccaggugagccugaccugccuggucaagggcuucuaccccagcgacaucgccguggagugggaguccaacgggcagcccgagaacaacuacaagacgaccccgcccgugcucgacagcgacggcuccuucuuccuguacagcaagcugaccgucgacaagucccgcuggcagcagggcaacguguucagcugcuccgugaugcacgaggcccuccacaaccacuacacccagaagucccugagccugagccccgggaag

SEQ ID NO: 7952 - RNA, 642 nt, Artificial Sequence
  derived and/or modified sequence opt1 from Fontolizumab_LightChain1
gacauccagaugacccagagccccuccacccugagcgccuccgugggcgaccgcgucacgaucacgugcaaggccagcgagaacguggacaccuacguguccugguaccagcagaagccggggaaggcgcccaagcuccugaucuacggcgccagcaaccgguacaccgggguccccucccgcuucagcggcuccgggagcggcaccgacuucacccugaccaucuccagccuccagcccgacgacuucgccaccuacuacugcggccaguccuacaacuacccguucacguucgggcagggcaccaagguggaggugaagcggaccgucgccgcccccagcguguucaucuucccgcccuccgacgagcagcucaagagcgggaccgcguccguggucugccugcugaacaacuucuacccccgcgaggccaaggugcaguggaagguggacaacgcccugcagagcggcaacucccaggagagcgucacggagcaggacagcaaggacuccaccuacagccuguccagcacccucacccuguccaaggccgacuacgagaagcacaagguguacgcgugcgaggugacgcaccaggggcugagcucccccgucaccaagagcuucaaccggggcgagugc

SEQ ID NO: 7953 - RNA, 1344 nt, Artificial Sequence
  derived and/or modified sequence opt1 from Foralumab_HeavyChain1
caggugcagcuggucgagagcggcgggggcguggugcagcccgggcgcucccuccggcugagcugcgccgccuccggcuucaaguucagcggguacggcaugcacuggguccgccaggcgccgggcaaggggcuggaguggguggccgugaucugguacgacggcuccaagaaguacuacgucgacagcgugaaggggcgguucaccaucucccgcgacaacagcaagaacacccucuaccugcagaugaacucccugcgggccgaggacacggccguguacuacugcgcccgccagaugggcuacuggcacuucgaccucugggggcggggcacccuggucaccgugagcuccgcgagcaccaagggccccuccguguucccccuggcccccagcuccaagagcacguccgggggcaccgccgcccucgggugccuggucaaggacuacuucccggagcccgugaccgugagcuggaacuccggcgcgcugaccagcggcguccacacguuccccgccgugcuccagagcuccgggcuguacagccuguccagcguggucaccgugcccuccagcucccucggcacccagaccuacaucugcaacgugaaccacaagccgagcaacacgaaggucgacaagcgcguggagcccaaguccugcgacaagacccacacgugcccgcccugccccgcccccgaggccgagggcgggcccagcguguuccuguucccgcccaagcccaaggacacccugaugaucucccggacccccgaggugaccugcgucgucguggacgugagccacgaggaccccgaggucaaguucaacugguacguggacgggguggagguccacaacgccaagaccaagccgcgcgaggagcaguacaacuccaccuaccggguggugagcguccucacggugcugcaccaggacuggcugaacggcaaggaguacaagugcaagguguccaacaaggcgcuccccgcccccaucgagaagaccaucagcaaggccaagggccagccccgcgagccgcaggucuacacccugccgcccucccgggaggagaugaccaagaaccaggugagccugacgugccucgugaagggguucuaccccuccgacaucgccgucgagugggagagcaacggccagcccgagaacaacuacaagaccaccccgcccgugcuggacagcgacggguccuucuuccuguacagcaagcucaccguggacaagucccgcuggcagcagggcaacgucuucagcugcuccgugaugcacgaggcccugcacaaccacuacacgcagaagucccugagccucagccccgggaag

SEQ ID NO: 7954 - RNA, 645 nt, Artificial Sequence
  derived and/or modified sequence opt1 from Foralumab_LightChain1
gagaucgugcugacccagagccccgccacccucucccugagccccggcgagcgcgccacgcuguccugccgggcgagccaguccgucagcuccuaccucgccugguaccagcagaagcccgggcaggcgccccgccugcugaucuacgacgccagcaaccgggccaccggcauccccgcccgcuucuccgggagcggcuccgggaccgacuucacccucacgaucagcucccuggagccggaggacuucgccguguacuacugccagcagcggagcaacuggccgccccugaccuucggcggcgggaccaagguggagaucaagcgcaccgucgccgcccccuccguguucaucuucccgcccagcgacgagcagcucaaguccggcacggcgagcguggucugccugcugaacaacuucuacccccgggaggccaaggugcaguggaagguggacaacgcccuccaguccgggaacagccaggagagcgucaccgagcaggacuccaaggacagcaccuacucccugagcuccacccugacgcucagcaaggccgacuacgagaagcacaagguguacgccugcgaggugacccaccagggccuguccagccccgucaccaaguccuucaaccgcggggagugc

SEQ ID NO: 7955 - RNA, 1344 nt, Artificial Sequence
  derived and/or modified sequence opt1 from Foravirumab_HeavyChain1
caggugcagcuggucgagagcggcgggggcgccgugcagcccgggcgcucccuccggcugagcugcgccgcguccggcuucaccuucagcuccuacgggaugcacugggugcgccaggccccgggcaagggccuggagugggucgccgugauccucuacgacgggagcgacaaguucuacgccgacuccgugaagggccgguucaccaucagccgcgacaacuccaagaacacgcuguaccugcagaugaacagccuccgggccgaggacaccgcggucuacuacugcgccaagguggccguggccgggacccacuucgacuacuggggccaggggacccuggucacgguguccagcgcguccaccaagggccccagcguguucccccuggcccccuccagcaaguccaccagcggcgggaccgccgcccucggcugccuggucaaggacuacuucccggagcccgugacgguguccuggaacagcggggcccugaccagcggcguccacaccuuccccgcggugcuccaguccagcggccuguacucccugagcuccguggucaccgugcccagcuccagccucgggacgcagaccuacaucugcaacgugaaccacaagccguccaacaccaaggucgacaagcgcguggagcccaagagcugcgacaagacccacacgugcccgcccugccccgcccccgagcugcugggcgggcccuccguguuccucuucccgcccaagcccaaggacacccugaugaucagccggacccccgaggugaccugcgucgucguggacgugucccacgaggaccccgaggucaaguucaacugguacguggacggcguggagguccacaacgccaagacgaagccgcgcgaggagcaguacaacagcaccuaccgggugguguccguccugaccgugcuccaccaggacuggcugaacgggaaggaguacaagugcaaggugagcaacaaggcccugcccgcccccaucgagaagaccaucuccaaggcgaagggccagccccgcgagccgcaggucuacacgcucccgcccagccgggaggagaugaccaagaaccaggugucccugaccugccuggugaagggcuucuaccccagcgacaucgccgucgagugggagagcaacgggcagcccgagaacaacuacaagaccacgccgcccgugcucgacuccgacggcagcuucuuccuguacuccaagcugaccguggacaagagccgcuggcagcaggggaacgucuucuccugcagcgugaugcacgaggcccuccacaaccacuacacccagaagucccugagccugucccccggc

SEQ ID NO: 7956 - RNA, 1344 nt, Artificial Sequence
  derived and/or modified sequence opt1 from Foravirumab_HeavyChain
gaggugcagcuggucgagagcggcgggggcgccgugcagcccgggcgcucccuccggcugagcugcgccgcguccggcuucaccuucagcuccuacgggaugcacugggugcgccaggccccgggcaagggccuggagugggucgccgugauccucuacgacgggagcgacaaguucuacgccgacuccgugaagggccgguucaccaucagccgcgacaacuccaagaacacgcuguaccugcagaugaacagccuccgggccgaggacaccgcggucuacuacugcgccaagguggccguggccgggacccacuucgacuacuggggccaggggacccuggucacgguguccagcgcguccaccaagggccccagcguguucccccuggcccccuccagcaaguccaccagcggcgggaccgccgcccucggcugccuggucaaggacuacuucccggagcccgugacgguguccuggaacagcggggcccugaccagcggcguccacaccuuccccgcggugcuccaguccagcggccuguacucccugagcuccguggucaccgugcccagcuccagccucgggacgcagaccuacaucugcaacgugaaccacaagccguccaacaccaaggucgacaagcgcguggagcccaagagcugcgacaagacccacacgugcccgcccugccccgcccccgagcugcugggcgggcccuccguguuccucuucccgcccaagcccaaggacacccugaugaucagccggacccccgaggugaccugcgucgucguggacgugucccacgaggaccccgaggucaaguucaacugguacguggacggcguggagguccacaacgccaagacgaagccgcgcgaggagcaguacaacagcaccuaccgggugguguccguccugaccgugcuccaccaggacuggcugaacgggaaggaguacaagugcaaggugagcaacaaggcccugcccgcccccaucgagaagaccaucuccaaggcgaagggccagccccgcgagccgcaggucuacacgcucccgcccagccgggaggagaugaccaagaaccaggugucccugaccugccuggugaagggcuucuaccccagcgacaucgccgucgagugggagagcaacgggcagcccgagaacaacuacaagaccacgccgcccgugcucgacuccgacggcagcuucuuccuguacuccaagcugaccguggacaagagccgcuggcagcaggggaacgucuucuccugcagcgugaugcacgaggcccuccacaaccacuacacccagaagucccugagccugucccccggc

SEQ ID NO: 7957 - RNA, 642 nt, Artificial Sequence
  derived and/or modified sequence opt1 from Foravirumab_LightChain1
gacauccagaugacccagagccccuccagccuguccgccagcgugggcgaccgcgucaccaucacgugccgggccucccaggggauccgcaacgaccucggcugguaccagcagaagccggggaaggcgcccaagcugcugaucuacgccgccagcucccuccagagcggcgugcccucccgguucagcggguccggcagcggcaccgacuucacccugaccaucuccagccugcagcccgaggacuucgccacguacuacugccagcagcucaacuccuacccgcccaccuucgggggcgggaccaagguggagaucaagcgcaccgucgccgcgcccagcguguucaucuucccgcccuccgacgagcagcucaagagcggcacggccuccguggucugccugcugaacaacuucuacccccgggaggccaaggugcaguggaagguggacaacgcccugcagagcgggaacagccaggaguccgucaccgagcaggacagcaaggacuccaccuacagccuguccagcacccucacgcuguccaaggcggacuacgagaagcacaagguguacgccugcgaggugacccaccagggccugagcucccccgucaccaagagcuucaaccgcggcgagugc

SEQ ID NO: 7958 - RNA, 1341 nt, Artificial Sequence
  derived and/or modified sequence opt1 from Fresolimumab_HeavyChain1
caggugcagcugguccagagcggcgccgaggugaagaagcccggguccagcgugaaggucuccugcaaggccagcggcuacaccuucuccagcaacgugaucuccugggugcgccaggcgcccgggcagggccucgaguggaugggcggggucauccccaucguggacaucgccaacuacgcccagcgguucaagggccgcgugaccaucacggccgacgagagcaccuccaccaccuacauggagcugagcucccugcggagcgaggacacggccgucuacuacugcgcguccacccucgggcuggugcuggacgccauggacuacuggggccaggggacccucgugaccgucagcuccgccagcacgaagggccccuccguguucccccuggccccgugcagccgcuccaccagcgagagcaccgcggcccuggggugccucgugaaggacuacuuccccgagcccgucaccguguccuggaacagcggcgcccugacguccggcgugcacaccuuccccgccguccugcagagcuccgggcucuacagccuguccagcguggugaccgucccguccagcucccugggcaccaagacguacacgugcaacguggaccacaagcccagcaacaccaagguggacaagcgggucgaguccaaguacgggccgcccugcccgagcugccccgcccccgaguuccucggcggccccuccguguuccuguucccgcccaagcccaaggacacccugaugaucagccgcacccccgaggugaccugcgucguggucgacgugucccaggaggacccggaggugcaguucaacugguacgucgacgggguggaggugcacaacgcgaagaccaagccccgggaggagcaguucaacagcaccuaccgcgucguguccgugcucacgguccugcaccaggacuggcugaacggcaaggaguacaagugcaaggugagcaacaaggggcuccccagcuccaucgagaagaccaucagcaaggccaagggccagccccgggagccccagguguacacccugccgcccucccaggaggagaugaccaagaaccaggucagccugacgugccucgugaagggguucuaccccuccgacaucgccguggagugggagagcaacggccagcccgagaacaacuacaagaccaccccgcccguccuggacuccgacggcagcuucuuccuguacucccgccucaccguggacaagagccgguggcaggaggggaacguguucuccugcagcgucaugcacgaggcccugcacaaccacuacacgcagaagucccugagccucucccugggcaag

SEQ ID NO: 7959 - RNA, 645 nt, Artificial Sequence
  derived and/or modified sequence opt1 from Fresolimumab_LightChain1
gagaccgugcugacccagagccccggcacgcucucccugagcccgggggagcgcgccacccuguccugccgggccagccagucccucggcagcuccuaccuggcgugguaccagcagaagcccgggcaggcgccccgccugcucaucuacggcgccagcucccgggcccccgggaucccggaccgcuucagcggcuccggcagcgggaccgacuucacccugacgaucucccggcuggagcccgaggacuucgccgucuacuacugccagcaguacgccgacagccccaucaccuucggccaggggacccgccucgagaucaagcggaccguggccgcccccuccguguucaucuucccgcccagcgacgagcagcugaaguccggcacggccagcgucgugugccugcucaacaacuucuacccccgcgaggcgaaggugcaguggaaggucgacaacgcccugcaguccgggaacagccaggagagcgugaccgagcaggacuccaaggacagcaccuacucccugagcuccacccucacgcugagcaaggccgacuacgagaagcacaagguguacgccugcgaggucacccaccagggccuguccagccccgugaccaaguccuucaaccggggcgagugc

SEQ ID NO: 7960 - RNA, 1347 nt, Artificial Sequence
  derived and/or modified sequence opt1 from Fulranumab_HeavyChain1
gaggugcagcuggucgagagcggcgggggccucgugcagcccgggggcucccugcgccugagcugcgccgccuccggguucacccuccggagcuacuccaugaacugggugcgccaggcgccgggcaagggccuggagugggucagcuacaucucccggagcucccacaccaucuucuacgccgacagcgugaaggggcgcuucacgaucucccgggacaacgccaagaacagccuguaccuccagauggacucccugcgcgacgaggacaccgccauguacuacugcgcccggguguacagcuccggcuggcacgucagcgacuacuucgacuacugggggcagggcauccuggugaccguguccagcgcguccaccaaggggcccagcgucuucccccucgcccccugcagccgcuccacgagcgaguccaccgccgcccugggcugccuggugaaggacuacuucccggagcccgugaccgucagcuggaacuccggcgcgcucaccagcggggugcacacguuccccgccgugcugcaguccagcggccuguacucccucagcuccgucgugaccgugcccagcuccaacuucgggacccagaccuacacgugcaacgucgaccacaagccgagcaacaccaagguggacaagaccguggagcggaagugcugcgucgagugcccgcccugccccgccccgcccguggccggccccuccguguuccuguucccgcccaagcccaaggacacccugaugaucagccgcacgcccgaggugaccugcgucgucguggacgugucccacgaggaccccgagguccaguucaacugguacguggacggcguggagguccacaacgccaagaccaagccgcgggaggagcaguucaacagcaccuuccgcgugguguccguccucacgguggugcaccaggacuggcugaacgggaaggaguacaagugcaaggucagcaacaagggccugcccgcgcccaucgagaagaccaucagcaagaccaaggggcagccccgggagccccagguguacacccucccgcccucccgcgaggagaugacgaagaaccaggugagccugaccugccuggucaagggcuucuaccccuccgacaucgccguggagugggagagcaacgggcagcccgagaacaacuacaagaccaccccgcccaugcucgacuccgacggcagcuucuuccuguacuccaagcugacgguggacaagagccgguggcagcagggcaacgucuucuccugcagcgugaugcacgaggcccuccacaaccacuacacccagaagucccugagccugucccccgggaag

SEQ ID NO: 7961 - RNA, 642 nt, Artificial Sequence; identical to SEQ ID NO: 7950
  derived and/or modified sequence opt1 from Fulranumab_LightChain1

SEQ ID NO: 7962 - RNA, 1356 nt, Artificial Sequence
  derived and/or modified sequence opt1 from Futuximab_HeavyChain1
gaggugcagcugcagcagcccggcagcgagcucguccgcccgggggccuccgugaagcugagcugcaaggccuccggcuacaccuucaccagcuacuggaugcacugggugaagcagcggcccgggcagggccuggaguggaucgggaacaucuaccccggcucccgcagcacgaacuacgacgagaaguucaaguccaaggcgacccucaccgucgacaccagcuccagcacggccuacaugcagcuguccagccugaccuccgaggacagcgccguguacuacugcacccggaacggcgacuacuacguguccagcggggacgccauggacuacuggggccaggggaccuccgucacggugagcuccgccagcaccaagggccccagcguguucccgcucgcgcccuccagcaaguccaccagcgggggcaccgccgcccugggcugccuggucaaggacuacuuccccgagcccgugacgguguccuggaacagcggggcccucaccuccggcguccacaccuucccggcggugcugcagagcuccgggcuguacagccucuccagcguggucaccgugcccuccagcucccugggcacgcagaccuacaucugcaacgugaaccacaagcccagcaacaccaaggucgacaagcgcguggagcccaaguccugcgacaagacccacacgugcccgcccugccccgcccccgagcugcucggcgggccgagcguguuccuguucccgcccaagcccaaggacacccugaugaucucccggacccccgaggugaccugcgucguggucgacgugagccacgaggaccccgaggucaaguucaacugguacguggacggcguggagguccacaacgccaagacgaagccccgcgaggagcaguacaacagcaccuaccgggugguguccguccucaccgugcugcaccaggacuggcugaacgggaaggaguacaagugcaaggugagcaacaaggcccuccccgccccgaucgagaagaccaucuccaaggcgaagggccagccccgcgagccccaggucuacacgcugcccccgagccgggaggagaugaccaagaaccaggugucccugaccugccucgugaagggguucuaccccagcgacaucgccgucgagugggaguccaacggccagcccgagaacaacuacaagaccacgccgcccgugcuggacagcgacggcuccuucuuccuguacagcaagcucaccguggacaagucccgcuggcagcaggggaacgucuucagcugcuccgugaugcacgaggcccugcacaaccacuacacccagaagucccugagccucagccccggc

SEQ ID NO: 7963 - RNA, 642 nt, Artificial Sequence
  derived and/or modified sequence opt1 from Futuximab_LightChain1
gacauccagaugacccagaccacgagcucccugagcgccucccucggcgaccgcgugaccaucagcugccggaccucccaggacaucgggaacuaccugaacugguaccagcagaagcccgacggcaccgucaagcugcucaucuacuacacgagccgccugcacuccggggugcccagccgguucuccggcagcggguccggcaccgacuucagccugaccaucaacaacguggagcaggaggacgucgccaccuacuucugccagcacuacaacacggugccgcccaccuucggcgggggcaccaagcucgagaucaagcgcaccguggcggcccccuccgucuucaucuucccgcccagcgacgagcagcugaaguccgggacggccagcguggugugccugcucaacaacuucuacccccgggaggccaagguccaguggaagguggacaacgcccugcaguccggcaacagccaggaguccgugaccgagcaggacagcaaggacagcaccuacucccugagcuccacccucacgcugagcaaggcggacuacgagaagcacaaggucuacgccugcgaggugacccaccaggggcuguccagccccgugaccaaguccuucaaccgcggcgagugc

SEQ ID NO: 7964 - RNA, 1335 nt, Artificial Sequence
  derived and/or modified sequence opt1 from Galcanezumab_HeavyChain1
caggugcagcugguccagagcggcgccgaggugaagaagcccggguccagcgugaaggucuccugcaaggccagcggcuacaccuucgggaacuacuggaugcagugggugcgccaggcgcccggccaggggcucgaguggaugggcgccaucuacgagggcaccgggaagacgguguacauccagaaguucgccgaccgggucaccaucaccgccgacaaguccaccagcacggccuacauggagcuguccagccugcgcuccgaggacaccgcgguguacuacugcgcccggcucagcgacuacguguccggcuucggguacuggggccaggggaccaccgucacggugagcuccgccagcaccaagggccccuccguguucccccuggcccccugcagccgcuccaccagcgaguccaccgcggcccugggcugccucgucaaggacuacuucccggagcccgugacggugagcuggaacagcggggcccugaccuccggcguccacaccuuccccgccgugcugcagagcuccgggcucuacagccuguccagcguggucaccgugcccuccagcucccugggcacgaagaccuacacgugcaacguggaccacaagccgagcaacaccaaggucgacaagcggguggaguccaaguacggcccgcccugcccgcccugccccgcccccgaggcggccgggggccccagcguguuccucuucccgcccaagcccaaggacacccugaugaucucccgcacccccgaggugaccugcgucgucguggacgugagccaggaggaccccgagguccaguucaacugguacguggacgggguggagguccacaacgccaagaccaagccccgggaggagcaguucaacuccacguaccgcguggugagcguccugaccgugcuccaccaggacuggcugaacggcaaggaguacaagugcaagguguccaacaaggggcugcccagcuccaucgagaagaccaucagcaaggccaagggccagccccgggagccgcaggucuacacccucccgcccagccaggaggagaugacgaagaaccaggugucccugaccugccuggugaagggcuucuaccccagcgacaucgccgucgagugggaguccaacgggcagcccgagaacaacuacaagaccaccccgcccgugcucgacagcgacggcuccuucuuccuguacagccgccugacgguggacaagucccgguggcaggaggggaacgucuucagcugcuccgugaugcacgaggcgcuccacaaccacuacacccagaagucccugagccugagccucggc

SEQ ID NO: 7965 - RNA, 642 nt, Artificial Sequence
  derived and/or modified sequence opt1 from Galcanezumab_LightChain1
gacauccagaugacccagagccccuccagccuguccgccagcgugggcgaccgcgucaccaucacgugccgggccuccaaggacaucagcaaguaccucaacugguaccagcagaagccggggaaggcgcccaagcugcugaucuacuacaccuccggcuaccacagcggggugcccucccgcuucagcggcuccgggagcggcaccgacuucacccucacgaucuccagccugcagcccgaggacuucgccaccuacuacugccagcagggcgacgcccugccgcccaccuucgggggcgggaccaagguggagaucaagcggacggucgccgcccccuccguguucaucuucccgcccagcgacgagcagcucaaguccggcaccgcgagcguggucugccugcugaacaacuucuacccccgcgaggccaaggugcaguggaagguggacaacgcccuccaguccgggaacagccaggagagcgucaccgagcaggacuccaaggacagcaccuacucccugagcuccacgcugacccucagcaaggccgacuacgagaagcacaagguguacgcgugcgaggugacccaccagggccuguccagccccgucaccaaguccuucaaccggggcgagugc

SEQ ID NO: 7966 - RNA, 1371 nt, Artificial Sequence
  derived and/or modified sequence opt1 from Galiximab_HeavyChain1
caggugcagcugcaggagagcggccccgggcucgucaagccguccgagacccugagccugaccugcgccguguccggcgggagcaucuccggcggguacggcuggggcuggauccgccagccgcccgggaagggccucgaguggaucgggagcuucuacuccagcuccggcaacacguacuacaaccccagccugaagucccaggugaccaucagcaccgacaccuccaagaaccaguucagccugaagcucaacuccaugacggccgcggacaccgccgucuacuacugcgugcgggaccgccuguucagcguggucgggaugguguacaacaacugguucgacguguggggccccggcguccuggugaccguguccagcgccuccaccaaggggcccagcgucuucccccucgcccccagcuccaagagcacguccggcgggaccgccgcgcugggcugccuggugaaggacuacuucccggagcccgugaccgucagcuggaacuccggcgcccucaccagcggggugcacacguuccccgccgugcugcaguccagcggccuguacucccucagcuccgucgugaccgugcccagcuccagccuggggacccagaccuacaucugcaacgucaaccacaagccguccaacacgaagguggacaagaaggccgagcccaagagcugcgacaagacccacacgugcccgcccugccccgcgcccgagcugcucggcgggcccuccguguuccuguucccgcccaagcccaaggacacccugaugaucagccggacccccgaggugaccugcgucgucguggacgugucccacgaggaccccgaggucaaguucaacugguacguggacggcguggagguccacaacgccaagaccaagccgcgcgaggagcaguacaacagcaccuaccggguggugagcguccucacggugcugcaccaggacuggcugaacggcaaggaguacaagugcaagguguccaacaaggcccuccccgcccccaucgagaagaccaucagcaaggccaaggggcagccccgcgagccgcaggucuacacccugccgcccucccgggacgagcugaccaagaaccaggugagccucacgugccuggugaagggcuucuaccccuccgacaucgcggucgagugggagagcaacgggcagcccgagaacaacuacaagaccaccccgcccgugcuggacuccgacggcagcuucuuccucuacuccaagcugaccguggacaagagccgcuggcagcaggggaacgucuucuccugcagcgugaugcacgaggcccugcacaaccacuacacgcagaagucccucagccugucccccggcaag

SEQ ID NO: 7967 - RNA, 648 nt, Artificial Sequence
  derived and/or modified sequence opt1 from Galiximab_LightChain1
gagagcgcccugacccagcccccguccgugagcggcgcccccgggcagaaggucaccaucuccugcacgggcagcaccuccaacaucgggggcuacgaccuccacugguaccagcagcugcccgggaccgcgcccaagcugcucaucuacgacaucaacaagcgcccgagcggcaucuccgaccgguucagcggcuccaagagcgggaccgccgccucccuggccaucacgggccugcagaccgaggacgaggccgacuacuacugccagagcuacgacuccagccucaacgcccagguguucgggggcgggacccgccugaccgugcugggccagcccaaggcggcccccacggucacccucuucccgcccuccagcgaggagcugcaggccaacaaggcgacccuggugugccucaucuccgacuucuaccccggcgccgugaccgucgccuggaaggccgacagcucccccgugaaggccgggguggagacgaccacccccagcaagcagagcaacaacaaguacgcggccuccagcuaccugucccugaccccggagcaguggaagucccaccggagcuacagcugccaggucacgcacgagggcuccaccguggagaagaccguggcccccaccgagugcagc

SEQ ID NO: 7968 - RNA, 1347 nt, Artificial Sequence
  derived and/or modified sequence opt1 from Ganitumab_HeavyChain1
caggugcagcugcaggagagcggccccgggcucgucaagcccuccggcacccugagccugaccugcgccguguccgggggcagcaucuccagcuccaacugguggagcugggugcgccagccgcccgggaagggccucgaguggaucggcgagaucuaccacuccgggagcacgaacuacaaccccucccucaagagccgggucaccaucuccguggacaagagcaagaaccaguucucccugaagcugagcuccgugaccgccgcggacaccgccgucuacuacugcgcccgcuggacgggccggaccgacgccuucgacaucugggggcagggcaccauggugaccgugagcuccgccagcacgaaggggcccagcgucuucccccuggcgcccuccagcaaguccaccagcggcggcaccgccgcccuggggugccucgugaaggacuacuuccccgagccggugaccgucuccuggaacagcggcgcccugacguccggggugcacaccuuccccgcggugcugcagagcuccggccucuacagccuguccagcgucgugaccgugcccuccagcucccugggcacccagacguacaucugcaacgucaaccacaagcccagcaacaccaagguggacaagaagguggagccgaaguccugcgacaagacccacacgugcccgcccugccccgcccccgagcuccucgggggccccagcgucuuccuguucccgcccaagcccaaggacacccugaugaucucccgcacccccgaggugaccugcguggucguggacgucagccacgaggaccccgaggugaaguucaacugguacguggacggggucgaggugcacaacgccaagaccaagccccgggaggagcaguacaacagcacguaccgcguggucuccgugcugaccgugcugcaccaggacuggcucaacggcaaggaguacaagugcaaggucagcaacaaggcccugccggcccccaucgagaagaccaucuccaaggcgaaggggcagccccgggagccccagguguacacccugccgcccagccgcgacgagcucacgaagaaccaggugucccugaccugccuggucaagggcuucuaccccagcgacaucgccguggagugggaguccaacggccagccggagaacaacuacaagaccaccccgcccgugcucgacagcgacggguccuucuuccuguacagcaagcugacggucgacaagucccgguggcagcagggcaacguguucagcugcuccgugaugcacgaggcccuccacaaccacuacacccagaagucccugagccugagccccgggaag

SEQ ID NO: 7969 - RNA, 657 nt, Artificial Sequence
  derived and/or modified sequence opt1 from Ganitumab_LightChain1
gacguggucaugacccagagcccccugucccucccggugacccccggcgagcccgccagcaucuccugccgcagcucccagagccugcugcacuccaacggguacaacuaccucgacugguaccugcagaagcccggccagagcccgcagcugcucaucuaccugggguccaaccgggccagcggcgugcccgaccgcuucuccgggagcggcuccggcacggacuucacccugaagaucagccgggucgaggcggaggacguggggguguacuacugcaugcagggcacccacuggccccucaccuucgggcagggcacgaaggucgagaucaagcgcaccguggccgcccccuccguguucaucuucccgcccagcgacgagcagcugaaguccgggaccgccagcgucgugugccugcucaacaacuucuacccccgggaggccaaggugcaguggaaggucgacaacgcgcugcaguccggcaacagccaggagagcgugaccgagcaggacuccaaggacagcacguacucccugagcuccacccucacccugagcaaggccgacuacgagaagcacaagguguacgccugcgaggucacccaccagggccuguccagccccgugacgaaguccuucaaccgcggggagugc

SEQ ID NO: 7970 - RNA, 1368 nt, Artificial Sequence
  derived and/or modified sequence opt1 from Gantenerumab_HeavyChain1
cagguggagcuggucgagagcggcgggggccucgugcagcccgggggcucccugcgccugagcugcgccgccuccggguucaccuucagcuccuacgcgaugagcugggugcggcaggccccgggcaagggccucgagugggucuccgccaucaacgccagcgggacccgcacguacuacgccgacuccgugaagggccgguucaccaucagccgcgacaacuccaagaacacccuguaccugcagaugaacagccuccgggcggaggacaccgccguguacuacugcgcccgcgggaagggcaacacgcacaagcccuacggguacguccgguacuucgacguguggggccagggcacccuggugaccgucuccagcgccuccaccaaggggcccagcguguucccccuggcgccguccagcaaguccacgagcggcgggaccgccgcccucggcugccuggugaaggacuacuuccccgagcccgucaccgugagcuggaacuccggcgcccugaccagcggggugcacacguuccccgccguccuccaguccagcggccuguacucccugagcuccguggugaccgucccgagcuccagccucgggacccagaccuacaucugcaacgugaaccacaagcccuccaacacgaagguggacaagaaggucgagcccaagagcugcgacaagacccacacgugcccgcccugccccgcgcccgagcugcugggcgggcccuccguguuccucuucccgcccaagcccaaggacacccugaugaucagccgcacccccgaggugaccugcgucguggucgacgugucccacgaggacccggaggugaaguucaacugguacgucgacggcguggaggugcacaacgccaagaccaagccccgggaggagcaguacaacagcaccuaccgcgucguguccgugcugacgguccuccaccaggacuggcugaacggcaaggaguacaagugcaaggugagcaacaaggcccugcccgcccccaucgagaagaccaucuccaaggccaaggggcagccgcgggagccccagguguacacccucccgcccagccgcgacgagcugaccaagaaccaggucagccugacgugccucgugaagggcuucuaccccuccgacaucgcgguggagugggagagcaacgggcagcccgagaacaacuacaagaccacgcccccgguccuggacuccgacggcagcuucuuccuguacuccaagcucaccguggacaagagccgguggcagcaggggaacguguucuccugcagcgucaugcacgaggcccugcacaaccacuacacccagaagucccugagccucucccccggcaag

SEQ ID NO: 7971 - RNA, 645 nt, Artificial Sequence
  derived and/or modified sequence opt1 from Gantenerumab_LightChain1
gacaucgugcugacccagagccccgccacccucucccugagcccgggcgagcgggccacgcuguccugccgggcgagccaguccgucagcuccagcuaccucgccugguaccagcagaagcccgggcaggcgccccgccugcugaucuacggcgccuccagccgggccaccggggugcccgcccgcuucuccggcagcggguccggcaccgacuucacccucacgaucagcucccuggagccggaggacuucgccaccuacuacugccugcagaucuacaacaugcccaucaccuucggccaggggaccaagguggagaucaagcggacggucgccgcccccagcguguucaucuucccgcccuccgacgagcagcucaagagcggcaccgcguccguggucugccugcugaacaacuucuacccccgcgaggccaaggugcaguggaagguggacaacgcccuccagagcgggaacagccaggaguccgucaccgagcaggacagcaaggacuccaccuacagccuguccagcacgcugacccucuccaaggccgacuacgagaagcacaagguguacgccugcgaggugacccaccagggccugagcucccccgucaccaagagcuucaaccgcggggagugc

SEQ ID NO: 7972 - RNA, 348 nt, Artificial Sequence
  derived and/or modified sequence opt1 from Gemtuzumab_HeavyChain1
caggugcagcugcagcagagcggcgccgagcucgccaagcccggggcguccgucaagaugagcugcaaggccuccggcuacaccuucaccagcuaccgcaugcacugggugaagcagcggccggggcagggccuggaguggaucggguacaucaaccccuccacgggcuacaccgaguacaaccagaaguucaaggacaaggccacccugaccgccgacaagagcuccagcacggccuacaugcagcucuccagccugaccuucgaggacuccgcgguguacuacugcgcccgcggcgggggcgucuucgacuacugggggcagggcaccacccugacggugagcucc

SEQ ID NO: 7973 - RNA, 351 nt, Artificial Sequence
  derived and/or modified sequence opt1 from Gemtuzumab_HeavyChain2
caggugcagcugguccagagcggcgccgaggugaagaagcccggguccagcgugaaggucuccugcaaggccagcggcgggaccuucucccgcagcgcgaucaucugggugcggcaggccccgggccaggggcucgaguggaugggcggcaucgugcccauguucgggccgcccaacuacgcccagaaguuccagggccgcgucaccaucacggccgacgaguccaccaacaccgccuacauggagcugagcucccugcggagcgaggacaccgcguucuacuucugcgccgggggcuacgggaucuacucccccgaggaguacaacggcggccucgugacggugagcucc

SEQ ID NO: 7974 - RNA, 321 nt, Artificial Sequence
  derived and/or modified sequence opt1 from Gemtuzumab_LightChain2
gacauccagaugacccagagccccuccacccugagcgccuccgugggcgaccgcgucacgaucacgugccgggccagccaguccaucaacaccuggcucgcgugguaccagcagaagccggggaaggcccccaagcugcugauguacaaggccagcucccucgagagcggcgugcccucccgcuucaucgggagcggcuccgggaccgaguucacccugaccaucagcucccugcagcccgacgacuucgccaccuacuacugccagcaguacaacagcgacuccaagauguucggccagggcaccaagguggaggucaag

SEQ ID NO: 7975 - RNA, 318 nt, Artificial Sequence
  derived and/or modified sequence opt1 from Gemtuzumab_ozogamicin_LightChain1
cagaucgugcugacccagagccccgccaucauguccgccagcccgggcgagaaggucaccaucacgugcuccgcgagcuccagcaucuccuacaugcacugguuccagcagaagcccgggaccagccccaagcucuggaucuacaccaccuccaaccuggccagcggcgugcccgcccgcuucuccgggagcggcuccgggacgagcuacucccugaccaucagccggauggaggccgaggacgccgcgaccuacuacugccaccagcgcuccaccuacccgcucacguucggcagcggcaccaagcuggagcugaag

SEQ ID NO: 7976 - RNA, 1335 nt, Artificial Sequence
  derived and/or modified sequence opt1 from Gevokizumab_HeavyChain1
caggugcagcugcaggagagcggccccgggcucgucaagcccucccagacccugagccugaccugcuccuucagcggcuucucccucagcacguccgggaugggcgugggguggauccgccagcccagcggcaagggccuggaguggcuggcccacaucuggugggacggggacgaguccuacaaccccagccucaagucccggcugaccaucagcaaggacaccuccaagaaccaggugagccugaagaucaccuccgucacggccgcggacaccgccguguacuucugcgcccgcaaccgguacgacccgcccugguucguggacuggggccaggggacccucgucaccgugagcuccgccagcacgaagggccccuccguguucccccuggcccccugcagccgcagcaccuccgagagcaccgcggcccuggggugccucgucaaggacuacuucccggagcccgugaccguguccuggaacagcggcgcccugacguccggcguccacaccuuccccgccgugcugcagagcuccgggcucuacagccuguccagcguggucaccgugaccuccagcaacuucggcacgcagaccuacacgugcaacguggaccacaagcccuccaacaccaaggucgacaagaccguggagcggaagugcugcguggagugcccgcccugccccgcgcccccggucgccgggcccagcguguuccuguucccgcccaagcccaaggacacccucaugaucucccgcacccccgaggugaccugcgucguggucgacgugagccacgaggaccccgaggugcaguucaacugguacgucgacggcauggaggugcacaacgccaagacgaagccccgggaggagcaguucaacuccaccuuccgcguggucagcgugcugaccgugguccaccaggacuggcugaacggcaaggaguacaagugcaagguguccaacaaggggcucccggcccccaucgagaagaccaucagcaagacgaagggccagccccgggagccccagguguacacccugccgcccagccgcgaggagaugaccaagaaccaggucucccugaccugccucgugaagggguucuaccccagcgacaucgccguggagugggaguccaacggccagccggagaacaacuacaagacgaccccgcccaugcuggacagcgacggguccuucuuccuguacagcaagcucaccgucgacaagucccgguggcagcagggcaacguguucagcugcuccgugaugcacgaggcgcugcacaaccacuacacccagaagucccugagccucagccccggc

SEQ ID NO: 7977 - RNA, 642 nt, Artificial Sequence
  derived and/or modified sequence opt1 from Gevokizumab_LightChain1
gacauccagaugacccagagcaccuccagccuguccgccagcgugggcgaccgggucacgaucacgugccgggccucccaggacaucagcaacuaccucuccugguaccagcagaagcccgggaaggcggugaagcugcugaucuacuacaccagcaagcuccacuccggcgugccgagccgcuucuccgggagcggcuccgggaccgacuacacgcugaccaucagcucccugcagcaggaggacuucgccaccuacuucugccuccagggcaagaugcugcccuggaccuucggccaggggacgaagcuggagaucaagcggaccgucgccgcccccagcguguucaucuucccgcccuccgacgagcagcucaagagcggcaccgccuccguggucugccugcugaacaacuucuacccccgcgaggcgaaggugcaguggaagguggacaacgcccuccagagcgggaacagccaggaguccgucaccgagcaggacagcaaggacuccacguacagccuguccagcacccugacccucuccaaggccgacuacgagaagcacaagguguacgccugcgaggugacccaccagggccugagcucccccgucaccaagagcuucaaccgcggggagugc

SEQ ID NO: 7978 - RNA, 1347 nt, Artificial Sequence
  derived and/or modified sequence opt1 from Girentuximab_HeavyChain1
gacgugaagcuggucgagagcggcgggggccucgugaagcucgggggcucccugaagcugagcugcgccgccuccggguucaccuucagcaacuacuacauguccugggugcgccagacccccgagaagcggcuggagcuggucgcggccaucaacagcgacggcggcaucacguacuaccucgacaccgugaaggggcgcuucaccaucucccgggacaacgccaagaacacccuguaccugcagaugagcucccucaagagcgaggacacggcccuguucuacugcgcccgccaccgguccggcuacuucagcauggacuacugggggcagggcaccuccgugaccgucagcuccgcgagcaccaaggggccguccguguucccccuggcccccagcuccaagagcacgagcggcggcaccgccgcccucgggugccuggugaaggacuacuuccccgagccggucaccguguccuggaacagcggcgcgcugaccuccggggugcacacguuccccgccguccuccagagcuccggccuguacagccuguccagcguggugaccguccccuccagcucccucggcacccagaccuacaucugcaacgugaaccacaagcccagcaacacgaagguggacaagaaggucgagccgaaguccugcgacaagacccacacgugcccgcccugccccgcccccgagcugcucgggggccccagcguguuccuguucccgcccaagcccaaggacacccugaugaucucccgcacccccgaggugaccugcgucgugguggacgucagccacgaggaccccgaggugaaguucaacugguacgucgacgggguggaggugcacaacgccaagaccaagccccgggaggagcaguacaacuccaccuaccgcgucgugagcgugcugacgguccuccaccaggacuggcugaacggcaaggaguacaagugcaagguguccaacaaggcccugccggcgcccaucgagaagaccaucagcaaggccaaggggcagccccgggagccccagguguacacccucccgcccagccgcgacgagcugaccaagaaccaggucucccugacgugccucgugaagggcuucuaccccagcgacaucgccguggagugggaguccaacggccagcccgagaacaacuacaagaccaccccgcccguccuggacagcgacggguccuucuuccuguacagcaagcucaccguggacaagucccgguggcagcagggcaacguguucagcugcuccgucaugcacgaggcccugcacaaccacuacacgcagaagucccugagccucagccccgggaag

SEQ ID NO: 7979 - RNA, 642 nt, Artificial Sequence
  derived and/or modified sequence opt1 from Girentuximab_LightChain1
gacaucgugaugacccagagccagcgcuucauguccaccacggucggcgaccgggugagcaucacgugcaaggccucccagaacguggucagcgccguggcgugguaccagcagaagcccgggcaguccccgaagcugcucaucuacagcgccuccaaccgcuacaccggcgugcccgaccgguucaccgggagcggcuccgggaccgacuucacccugaccaucagcaacaugcaguccgaggaccuggccgacuucuucugccagcaguacagcaacuaccccuggaccuucggcggcgggacgaagcucgagaucaagcgcaccgucgccgcccccuccguguucaucuucccgcccagcgacgagcagcugaaguccggcaccgcgagcguggucugccugcucaacaacuucuacccccgggaggccaaggugcaguggaagguggacaacgcccugcaguccgggaacagccaggaguccgucaccgagcaggacagcaaggacagcacguacucccugagcuccacccucacccugagcaaggccgacuacgagaagcacaagguguacgcgugcgaggugacccaccagggccuguccagccccgucacgaaguccuucaaccgcggggagugc

SEQ ID NO: 7980 - RNA, 1335 nt, Artificial Sequence
  derived and/or modified sequence opt1 from Glembatumumab_HeavyChain1
caggugcagcugcaggagagcggccccgggcucgucaagccgucccagacccugagccugaccugcacgguguccggcgggagcaucuccagcuucaacuacuacugguccuggauccgccaccaccccggcaaggggcucgaguggaucggcuacaucuacuacagcggcuccaccuacagcaaccccucccucaagagccgggugaccaucuccgucgacaccagcaagaaccaguucucccugacgcucagcuccgugaccgccgccgacaccgcgguguacuacugcgcccgcggguacaacuggaacuacuucgacuacuggggccaggggacccuggucacggugagcuccgccagcaccaagggccccagcguguucccgcuggcccccugcucccggagcaccuccgagagcaccgccgcgcucgggugccuggucaaggacuacuuccccgagcccgugacgguguccuggaacagcggcgcccugaccuccggcguccacaccuucccggccgugcuccagagcuccgggcuguacagccuguccagcguggucaccgugcccuccagcaacuucggcacgcagaccuacacgugcaacguggaccacaagcccuccaacaccaaggucgacaagaccguggagcgcaagugcugcguggagugcccgcccugccccgccccgcccgucgcggggcccagcguguuccucuucccgcccaagcccaaggacacccugaugaucucccggacccccgaggugaccugcgucguggucgacgugagccacgaggaccccgaggugcaguucaacugguacgucgacggcguggaggugcacaacgccaagacgaagccccgcgaggagcaguucaacuccaccuuccgggucgugagcgugcugaccgucgugcaccaggacuggcucaacggcaaggaguacaagugcaaggugagcaacaaggggcugcccgccccgaucgagaagaccaucuccaagacgaagggccagccccgcgagccccaggucuacacccugcccccgagccgggaggagaugaccaagaaccaggugucccugaccugccuggugaagggguucuaccccagcgacaucgccgucgagugggaguccaacggccagcccgagaacaacuacaagacgaccccgcccaugcuggacagcgacggguccuucuuccucuacagcaagcugaccguggacaagucccgcuggcagcagggcaacguguucagcugcuccgucaugcacgaggcccugcacaaccacuacacccagaagucccucagccugagccccggcaag

SEQ ID NO: 7981 - RNA, 645 nt, Artificial Sequence
  derived and/or modified sequence opt1 from Glembatumumab_LightChain1
gagaucgugaugacccagagccccgccacccuguccgucagcccgggcgagcgggccacgcucuccugccgggcgagccaguccguggacaacaaccuggugugguaccagcagaagcccgggcaggcgccccgccugcucaucuacggcgccagcacccgggccaccgggauccccgcccgcuucuccggcagcggguccggcaccgaguucacgcugaccaucagcucccugcagagcgaggacuucgccgucuacuacugccagcaguacaacaacuggccgcccuggaccuucggccaggggaccaagguggagaucaagcggacgguggccgcccccuccgucuucaucuucccgcccagcgacgagcagcucaaguccggcaccgccagcguggugugccugcugaacaacuucuacccccgcgaggcgaagguccaguggaagguggacaacgcccuccaguccgggaacagccaggaguccgugaccgagcaggacagcaaggacagcaccuacucccugagcuccacgcugacccucagcaaggccgacuacgagaagcacaaggucuacgccugcgaggugacccaccagggccuguccagccccgugaccaaguccuucaaccgcggggagugc

SEQ ID NO: 7982 - RNA, 1332 nt, Artificial Sequence
  derived and/or modified sequence opt1 from Goilixiab_HeavyChain1
gaggugcagcuggucgagagcggcgggggccucgccaagcccgggggcucccugcgccugagcugcgccgcguccggguuccgguucaccuucaacaacuacuacgacugggugcgccaggccccgggccagggccucgagugggugagccggaucuccagcuccggggaccccaccugguacgccgacagcgucaagggccgcuucaccaucucccgggagaacgccaagaacacccuguuccugcagaacagccuccgcgccgaggacaccgcgguguacuacugcgccucccugaccacggggagcgacuccuggggccagggggugcuggucaccgugagcuccgccagcaccaagggccccuccguguucccccucgccccgagcuccaagagcaccagcggcgggacggcggcccugggcugccuggucaaggacuacuuccccgagcccgugaccguguccuggaacagcggggcccucaccuccggcguccacaccuuccccgccgugcugcagagcuccggccuguacagccucuccagcguggucacggugccguccagcucccuggggacccagaccuacaucugcaacgugaaccacaagcccagcaacaccaaggucgacaagaagguggagcccaaguccugcgacaagacgcacacgugcccgcccugccccgcccccgagcugcucggcgggcccagcguguuccuguucccgcccaagcccaaggacacccugaucucccggacccccgaggugaccugcgucguggucgacgugagccacgaggacccggaggucaaguucaacugguacguggacggcguggagguccacaacgcgaagaccaagccccgcgaggagcaguacaacuccaccuaccggguggugagcguccucaccgugcugcaccaggacuggcugaacgggaaggaguacaagugcaagguguccaacaaggcccuccccgcccccaucgagaagacgaucagcaaggccaagggccagccgcgcgagccccaggucuacacccugccgcccagccgggacgagcugaccaagaaccaggugucccugaccugccucgugaagggcuucuaccccagcgacaucgccgucgagugggaguccaacgggcagcccgagaacaacuacaagacgacgcccccggugcuggacagcgacggcuccuucuuccucuacagcaagcugaccguggacaagucccgcuggcagcaggggaacgucuucagcugcuccgugcacgaggcgcugcacaaccacuacacccagaagucccucagccugagccccggcaag

SEQ ID NO: 7983 - RNA, 639 nt, Artificial Sequence
  derived and/or modified sequence opt1 from Goilixiab_LightChain1
gacauccagacccagagccccuccagccuguccgccagcgugggcgaccgcgucaccaucacgugccgggccucccaggacauccgcuacuaccucaacugguaccagcagaagccggggaaggcgcccaagcugcugaucuacguggccagcucccuccagagcggcgugcccucccgguucagcggguccggcagcgggaccgaguucacccugaccgucuccagccugcagcccgaggacuucgccacguacuacugccuccagguguacuccaccccgcgcaccuucggccagggcaccaagguggagaucaagcggacggucgccgcccccagcguguucaucuucccgcccuccgacgagcagcucaagagcgggaccgcguccguggucugccugcugaacaacuucuacccccgcgaggccaaggugcaguggaagguggacaacgcccugcagagcggcaacagccaggaguccgucaccgagcaggacagcaaggacuccaccuacagccuguccagcacgcucacccuguccaaggccgacuacgagaagcacaagguguacgcgugcgaggugacccaccaggggcugagcucccccgucaccaagagcuucaaccggggcgagugc

SEQ ID NO: 7984 - RNA, 1338 nt, Artificial Sequence
  derived and/or modified sequence opt1 from Guselkumab_HeavyChain1
gaggugcagcugguccagagcggcgccgaggugaagaagcccggggagucccucaagaucagcugcaagggcuccggguacagcuucuccaacuacuggaucggcugggugcgccagaugcccgggaagggccuggaguggaugggcaucaucgaccccagcaacuccuacacccgguacagccccuccuuccaggggcaggucaccaucagcgccgacaaguccaucagcacggcguaccugcagugguccagccucaaggccuccgacaccgccauguacuacugcgcccgcugguacuacaagcccuucgacguguggggccaggggacccuggugaccgucagcuccgccagcacgaagggcccguccguguucccccuggcgcccagcagcaaguccaccagcgggggcaccgccgcccucggcugccuggugaaggacuacuuccccgagccggucaccguguccuggaacagcggggcccugacguccggcgugcacaccuuccccgcgguccuccagagcuccgggcuguacagccuguccagcguggugaccguccccuccagcucccucggcacccagacguacaucugcaacgugaaccacaagcccagcaacaccaagguggacaagaaggucgagccgaaguccugcgacaagacccacacgugcccgcccugccccgcccccgagcugcugggcgggcccagcguguuccucuucccgcccaagcccaaggacacccugaugaucucccggacccccgaggugaccugcgucgugguggacgucagccacgaggaccccgaggugaaguucaacugguacgucgacggcguggaggugcacaacgccaagaccaagccccgcgaggagcaguacaacuccacguaccgggucgugagcgugcugaccguccuccaccaggacuggcugaacgggaaggaguacaagugcaaggugagcaacaaggcccugccggcccccaucgagaagaccaucuccaaggcgaagggccagccccgcgagccccagguguacacccucccgcccagccgggacgagcugacgaagaaccaggucucccugaccugccucgugaagggguucuaccccagcgacaucgccguggagugggaguccaacggccagccggagaacaacuacaagaccaccccgcccguccuggacagcgacggcuccuucuuccuguacagcaagcucacgguggacaagucccgcuggcagcaggggaacguguucagcugcuccgucaugcacgaggcccugcacaaccacuacacccagaagucccugagccucagccccggc

SEQ ID NO: 7985 - RNA, 651 nt, Artificial Sequence
  derived and/or modified sequence opt1 from Guselkumab_LightChain1
cagagcgugcugacccagcccccguccgucagcggcgcccccgggcagcgcgugaccaucuccugcacgggcagcuccagcaacaucggguccggcuacgacgugcacugguaccagcagcuccccgggaccgcccccaagcugcugaucuacggcaacagcaagcggccguccggcguccccgaccgcuucagcggguccaagagcggcaccuccgcgagccucgccaucaccgggcugcaguccgaggacgaggccgacuacuacugcgccagcuggacggacggccugucccucgugguguucgggggcggcaccaagcugaccguccuggggcagcccaaggccgcgcccagcgugacccucuucccgcccuccagcgaggagcugcaggccaacaaggccacgcuggugugccucaucagcgacuucuaccccggcgccgucaccguggcguggaaggccgacuccagccccgugaaggccggggucgagaccaccacgccguccaagcagagcaacaacaaguacgccgccuccagcuaccugucccugacccccgagcaguggaagucccaccggagcuacagcugccaggugacccacgagggcuccaccguggagaagacggucgcgcccaccgagugcagc

SEQ ID NO: 7986 - RNA, 360 nt, Artificial Sequence
  derived and/or modified sequence opt1 from HuMab-001_HeavyChain_VDJ-Region
caggugcagcugcagcaguggggcgccgggcuccugaagcccagcgagacccugucccugaccugcgccgucuacggcgggagcuucuccggcuacuacuggaacuggauccgccagccgcccgggaagggccucgaguggaucggcgagaucaaccacagcggguccacgaacuacaaccccagccugaagucccgggugaccaucagcguggacaccuccaagaaccaguucagccucaagcuguccagcgucaccgcggccgacacggccguguacuacugcgcccgcggcaacuacggguccggcuacuacuacuucgaccugugggggcggggcacccaggugaccgucagcucc

SEQ ID NO: 7987 - RNA, 321 nt, Artificial Sequence
  derived and/or modified sequence opt1 from HuMab-001_LightChain_VJ-Region
gacauccagaugacccagagccccuccagccuguccgccagcgugggcgaccgcgucaccaucacgugccgggccucccaggggaucagcuccuggcucgcgugguaccagcagaagccggagaaggcccccaagagccugaucuucgccgccuccagccugcaguccggcgugcccagccgcuucuccgggagcggcuccgggaccgacuucacccucaccaucagcucccugcagcccgaggacuucgccacguacuacugccagcaguacaucagcuucccgaucaccuucggccagggcacccggcuggagaucaag

SEQ ID NO: 7988 - RNA, 366 nt, Artificial Sequence
  derived and/or modified sequence opt1 from HuMab-005_HeavyChain_gamma-Chain_VDJ-Region
gaggugcagcugguccagagcggcgccgaggugaagaagcccggggagucccucaagaucagcugcaaggccuccggcuacagcuuccacuucuacuggaucgggugggugcgccagaugccgggcaaggggcuggaguggaugggcuccaucuaccccggcgacagcgacacccgguaccgccccuccuuccaggggcaggucaccaucagcgcggacaaguccaucagcacggccuaccugcaguggaccucccucaaggccagcgacaccgccaucuacuacugcgcccggcagcgcggcgacuacuacuacuucuacgggauggacguguggggccaggggaccacggugaccgucuccagc

SEQ ID NO: 7989 - RNA, 321 nt, Artificial Sequence
  derived and/or modified sequence opt1 from HuMab-005_LightChain_VJ-Region
gagaucgugcugacccagagccccggcacccucucccugagcccgggggagcgcgccacgcuguccugccgggccagccaguccgucagcuccagcuaccucgcgugguaccagcagaagcccggccaggugccccgccugcugaucuacggggccuccagccgggccaccggcauccccgaccgcuucuccgggagcggcuccggcaccgacuucacccucacgaucagccggcuggagccggaggacuucgccguguacuacugccagcaguacggguccagccugaccuucggcgggggcaccaaggucgagaucaag

SEQ ID NO: 7990 - RNA, 357 nt, Artificial Sequence
  derived and/or modified sequence opt1 from HuMab-006_HeavyChain_VDJ-Region
gaggugcagcugcucgagagcggcgggggccugguccagcccgggggcucccugcgccucagcugcgccgccuccggguucaccuucagcaacuacgcgcugaucugggugcggcaggccccgggcaagggccuggaguggguguccaucauccgcgggggcgccgggagcaccuacuacgccgacuccgucaagggccgguucacgaucagccgcgacaacuccaagaacacccucuaccugcagaugaacagccugcgggccgaggacaccgcgguguacuacugcgccaaggcccgcaucugggggccccucuucgacuacuggggccagggcacccuggugacggucuccagc

SEQ ID NO: 7991 - RNA, 324 nt, Artificial Sequence
  derived and/or modified sequence opt1 from HuMab-006_LightChain_VJ-Region
gagaucgugcugacccagagccccgccacccucucccugagccccggcgagcgcgccacgcuguccugccgggcgagccaguccgucagcuccuaccucgccugguaccagcagaagcccgggcaggcgccccgccugcugaucuacgacgccagcaaccgggccaccggcauccccgcccgcuucuccgggagcggcuccgggaccgacuucacccucacgaucagcucccuggagccggaggacuucgccguguacuacugccagcagcggagcaacuggccgccccugaccuucggcggcgggaccaagguggagaucaag

SEQ ID NO: 7992 - RNA, 360 nt, Artificial Sequence
  derived and/or modified sequence opt1 from HuMab-019_HeavyChain_VDJ-Region
caggugcagcugcagcaguggggcgccgggcuccugaagcccagcgagacccugucccugaccugcgccgucuacggcgggagcuucuccgacuacuacuggaacuggauccgccagccgcccggcaaggggcuggaguggaucggcgagauccaccacgugggcagcacgaacuacaaccccucccucaagagccgggugaccaucuccgucgacaccagcaagucccaguucagccucaagcuguccagcgugaccgcggccgacacggccguguacuacugcgcccgcggguacuacgacuccggcgucuacuacuucgacuacugggcccaggggacccuggugaccgugagcucc

SEQ ID NO: 7993 - RNA, 360 nt, Artificial Sequence
  derived and/or modified sequence opt1 from HuMab-021_HeavyChain_VDJ-Region
caggugcagcugcagcaguggggcgccgggcuccugaagcccagcgagacccugucccugaccugcgccgucuacggcgggagcuucuccgacuacuacuggaacuggauccgccagccgcccggcaaggggcucgaguggaucggcgagauccaccacagcggcuccacgaacuacaaccccagccugaagucccgggugaccaucagcguggacaccuccaagaaccaguucagccucaagcuguccagcgucaccgcggccgacacggccguguacuacugcgcccgcggguacuacgccuccggcguguacuacuucgacuacugggggcagggcacccuggucaccgugagcucc

SEQ ID NO: 7994 - RNA, 321 nt, Artificial Sequence
  derived and/or modified sequence opt1 from HuMab-021_LightChain_VJ-Region
gacauccagaugacccagagccccuccagccuguccgccagcgugggcgaccgcgucaccaucacgugccgggccucccaggggaucagcuccuggcucgcgugguaccagcagaagccggagaaggcccccaagagccugaucuacgccgccuccagccugcaguccggcgugcccagccgcuucuccgggagcggcuccgggaccgacuucacccucaccaucagcucccugcagcccgaggacuucgccacguacuacugccagcaguacaacagcuacccgaucaccuucggccagggcacccggcuggagaucaag

SEQ ID NO: 7995 - RNA, 360 nt, Artificial Sequence
  derived and/or modified sequence opt1 from HuMab-025_HeavyChain_VDJ-Region
caggugcagcugcagcaguggggcgccgggcuccugaagcccagcgagacccugucccugaccugcgccgucuacggcgggagcuucuccgacuacuacuggaacuggauccgccagccgcccggcaaggggcucgaguggaucggcgagauccaccacagcggcuccacgaacuacaaccccagccugaagucccgggugaccaucagcguggacaccuccaagaaccaguucagccucaagcuguccagcgucaccgcggccgacacggccguguacuacugcgcccgcggguacuacgacuccggcguguacuacuucgacuacugggcccaggggacccuggucaccgugagcucc

SEQ ID NO: 7996 - RNA, 321 nt, Artificial Sequence
  derived and/or modified sequence opt1 from HuMab-025_LightChain_VJ-Region
gacauccagaugacccagagccccuccagccuguccgccagcgugggcgaccgcgucaccaucacgugccgggccucccaggggaucagccgcuggcucgcgugguaccagcagaagccggagaaggcccccaagucccugaucuacgccgccagcucccugcggagcggcgugcccucccgcuucagcggguccggcagcgggaccgacuucacccucaccaucuccagccugcagcccgaggacuucgccacguacuacugccagcaguacaacuccuacccgaucaccuucggccagggcacccggcuggagaucaag

SEQ ID NO: 7997 - RNA, 360 nt, Artificial Sequence
  derived and/or modified sequence opt1 from HuMab-027_HeavyChain_VDJ-Region
caggugcagcugcagcaguggggcgccgggcuccugaagcccagcgagacccugucccugaccugcgccgucuacggcgggagcuucuccgacuacuucuggaacuggauccgccagccgcccggcaaggggcucgaguggaucggcgagauccaccacagcggcuccacgaacuacaaccccagccugaagucccgggugaccaucagcguggacaccuccaagaaccaguucagccucaaccuguccagcgucaccgcggccgacacggccguguacuacugcgcccgcgggcugaucggcuccggguacuacuacuucgacuacugggaccagggcacccucgugaccgucagcucc

SEQ ID NO: 7998 - RNA, 360 nt, Artificial Sequence
  derived and/or modified sequence opt1 from HuMab-032_HeavyChain_VDJ-Region
caggugcagcugcagcaguggggcgccgggcuccugaagcccagcgagacccugucccugaccugcgccgucuacggcgggagcuucuccggcuacuacuggagcuggauccgccagccgcccgggaagggccucgaguggaucggcgagaucaaccacuccggggacacgaacuacaaccccagccugaccucccgggugaccaucagcguggacaccuccaagaaccaguucagccucaagcuguccagcgucacggcggccgacaccgccguguacuacugcgcccgccuguucuacggcuccgggaucuacuacuucgacuacuggggccaggggacccucgugaccgucagcucc

SEQ ID NO: 7999 - RNA, 321 nt, Artificial Sequence
  derived and/or modified sequence opt1 from HuMab-032_LightChain_VJ-Region
gacauccagaugacccagagccccuccagccuguccgccagcgugggcgaccgcgucaccaucacgugccgggccucccaggggaucagcuccuggcucgcgugguaccagcagaagccggagaaggcccccaagagccugaucuacgccaccuuccgccugcaguccggcgugcccagccgguucuccgggagcggcuccgggaccgacuucacccucacgaucagcucccugcagcccgaggacuucgccaccuacuacugccagcaguacaacagcuucccgcccaccuucggccagggcaccaagguggagaucaag

SEQ ID NO: 8000 - RNA, 363 nt, Artificial Sequence
  derived and/or modified sequence opt1 from HuMab-033_HeavyChain_VDJ-Region
caggugcagcuggucgagagcggcgggggcguggugcagaccgggcgcucccuccggcugagcugcgccgccuccggcuucaccuucagcucccacgcgaugcacuggguccgccaggcccccgggaagggccuggaguggguggccgccaucagcuacgacggcuccaacaaguacuacgccgacagcgugaaggggcgguucacgaucucccgcgacaacagcaagaacacccucuaccugcagaugaacucccugcgggcggaggacaccgccgucuacuacugcgcccgcggcgacuacaucagcuccagcgggguguucgacuacuggggccaggggacccucgugacggucuccagc

SEQ ID NO: 8001 - RNA, 360 nt, Artificial Sequence
  derived and/or modified sequence opt1 from HuMab-035_HeavyChain_VDJ-Region
caggugcagcugcagcaguggggcgccgggcuccugaagcccagcgagacccugucccugaccugcgccaucuacggcgggagcuucuccggcuacuacuggagcuggauccgccagccgcccgggaagggccucgaguggaucggcgagaucaaccacuccggggacacgaacuacaaccccagccugaccucccgggucaccaucagcguggacaccuccaagaaccaguucagccucaagcuguccagcgugacggcggccgacaccgccgucuacuacugcgcccgccuguucuacggcuccgggaucuacuacuucgacuacuggggccaggggacccucgugaccgugagcucc

SEQ ID NO: 8002 - RNA, 360 nt, Artificial Sequence
  derived and/or modified sequence opt1 from HuMab-036_HeavyChain_VDJ-Region
caggugcagcugcagcaguggggcgccgggcuccugaagcccagcgagacccugucccugaccugcgccgucuacggcgggagcuucuccgacuacuacuggagcuggauccgccagccgcccggcaaggggcuggaguggaucggcgagaucaaccacuccggcagcacgaacuacaaccccucccucaagagccgggugaccaucuccguggacaccagcaagaaccaguucucccucaagcugagcuccgucaccgcggccgacacggccguguacuacugcgcccgccuguacuacgggagcggcaccuacuacuucgacuacugggggcagggcacccucgugaccgucuccagc

SEQ ID NO: 8003 - RNA, 321 nt, Artificial Sequence
  derived and/or modified sequence opt1 from HuMab-036_LightChain_VJ-Region
gacauccagaugacccagagccccuccagccuguccgccagcgugggcgaccgcgucaccaucacgugccgggccucccaggggaucagcuccuggcucaccugguaccagcagaagccggagaaggcgcccaagagccugaucuacgccgccucccgccugcagagcggcgugcccucccgguucagcggguccggcagcgggaccgacuucacccucacgaucuccagccugcagcccgaggacuucgccaccuacuacugccagcaguacaacuccuucccgcccaccuucggccagggcaccaagguggagaucaag

SEQ ID NO: 8004 - RNA, 366 nt, Artificial Sequence
  derived and/or modified sequence opt1 from HuMab-041_HeavyChain_VDJ-Region
gaggugcagcugguccagagcggcgccgaggugaagaagcccggggagucccucaagaucagcugcaagggcuccggguacagcuucaccuccuacuggaucggcugggugcgccagaugccggggaagggccuggaguggaugggcagcaucuaccccggggacucccacacccgguaccgccccagcuuccagggccaggucacgaucuccgccgacaagagcaucuccaccgcguaccugcaguggagcucccucaaggccagcgacaccgccauguacuacugcgcccggcagaagggggacuucuacuacuucuucggccuggacgugugggggcagggcaccgccaucacgguguccagc

SEQ ID NO: 8005 - RNA, 366 nt, Artificial Sequence
  derived and/or modified sequence opt1 from HuMab-044_HeavyChain_VDJ-Region
gaggugcagcugguccagagcggcgccgaggugaagaagcccggggagucccucaagaucagcugcaagggcuccggguaccgcuucagcuccuacuggaucggcugggugcggcagaugccggggaagggccuggaguggaugggcagcaucuuccccggggacuccgacacccgcuacagccccuccuuccagggccaggucaccaucagcgccgacaaguccaucacgaccgcguaccugcaguggagcucccucaaggccagcgacaccgccauguacuacugcgcccggcaggccggggacuacuacuacuacaacggcauggacgugugggggcagggcaccacggugaccgucuccagc

SEQ ID NO: 8006 - RNA, 357 nt, Artificial Sequence
  derived and/or modified sequence opt1 from HuMab-049_HeavyChain_VDJ-Region
gaggugcagcugcucgagagcggcggggaccugguccagcccggcgggucccugcgccucagcugcgccgccuccggcuucaccuucagcuccuacgcgaugagcugggugcggcaggccccggggaagggccuggaguggguguccgccaucagcggccgcgggggcaccacguacuacgccgacuccgucaaggggcgguucaccaucagccgcgacaacuccaagagcacccugugccuccagaugaacucccugcgggccgaggacaccgcgguguacuacugcgccaaggcccgcgccaacugggacuacuucgacuacuggggccaggggacgcuggugaccgucagcucc

SEQ ID NO: 8007 - RNA, 321 nt, Artificial Sequence
  derived and/or modified sequence opt1 from HuMab-049_LightChain_VJ-Region
gacauccagaugacccagagccccuccagcguguccgccagcgucggcgaccgcgugaccaucacgugccgggccucccaggggaucagcuccuggcuggcgugguaccagcacaagccgggcaaggcccccaagcuccugaucuacgccgccagcauccugcaguccggggugcccagccgcuucuccggcagcggguccggcaccgacuucacccucaccaucagcucccugcggcccgaggacuucgccacguacuacugccagcaggcgaacagcuucccgaucaccuucggccaggggacccgccuggagaucaag

SEQ ID NO: 8008 - RNA, 357 nt, Artificial Sequence
  derived and/or modified sequence opt1 from HuMab-050_HeavyChain_VDJ-Region
gaggugcagcugcucgagagcggcgggggccugguccagcccgggggcucccugcgccucagcugcgccgccuccggguucaccuucagcuccuacgcgaugaacugggugcggcaggccccgggcaagggccuggagugggugagcgccaucuccgggcgcggcgggaccacguacuacgccgacagcgucaagggccgguucaccaucucccgcgacaacagcaagaacacccuguaccuccagauguccagccugcgggccgaggacaccgcgguguacuacugcgccaaggcccgcgccaacugggacuacuucgacuacugggggcagggcacgcuggugaccgucuccagc

SEQ ID NO: 8009 - RNA, 321 nt, Artificial Sequence
  derived and/or modified sequence opt1 from HuMab-050_LightChain_VJ-Region
gacauccagaugacccagagccccuccagcguguccgccagcgucggcgaccgcgugaccaucacgugccgggccucccaggggaucagcuccuggcuggcgugguaccagcacaagccgggcaaggcccccaagcuccugaucuacgccgccagcauccugcaguccggggugcccagccgcuucuccggcagcggguccggcaccgacuucacccucaccaucagcucccugcagcccgaggacuucgccacguacuacugccagcaggcgaacagcuucccgaucaccuucggccaggggacccggcuggagaucaag

SEQ ID NO: 8010 - RNA, 360 nt, Artificial Sequence
  derived and/or modified sequence opt1 from HuMab-054_HeavyChain_VDJ-Region
caggugcagcugcagcaguggggcgccgggcuccugaagcccagcgagacccugucccugaccugcgccgucuacggcgggagcuucuccggcuacuacuggagcuggauccgccagccgcccgggaagggccuggaguggaucggcgagauccaccacuccgggagcacgaacuacaaccccucccucaagagccgggugaccaucuccguggacaccagcaagaaccaguucucccucaagcugagcuccgucaccgcggccgacacggccguguacuacugcgcccgccugugguacggcagcggguccuacuacuucgacuacuggggccaggggacccucgugaccgucagcucc

SEQ ID NO: 8011 - RNA, 321 nt, Artificial Sequence
  derived and/or modified sequence opt1 from HuMab-054_LightChain_VJ-Region
gacauccagaugacccagagccccuccagccuguccgccagcgugggcgaccgcgucaccaucacgugccgggccucccaggggaucagcuccuggcucgcgugguaccagcagaagccggagaaggcccccaagagccugaucuacgccgccuccagccugcaguccggcgugcccagccgcuucuccgggagcggcuccgggaccgacuucacccucaccaucagcucccugcagcccgaggacuucgccacguacuacugccagcaguacaacagcuucccgcccaccuucggcggcgggaccaagguggagaucaag

SEQ ID NO: 8012 - RNA, 357 nt, Artificial Sequence
  derived and/or modified sequence opt1 from HuMab-055_HeavyChain_VDJ-Region
gaggugcagcugcucgagagcggcgggggccugguccagcccgggggcucccugcgccucagcugcgccgccuccggguucaccuucagcuccuacgcgaugaacugggugcggcaggccccgggcaagggccuggagugggugagcgccaucuccgggcgcggcgggaccacguacuacgccgacagcgucaagggccgguucaccaucucccgcgacaacagcaaguccacccugugccuccagaugaacagccugcgggccgaggacaccgcgguguacuacugcgccaaggcccgcgccaacugggacuacuucgacuacugggggcagggcacgcuggugaccgucuccagc

SEQ ID NO: 8013 - RNA, 366 nt, Artificial Sequence
  derived and/or modified sequence opt1 from HuMab-059_HeavyChain_VDJ-Region
caggugcagcugguccagagcggcgccgaggugaagaagcccggggccuccgugcgcgucccgugcaaggcgagcggcuacaccuucacccgguacgggaucuccugggugcgccaggcccccggccaggggcucgaguggaugggcuggaucagcgccuacaacggcaagacguacuacgcccagaagcugcaggggcgggugaccaugaccaccgacacguccaccagcaccgccuacauggagcugcgcucccuccggagcgacgacaccgcggucuacuacugcgcccgcagcccccugcugugguucgaggagcucuacuucgacuacuggggccaggggacgcuggugaccguguccucc

SEQ ID NO: 8014 - RNA, 324 nt, Artificial Sequence
  derived and/or modified sequence opt1 from HuMab-059_LightChain_VJ-Region
gagaucgugcugacccagagccccggcacccucucccugagcccgggggagcgcgccacgcuguccugccgggccagccaguccgucagcuccaccuaccucgccugguaccagcagaagcccggccaggcgccccgccugcugaucuacggggccagcucccgggccaccggcauccccgaccgcuucagcggguccggcagcggcaccgacuucacgcucaccaucucccggcuggagccggaggacuucgccguguacuacugccagcaguacgggaccagccuguucaccuucggccccgggacgaagguggacaucaag

SEQ ID NO: 8015 - RNA, 366 nt, Artificial Sequence
  derived and/or modified sequence opt1 from HuMab-060_HeavyChain_VDJ-Region
gaggugcagcugguccagagcggcgccgaggugaagaagcccggggagucccucaagaucagcugcaagggcuccggguaccgcuucaccagcuacuggaucggcugggugcggcagaugccggggaagggccuggaguggaugggcuccaucuaccccggggacagcuacacccgcaacucccccagcuuccagggccaggucacgaucuccgccgacaagagcaucgcgaccgccuaccugcaguggaacucccucaaggccagcgacaccgccauguacuacugcgcccggcacgcgggggacuucuacuacuucgacggccuggacgugugggggcagggcaccacggugaccgucuccagc

SEQ ID NO: 8016 - RNA, 327 nt, Artificial Sequence
  derived and/or modified sequence opt1 from HuMab-060_LightChain_VJ-Region
gagaucgugcugacccagagccccggcacccucucccugagccccggggagcgcgccacgcuguccugccgggccagccaguccgucagcuccagcuaccucgccugguaccagcagaagcccggccaggcgccccgccugcugaucuacggggccuccagccgggccaccggcauccccgaccgcuucuccgggagcggcuccggcaccgacuucacccucacgaucagccggcuggagccggaggacuucgccguguacuacugccagcaguacggguccagcccgcccaucaccuucggccaggggacccgccuggagaucaag

SEQ ID NO: 8017 - RNA, 366 nt, Artificial Sequence
  derived and/or modified sequence opt1 from HuMab-067_HeavyChain_VDJ-Region
gaggugcagcugguccagagcggcgccgaggugaagaagcccggggagucccucaagaucagcugcaagggcuccggguacagcuucaccuccuacuggaucggcugggugcgccagaugccggggaagggccuggaguggaugggcaucaucuaccccggggacagcgacacccgguacucccccagcuuccagggccaggucacgaucuccguggacaagagcaucuccaccgccuaccugcaguggagcucccucaaggcgagcgacaccgccauguacuacugcgcccgccagaagggggacuacuacuaccacuacggccuggacgugugggggcagggcaccacggucaccguguccagc

SEQ ID NO: 8018 - RNA, 366 nt, Artificial Sequence
  derived and/or modified sequence opt1 from HuMab-072_HeavyChain_VDJ-Region
gaggugcagcugguccagagcggcgccgaggugaagaagcccggggagucccucaagaucagcugcaagggcuccggguacagcuucaccuccuacuggaucggcugggugcgccagaugccggggaagggccuggaguggaugggcaucaucuaccccggggacagcgacacccgguacucccccagcuuccagggccaggucacgaucuccgccgacaagagcaucuccaccgcguaccugcaguggagcucccucaaggccagcgacaccgccauguacuacugcgcccgccagaagggggacuacuacuacuucaacggccuggacgugugggggcagggcaccacggugaccgucuccagc

SEQ ID NO: 8019 - RNA, 327 nt, Artificial Sequence
  derived and/or modified sequence opt1 from HuMab-072_LightChain_VJ-Region
gagaucgugcugacccagagccccggcacccucucccugagcccgggggagcgcgccacgcuguccugccgggccagccaguccgucagcuccagcuaccucgccugguaccagcagaagcccggccaggcgccccgccugcugaucuacggggccuccagccgggccaccggcauccccgaccgcuucuccgggagcggcuccggcaccgacuucacccucacgaucagccggcuggagccggaggacuucgccguguacuacugccagcaguacggguccagcccccgccugaccuucggcgggggcaccaagguggagaucaag

SEQ ID NO: 8020 - RNA, 363 nt, Artificial Sequence
  derived and/or modified sequence opt1 from HuMab-084_HeavyChain_VDJ-Region
caggugcagcugguccagagcggcgccgaggugaagaagcccggguccagcgugaaggucuccugcaaggccagcggcgggaccuuccgcaccuacgcgaucaacugggugcggcaggccccgggccaggggcucgaguggaugggccgcaucaacacggugcugggcaucgucaaccacgcccagaaguuccaggggcgggugaccaucaccgccgacaaguccaccaacacggccuacauggagcugaacagccuccgcuccgaggacaccgcgguguacuacugcgcccgggagaagggcgucgacuacuacuacgggaucgagguguggggccaggggaccaccgugacggucagcucc

SEQ ID NO: 8021 - RNA, 321 nt, Artificial Sequence
  derived and/or modified sequence opt1 from HuMab-084_LightChain_VJ-Region
gacauccagaugacccagagccccuccagcguguccgccagcgucggcgaccgcgugaccaucacgugccgggccucccaggggaucagcuccuggcuggcgugguaccagcacaagccgggcaaggcccccaagcuccugaucuacguggccagcacccugcaguccgggguccccagccgcuucuccggcagcggguccggcaccgacuucacccucacgaucagcucccugcagcccgaggacuucgccaccuacuacugccagcaggccaacagcuucccgcugaccuucggcgggggcaccaagguggagaucaag

SEQ ID NO: 8022 - RNA, 360 nt, Artificial Sequence
  derived and/or modified sequence opt1 from HuMab-091_HeavyChain_VDJ-Region
caggugcagcugcagcaguggggcgccgggcuccugaagcccagcgagacccugucccugaccugcgccgucagcggcggguccuucagcggcuacuacuggacguggauccgccagccgcccgggaagggccucgaguggaucggcgagaucuaccacuccggggacaccaacuacaaccccagccugaagucccgggugaccaucagcguggacaccuccaagaaccaguucagccucaagcuguacuccgucacggcggccgacaccgccguguacuacugcgcccgccuguacuucggcagcgggaucuacuaccucgacuacuggggccaggggacccuggugaccgucuccagc

SEQ ID NO: 8023 - RNA, 321 nt, Artificial Sequence
  derived and/or modified sequence opt1 from HuMab-091_LightChain_VJ-Region
gacauccagaugacccagagccccuccagccuguccgccagcgugggcgaccgcgucaccaucacgugccgggccucccaggggaucagcuccuggcucgugugguaccagcagaagccggagaaggcgcccaagagccugaucuacgccgccuccagccugcaguccggcgugcccagccgcuucuccgggagcggcuccgggaccgacuucacccucaccaucagcucccugcagcccgaggacuucgccacguacuacugccagcaguacaacagcuucccgcccaccuucggccagggcaccaaggucgagaucaag

SEQ ID NO: 8024 - RNA, 366 nt, Artificial Sequence
  derived and/or modified sequence opt1 from HuMab-093_HeavyChain_VDJ-Region
gaggugcagcugguccagagcggcgccgaggugaagaagcccggggagucccucaagaucagcugcaagggcuccggguacagcuucaccuccuacuggaucggcugggugcggcagaugccggggaagggccuggaguggaugggccggaucuaccccggggacagcgacacccgcuacucccccagcuuccagggccaggucacgaucuccgccgacaagagcaucaccaccgcguaccugcagugguccagccuccgggccuccgacaccgccauguacuacugcgcccgccagcgcggggacuacuacuacuucuucggccuggacaucugggggcagggcacgaccgugaccgugagccug

SEQ ID NO: 8025 - RNA, 372 nt, Artificial Sequence
  derived and/or modified sequence opt1 from HuMab-098_HeavyChain_VDJ-Region
gaggugcagcugcucgagagcggcgggggccugguccagcccgggggcucccugcgccucagcugcgccgccuccggguucaccuucagcaacuacggcauguccugggugcggcaggcgccgggcaaggggcuggagugggugagcgccaucuccggcagcgccuacuccaccuacuacgccgacagcgucaaggggcgcuucacgaucucccgggacaacagcaagaacacccuguggcuccagaugaacucccugcgcgccgaggacaccgcgguguacuacugcgccaaggcccacuaccacggcagcggguccuacuacacccuguucgacuacuggggccagggcacgcucgugaccgucagcucc

SEQ ID NO: 8026 - RNA, 321 nt, Artificial Sequence
  derived and/or modified sequence opt1 from HuMab-098_LightChain_VJ-Region
gacauccagaugacccagagccccuccagccuguccgccagcgugggcgaccgcgucaccaucacgugccgggccucccaggggaucagcuccuggcucgcgugguaccagcagaagccggagaaggcccccaagagccugaucuacgccgccuccagccugcaguccggcgugcccagccgcuucuccgggagcggcuccgggaccgacuucacccucaccaucagcucccugcagcccgaggacuucgccacguacuacugccagcaguacaacagcuacccguacaccuucggccagggcaccaagcuggagaucaag

SEQ ID NO: 8027 - RNA, 372 nt, Artificial Sequence
  derived and/or modified sequence opt1 from HuMab-100_HeavyChain_VDJ-Region
gaggugcagcugcucgagagcggcgggggccugguccagcccgggggcucccugcgccucagcugcgccgccuccggguucaccuucaacaacuacggcaugaacugggugcggcaggcgccgggcaaggggcuggagugggugagcgccaucuccggcaccggguacagcacguacuacgccgacuccgucaagggccgcuucaccaucagccgggacaacuccaagaacacccuguaccuccagaugaacagccugcgcgccgaggacaccgccguguacuacugcgcgaaggcccacuacuucggguccggcagcuacuacacgcuguucgacuacuggggccaggggacccucgugaccgucuccagc

SEQ ID NO: 8028 - RNA, 372 nt, Artificial Sequence
  derived and/or modified sequence opt1 from HuMab-106_HeavyChain_VDJ-Region
gaggugcagcugguccagagcggcgccgaggugaagaagcccggggagucccucaagaucagcugcaagggcuccggguacagcuucacccgcuacuggaucggcugggugcggcagaugccggggaagggccuggaguggaugggcaucaucuaccccggggacuccgacacccgcuacagccccuccuuccagggccaggucacgaucagcgccgacaaguccaucagcaccgcguaccugcagugguccagccucaaggccuccgacaccgccauguacuacugcgcccggcugaccggggaccgcggcuucgacuacuacagcgggauggacguguggggccagggcacgaccgugaccgucuccagc

SEQ ID NO: 8029 - RNA, 321 nt, Artificial Sequence
  derived and/or modified sequence opt1 from HuMab-106_LightChain_VJ-Region
gagaucgugcugacccagagccccggcacccucucccugagcccgggggagcgcgccacgcuguccugccgggccagccaguccgucagcuccagcuaccucgccugguaccagcagaagcccggccaggcgccccgccugcugaucuacggggccuccagccgggccaccggcauccccgaccgcuucuccgggagcggcuccggcaccgacuucacccucacgaucagccggcuggagccggaggacuucgccguguacuacugccagcaguacggguccagcuucaccuucggccccgggaccaagguggacaucaag

SEQ ID NO: 8030 - RNA, 351 nt, Artificial Sequence
  derived and/or modified sequence opt1 from HuMab_10F8_HeavyChain_V-Region
caggugcagcuggucgagagcggcgggggcguggugcagcccgggcgcucccuccggcugagcugcaccgccuccggcuucaccuucagccacuacgggauguacuggguccgccaggccccgggcaagggccuggaguggguggcggugaucugguacgacggguccuacgaguacaacgaggacagcgucaagggccgguucacgaucucccgcgacaacagcaagaacacccucuaccugcagaugaacucccugcgggccgaggacaccgccguguacuacugcgcccgcgaccgggugggccucuucgacuacugggggcaggggacccuggucacggugagcucc

SEQ ID NO: 8031 - RNA, 408 nt, Artificial Sequence
  derived and/or modified sequence opt1 from HuMab_10F8_HeavyChain_V-Region_Precursor
auggaguucggccugagcuggguguuccucgucgcccugcugcgcggggugcagugccaggugcagcucgucgaguccggcgggggcguggugcagcccgggcggagccugcgccuguccugcaccgccagcggcuucaccuucucccacuacggcauguacuggguccggcaggcgccggggaagggccucgaguggguggccgugaucugguacgacgggagcuacgaguacaacgccgacuccgucaagggccgcuucacgaucagccgggacaacuccaagaacacccuguaccugcagaugaacagccuccgcgccgaggacaccgccguguacuacugcgcgcgggaccgcguggggcuguucgacuacuggggccagggcacccuggucacgguguccagc

SEQ ID NO: 8032 - RNA, 321 nt, Artificial Sequence
  derived and/or modified sequence opt1 from HuMab_10F8_LightChain_V-Region
gagaucgugcugacccagagccccggcacccucucccugagcccgggggagcgcgccacgcuguccugccgggccagccaguccaucagcuccagcuaccucgccugguaccagcagaagcccggccaggcgccccgccugcugaucuacgggcccuccagccgggccaccggcaucccggaccgcuucuccgggagcggcuccggcaccgacuucacccucacgaucagccggcuggagcccgaggacuucgccgucuacuacugccagcaguacgccgggucccugaccuucggccccgggaccaagguggacaucaag

SEQ ID NO: 8033 - RNA, 381 nt, Artificial Sequence
  derived and/or modified sequence opt1 from HuMab_10F8_LightChain_V-Region_Precursor
auggagacccccgcccagcuccuguuccugcugcuccuguggcugccggacaccacgggcgagaucgugcucacccagagccccgggacccugucccugagccccggcgagcgcgccacccucuccugccgggcgagccaguccaucagcuccagcuaccuggccugguaccagcagaagcccgggcaggccccgcgccugcucaucuacggccccuccagccgggccacggggauccccgaccgcuucuccggcagcggcuccgggaccgacuucacccugaccaucagccggcuggagcccgaggacuucgccgucuacuacugccagcaguacgcgggcucccucacguucgggccgggcaccaagguggacaucaag

SEQ ID NO: 8034 - RNA, 357 nt, Artificial Sequence
  derived and/or modified sequence opt1 from HuMab-111_HeavyChain_VDJ-Region
caggugcagcugguccagagcggcgccgaggugaagaagcccggguccagcgugaaggucuccugcaaggccagcggcgggaccuucuccagcuacggcaucuccugggugcgccaggcgccggggcccggccucgaguggaugggccggaucauccccauccuggggaucgccaacuacgcccagaaguuccagggccgcgugaccaucacggccgacaagagcaccaacaccgccuacauggagcuguccagccuccgguccgaggacaccgcggucuacuacugcgcccgcgaccaggaguacagcuccaacugguacuacugggggcagggcacgcuggugaccgugagcucc

SEQ ID NO: 8035 - RNA, 321 nt, Artificial Sequence
  derived and/or modified sequence opt1 from HuMab-111_LightChain_VJ-Region
gagaucgugcugacccagagccccggcacccucucccugagcccgggggagcgcgccacgcuguccugccgggccagccaguccguccgcagcuccuaccucgccugguaccagcagaagcccggccaggcgccccggcugcugaucuacggggccagcucccgcgccaccggcauccccgaccgguucagcggguccggcagcggcaccgacuucacccucacgaucucccgccuggagccggaggacuucgccguguacuacugccagcuguacgggagcucccccaccuucggccccgggaccaagguggacaucaag

SEQ ID NO: 8036 - RNA, 363 nt, Artificial Sequence
  derived and/or modified sequence opt1 from HuMab-123_HeavyChain_VDJ-Region
caggugcagcugguccagagcggcgccgaggugaagaagcccggggccuccgugaaggucagcugcaaggcggccggcuacaccuucaccaacuacgggaucuccugggugcgccaggccccgggccaggcccucgaguggaugggguggaucacgaccuacagcuccaacaccaucuacgcccagaagcugcagggccgggugaccaugacgaccgacaccagcaccuccacggcguacauggagcugcgcagccuccgguccgacgacaccgccgucuacuacugcgcccgcgaccggguggugguccgccccgacuacuucgacuacuggggccaggggacccuggugaccgugagcucc

SEQ ID NO: 8037 - RNA, 321 nt, Artificial Sequence
  derived and/or modified sequence opt1 from HuMab-123_LightChain_VJ-Region
gagaucgugcugacccagagccccgccacccucucccugagcccgggcgagcgcgccacgcuguccugccgggcgagccaguccgucagcuccuaccucgccugguaccagcagaagcccgggcaggcgccccgccugcugaucuacgacaccagcaaccgggccaccggcauccccgcccgcuucuccgggagcggcuccgggaccgacuucacgcucaccaucagcucccuggagccggaggacuucgccguguacuacugccagcagcggagccacuggccccgcaccuucggccagggcaccaagguggagaucaag

SEQ ID NO: 8038 - RNA, 363 nt, Artificial Sequence
  derived and/or modified sequence opt1 from HuMab-124_HeavyChain_VDJ-Region
caggugcagcugguccagagcggcgccgaggugaagaagcccggggccuccgugaaggucagcugcaaggcggccggcuacaccuucaccaacuacgggaucuccugggugcgccaggccccgggccaggggcucgaguggaugggcuggaucaucacguacaacggcaacaccaucuacgcccagcgguuccaggaccgcgugaccaugaccacggacaccagcaccuccaccgccuacauggagcugcggagccugcgcuccgacgacacggcggucuacuacugcgcccgggaccgcaucaucgugcggcccgacuacuucgacuacugggggcagggcacccucgugaccgucagcucc

SEQ ID NO: 8039 - RNA, 372 nt, Artificial Sequence
  derived and/or modified sequence opt1 from HuMab-125_HeavyChain_VDJ-Region
gaggugcagcugcucgagagcggcgggggccugguccagcccgggggcucccugcgccucagcugcgccgccuccggguucaccuucaccgacuacgcgaugaacugggugcggcaggccccgggcaagggccuggagugggugagcacgaucuccgggagcggcuacgccaccuacuacgccgacuccgucaaggggcgcuucaccaucagccgggacaacuccaagaccacgcuguaccuccagaugaacagccugcgcgccgaggacaccgcgguguacuacugcgccaagggccacacccugggguccggcagcuacuacacccucuucgacuacuggggccaggggacgcuggugaccgucuccagc

SEQ ID NO: 8040 - RNA, 321 nt, Artificial Sequence
  derived and/or modified sequence opt1 from HuMab-125_LightChain_VJ-Region
gacauccagaugacccagagccccuccagccuguccgccagcgugggcgaccgcgucaccaucacgugccgggccucccaggggaucaacagcuggcucgcgugguaccagcagaagccggagaaggcccccaagucccugaucuacgccgccagcucccugcagagcggcgugcccucccgcuucagcggguccggcagcgggaccgacuucacccucaccaucuccagccugcagcccgaggacuucgccacguacuacugccagcaguacaacuccuacccguacaccuucggccagggcaccaagcuggagaucaag

SEQ ID NO: 8041 - RNA, 369 nt, Artificial Sequence
  derived and/or modified sequence opt1 from HuMab-127_HeavyChain_VDJ-Region
gaggugcagcugguccagagcggcgccgaggugaagaagcccggggagucccucaccaucagcugcaagggcuccggguacagcuucuccaucuacuggaucggcugggugcgccagaugccggggaagggccuggaguggaugggcaucaucuuccccggggacagcgacauccgguacucccccagcuuccagggccaggucaccaucuccgccgacaagagcaucuccacggcguaccugcaguggagcucccucaaggccagcgacaccgccauguacuacugcgcccgccagcccggggacugguccccgcggcacugguacuucgaccuguggggccgcgggacccuggugaccgugagcucc

SEQ ID NO: 8042 - RNA, 321 nt, Artificial Sequence
  derived and/or modified sequence opt1 from HuMab-127_LightChain_VJ-Region
gugaucuggaugacccagagccccucccugcucagcgccuccaccggcgaccgcgucacgaucagcugccggaugucccaggggaucagcuccuaccuggccugguaccagcagaagccgggcaaggcgcccgagcugcucaucuacgccgccagcacccugcaguccggggugcccagccgcuucuccggcagcggguccggcaccgacuucacccugacgaucagcuaccuccaguccgaggacuucgccaccuacuacugccagcaguacuacagcuucccccugaccuucggcgggggcaccaagguggagaucaag

SEQ ID NO: 8043 - RNA, 357 nt, Artificial Sequence
  derived and/or modified sequence opt1 from HuMab-129_HeavyChain_VDJ-Region
caggugcagcuggucgagagcggcgggggcguggugcagcccgggcgcucccuccggcugagcugcgccgccuccggcuucaccuucagcaccuucgcgauccacuggguccgccaggccccggggaagggccuggaguggguggccgugaucuccuacgacggcgggcacaaguucuacgccgacagcgucaagggccgguucacgaucucccgcgacaacagcaagaacacccucuaccugcagaugaacucccugcgggccgaggacaccgcgauguacuacugcgcccgcgggcucggcguguggggcgccuucgacuacugggggcagggcacccuggugacggucagcucc

SEQ ID NO: 8044 - RNA, 318 nt, Artificial Sequence
  derived and/or modified sequence opt1 from HuMab-129_LightChain_VJ-Region
gagaucgugcugacccagagccccgccacccucucccugagcccgggcgagcgcgccacgcuguccugccgggcgagccaguccgucagcuccuaccucgccugguaccagcagaagcccgggcaggcgccccgccugcugaucuacgacgccagcaaccgggccaccggcauccccgcccgcuucuccgggagcggcuccgggaccgacuucacccucacgaucagcucccuggagccggaggacuucgccguguacuacugccagcagcggagcaacugguggaccuucggccagggcaccaagguggagaucaag

SEQ ID NO: 8045 - RNA, 375 nt, Artificial Sequence
  derived and/or modified sequence opt1 from HuMab-132_HeavyChain_VDJ-Region
caggugcagcugguccagagcggcgccgaggugaagaagcccggggccuccgugaaggucagcugcaaggcguccggcuacaccuucaccagcuacgggaucuccugggugcgccaggccccgggccaggggcucgaguggaugggcuggaucagcgccuacaacggcaacuccaacuacgugcagaaguuccaggggcgggucacgaugaccaccgacaccacgaccagcaccgccuacauggagcugcgcucccugaccagcgacgacacggccguguacuacugcgcgcgggaguacuccuacgacagcggcaccuacuucuacuacgggauggacguguggggccaggggaccaccgucacgguguccagc

SEQ ID NO: 8046 - RNA, 324 nt, Artificial Sequence
  derived and/or modified sequence opt1 from HuMab-132_LightChain_VJ-Region
gagaucgugcugacccagagccccgccacccucucccugagcccgggcgagcgcgccacgcuguccugccgggcgagccaguccgucagcuccuaccucgccugguaccagcagaagcccgggcaggcgccccgccugcugaucuacgacgccagcaaccgggccaccggcauccccgcccgcuucuccgggagcggcuccgggaccgacuucacccucacgaucagcucccuggagccggaggacuucgccguguacuacugccagcagcggagcaacuggcccauguacaccuucggccagggcaccaagcuggagaucaag

SEQ ID NO: 8047 - RNA, 360 nt, Artificial Sequence
  derived and/or modified sequence opt1 from HuMab-143_HeavyChain_VDJ-Region
caggugcagcugcagcaguggggcgccgggcuccugaagcccagcgagacccugucccugaccugcgccgucuacggcgggagcuucuccggcuacuacuggaacuggauccgccagccgcccgggaagggccucgaguggaucggcgagauccaccacagcggguccgcgaacuacaaccccagccugaugucccgggugacgaucagcguggacaccuccaagaaccaguucagccuccagcuguccagcgucaccgccgccgacaccgccguguacuacugcgcccgcggcuacuacggguccggcuacuacuacuucgacuacugggggcagggcacgcuggugaccgucagcucc

SEQ ID NO: 8048 - RNA, 321 nt, Artificial Sequence
  derived and/or modified sequence opt1 from HuMab-143_LightChain_VJ-Region
gacauccagaugacccagagccccuccagccuguccgccagcgugggcgaccgcgucaccaucacgugccgggccucccaggggaucagcuccuggcucgcgugguaccagcagaagccggagaaggcccccaagagccugaucuacgccgccucccgccugcagagcggcgugcccucccgguucagcggguccggcagcgggaccgacuucacccucaccaucuccagccugcagcccgaggacuucgccacguacuacugccagcaguacaacuccuacccgaucaccuucggccagggcacccgccuggagaucaag

SEQ ID NO: 8049 - RNA, 366 nt, Artificial Sequence
  derived and/or modified sequence opt1 from HuMab-150_HeavyChain_VDJ-Region
gaggugcagcugguccagagcggcgccgaggugaagaagcccggggagucccucaagaucagcugcaagggcuccggguacagcuucaccuccuacuggaucggcugggugcgccagaugccggggaagggccuggaguggaugggcagcaucuaccccggggacucccacacccgguaccgccccagcuuccagggccaggucacgaucuccgccgacaagagcaucuccaccgcguaccugcaguggagcucccucaaggccagcgacaccgccauguacuacugcgcccggcaggccggggacuacuacuacuacaacggcauggacgugugggggcagggcaccacggugaccgucuccagc

SEQ ID NO: 8050 - RNA, 321 nt, Artificial Sequence
  derived and/or modified sequence opt1 from HuMab-150_LightChain_VJ-Region
gagaucgugcugacccagagccccggcacccucucccugagcccgggggagcgcgccacgcuguccugccgggccagccaguccgucagcuccagcuaccucaccugguaccagcagaagcccggccaggcgccccgccugcugaucuacggggccuccagccgggccaccggcauccccgaccgcuucuccgggagcggcuccggcaccgacuucacgcucaccaucagccggcuggagccggaggacuucgccguguacuacugccagcaguacggguccagccugaccuucggcgggggcaccaagguggagaucaag

SEQ ID NO: 8051 - RNA, 363 nt, Artificial Sequence
  derived and/or modified sequence opt1 from HuMab-152_HeavyChain_VDJ-Region
caggugcaggucguggagagcggcgggggcgugguccagcccgggcgcucccugcggcucagcugcgccgccuccggcuucaccuucagcuccuacgcgaugcacugggugcgccaggccccggggaagggccuggaguggguggccgucaucagcuacgacggcuccuacaaguacuacgccgacagcgugaaggggcgguucaccaucucccgcgacaacagcaagaacacgcuguaccuccagaugaacucccugcgggccgaggacaccgcgguguacuacugcgcccgcggcagcaucaccggguccaccggcgucuucgacuacugggggcagggcacgcuggugaccgugagcucc

SEQ ID NO: 8052 - RNA, 321 nt, Artificial Sequence
  derived and/or modified sequence opt1 from HuMab-152_LightChain_VJ-Region
gacauccagaugacccagagccccuccagccuguccgccagcgugggcgaccgcgucaccaucacgugccgggccucccaggggaucaacagcuggcucgcgugguaccagcagaagccggagaaggcccccaagucccugaucuacgacgccagcucccugcagagcggcgugcccucccgcuucagcggguccggcagcgggaccgacuucacccucaccaucuccagccugcagcccgagaacuucgccacguacuacugccagcaguacaacuccuacccgaucaccuucggccagggcacccggcuggagaucaag

SEQ ID NO: 8053 - RNA, 363 nt, Artificial Sequence
  derived and/or modified sequence opt1 from HuMab-153_HeavyChain_VDJ-Region
caggugcagcuggucgagagcggcgggggcguggugcagcccgggcgcucccuccggcugagcugcgccgccuccggcuucaccuucagcgacuacgucauccacugggugcgccaggcgccggggaagggccuggagugggugaccgucaucuccuacgacggcagcaacaaguacuacgccgacuccgugaaggggcgguucacgaucagccgcgacaacuccaagaacacccucuaccugcagaugaacagccuguccgccgaggacaccgccauguacuacugcgcccggggcgggaucaccggcacgaccgggguguucgacuacuggggccagggcacccucgucaccgugagcucc

SEQ ID NO: 8054 - RNA, 321 nt, Artificial Sequence
  derived and/or modified sequence opt1 from HuMab-153_LightChain_VJ-Region
gacauccagaugacccagagccccuccagccuguccgccagcgugggcgaccgcgucaccaucacgugccgggccucccaggggaucagcuccuggcucgcgugguaccagcagaagccggagaaggcccccaagagccugaucuacgacgccuccagccugcaguccggcgugcccagccgcuucuccgggagcggcuacgggaccgacuucucccucaccaucagcucccugcagcccgaggacuucgccaucuacuacugccagcaguacaagagcuacccgaucaccuucggccagggcacgcggcuggagaucaag

SEQ ID NO: 8055 - RNA, 378 nt, Artificial Sequence
  derived and/or modified sequence opt1 from HuMab-159_HeavyChain_VDJ-Region
gaggugcagcugguccagagcggcgccgaggugaagaagcccggggagucccucaagaucagcugcaagggcuccggguacaacuucaccagcuacuggaucggcugggugcgccagaugccggggaagggccuggaguggaugggcaucaucuaccccggggacuccgacacccgguacagccccuccuuccagggccaggucacgaucagcgccgacaaguccaucagcaccgcguaccugcagugguccagccucaaggccuccgacaccgccauguacuacugcgcccgcugggggaccuacuacgacauccugacgggcuacuucaacugguucgaccccugggggcagggcacccuggugaccgugagcucc

SEQ ID NO: 8056 - RNA, 321 nt, Artificial Sequence
  derived and/or modified sequence opt1 from HuMab-159_LightChain_VJ-Region
gacauccagaugacccagagccccuccagccuguccgccagcgugggcgaccgcgucaccaucacgugccgggccucccaggggaucagcuccuggcucgcgugguaccagcagaagccggagaaggcccccaagagccugaucuacgccgccuccagccugcaguccggcgugcccagccgcuucuccgggagcggcuccgggaccgacuucacccucaccaucagcucccugcagcccgaggacuucgccacguacuacugccagcaguacuacaucuacccguggaccuucggccagggcaccaagguggagaucaag

SEQ ID NO: 8057 - RNA, 363 nt, Artificial Sequence
  derived and/or modified sequence opt1 from HuMab-160_HeavyChain_VDJ-Region
caggugcagcuggucgagagcggcgggggcguggugcagcccgggcgcucccuccggcugagcugcgccgccuccggcuucaccuucagcucccacgcgaugcacuggguccgccaggccccggggaagggccuggaguggguggccgccaucagcuacgacggcuccaacaaguacuacgccgacagcgugaaggggcgguucaccaucucccgcgacaacagcaagaacacgauguaccuccagaugaacucccugcgggcggaggacaccgccaugugcuacugcgcccgcggcagcaucaccggguccaccggcgucuucgacuacugggggcagggcacgcuggugaccgugagcucc

SEQ ID NO: 8058 - RNA, 321 nt, Artificial Sequence
  derived and/or modified sequence opt1 from HuMab-160_LightChain_VJ-Region
gacauccagaugacccagagccccuccagccuguccgccagcgugggcgaccgcgucaccaucacgugccgggccucccaggacaucagcuccuggcucgcgugguaccagcagaagccggagaaggcccccaagagccugaucuacgccgccuccagccugcaguccggggugcccagccgcuucuccggcagcggguccggcaccgacuucacccucaccaucagcucccugcagcccgaggacuucgccacguacuacugccagcaguacaacagcuacccgaucaccuucgggcagggcacccggcuggagaucaag

SEQ ID NO: 8059 - RNA, 372 nt, Artificial Sequence
  derived and/or modified sequence opt1 from HuMab-162_HeavyChain_VDJ-Region
gaggugcagcugugggagagcggcgggggcuccguccagcccgggggcagccuccgccuguccugcgccgccagcggguucaccuucuccagcuacggcauguccugggugcggcaggcgccgggcaaggggcuggagugggugagcggcaucuccgggagcggcuacuccaccuacuacgccgacagcgucaaggggcgcuucacgaucucccgggacaacagcaagaacacccucuaccugcagaugaacucccugcgcgccgaggacaccgccguguacuacugcgccaagggcuacuaccacggcagcggguccuacuacaccagcuucgacuacuggggccaggggacgcucgugaccgucuccagc

SEQ ID NO: 8060 - RNA, 321 nt, Artificial Sequence
  derived and/or modified sequence opt1 from HuMab-162_LightChain_VJ-Region
gacauccagaugacccagagccccuccagccuguccgccagcgugggcgaccgcgucaccaucacgugccgggccucccaggggaucagcuccuggcucgcgugguaccagcagaagccggagaaggcccccaagagccugaucuacgccgccuccagccugcaguccggcgugcccagccgcuucuccgggagcggcuccgggaccgacuucacccucaccaucagcucccugcagcccgaggacuucgccacguacuacugccagcaguacaacagcuacccgcugaccuucggcggcgggaccaagguggagaucaag

SEQ ID NO: 8061 - RNA, 366 nt, Artificial Sequence
  derived and/or modified sequence opt1 from HuMab-163_HeavyChain_VDJ-Region
gaggugcagcugguccagagcggcgccgaggugaagaagcccggggagucccucaagaucagcugccagggcuccggguaccgguucaucagcuacuggaucggcugggugcggcagaugccggggaagggccuggaguggaugggccgcaucuaccccggggacuccgacacccgguacagccccuccuuccagggccaggucaccaucagcguggacaaguccaucagcacggccuaccugcagugguccagccucaaggcguccgacaccgccauguacuacugcgcccgccagcgcggggacuacuacuacuucaacggccuggacgugugggggcagggcaccaccgucacggugagcucc

SEQ ID NO: 8062 - RNA, 321 nt, Artificial Sequence
  derived and/or modified sequence opt1 from HuMab-163_LightChain_VJ-Region
gagaucgugcugacccagagccccggcacccucucccugagcccgggggagcgcgccacgcuguccugccgggccagccaguccgucagcuccagcuaccucgccugguaccagcagaagcccggccaggcgccccgccugcugaucuacggggccuccagccgggccaccggcauccccgaccgcuucuccgggagcggcuccggcaccgacuucacccucacgaucagccggcuggagccggaggacuucgccguguacuacugccagcaguacggguccagccugaccuucggcgggggcaccaagguggagaucaag

SEQ ID NO: 8063 - RNA, 363 nt, Artificial Sequence
  derived and/or modified sequence opt1 from HuMab-166_HeavyChain_VDJ-Region
caggugcagcuggucgagagcggcgggggcguggugcagcccgggcgcucccuccggcugagcugcgccgccuccggcuucaccuucagcuccuacgcgaugcacuggguccgccaggccccggggaagggccuggaguggguggccgugaucagcuacgacggcuccaacgaguacuacgccgacagcgucaaggggcgguucaccaucucccgcgacaacagcaagaacacgcucuaccugcagaugaacucccugcgggccgaggacaccgcgguguacuacugcgcccgcggcagcaucaucggguccaccggcguguucgacuacugggggcagggcacccucgucacggugagcucc

SEQ ID NO: 8064 - RNA, 321 nt, Artificial Sequence
  derived and/or modified sequence opt1 from HuMab-166_LightChain_VJ-Region
gacauccagaugacccagagccccuccagccuguccgccagcgugggcgaccgcgucaccaucacgugccgggccucccaggggaucagcaacuggcucgcgugguaccagcagaagccggagaaggcccccaagucccugaucuacgacgccagcucccugcagagcggcgugcccucccgcuucagcggguccggcagcgggaccgacuucacccucaccaucuccagccugcagcccgaggacuucgccacguacuacugccagcaguacaacuccuacccgaucaccuucggccagggcacccggcuggagaucaag

SEQ ID NO: 8065 - RNA, 363 nt, Artificial Sequence
  derived and/or modified sequence opt1 from HuMab-167_HeavyChain_VDJ-Region
caggugcagcuggucgagagcggcgggggcguggugcagcccgggcgcucccuccggcugagcugcgccgccuccggcuucaccuucagcuccuacgcgauccacuggguccgccaggccccggggaagggccuggaguggguggccgugaucagcuacgacggcuccaacaaguacuacgccgacagcgucaaggggcgguucaccaucucccgcgacaacagcaagaacacgcucuaccugcagaugaacucccugcgggccgaggacaccgcgguguacuacugcgcccgcggcagcaucaccggguccaccggcguguucgacuacugggggcagggcacgcucgucaccgugagcucc

SEQ ID NO: 8066 - RNA, 363 nt, Artificial Sequence
  derived and/or modified sequence opt1 from HuMab-169_HeavyChain_VDJ-Region
caggugcagcugguccagagcggcgccgaggugaagaagcccggggccuccgugaaggucagcugcaaggcguccggcuacaccuucaccaacuacgggaucagcugggugcgccaggccccgggccaggggcucgaguggaugggcuggcuguccgccuacagcggcaacacgaucuacgcccagaagcugcaggggcgggugaccaugaccaccgacacguccaccaccaccgccuacauggagcuccgcagccugcgguccgacgacacggcggucuacuacugcgcccgcgaccggaucguggugcgccccgacuacuucgacuacuggggccaggggacccuggucaccgugagcucc

SEQ ID NO: 8067 - RNA, 321 nt, Artificial Sequence
  derived and/or modified sequence opt1 from HuMab-169_LightChain_VJ-Region
gagaucgugcugacccagagccccgccacccucucccugagcccgggcgagcgcgccacgcuguccugccgggcgagccaguccgucagcuccuaccucgccugguaccagcagaagcccgggcaggcgccccgccugcugaucuacgacgccagcaaccgggccaccggcauccccgcccgcuucuccgggagcggcuccgggaccgacuucacccucacgaucagcucccuggagccggaggacuucgccguguacuacugccagcagcggagcaacuggccccgcaccuucggccagggcaccaagguggagaucaag

SEQ ID NO: 8068 - RNA, 366 nt, Artificial Sequence
  derived and/or modified sequence opt1 from HuMab-7D8_HeavyChain_VH-Region
gaggugcagcuggucgagagcggcgggggccucgugcagcccgaccgcucccugcggcugagcugcgccgccuccggguucaccuuccacgacuacgcgaugcacugggugcgccaggccccgggcaaggggcucgagugggucagcaccaucuccuggaacagcggcacgaucggcuacgccgacuccgugaaggggcgguucaccaucagccgcgacaacgccaagaacucccuguaccugcagaugaacagccuccgggccgaggacaccgcgcuguacuacugcgccaaggacauccaguacggcaacuacuacuacgggauggacguguggggccaggggaccacggucaccguguccagc

SEQ ID NO: 8069 - RNA, 366 nt, Artificial Sequence; identical to SEQ ID NO: 8068
  derived and/or modified sequence opt1 from HuMab-7D8_HeavyChain_V-Region

SEQ ID NO: 8070 - RNA, 321 nt, Artificial Sequence
  derived and/or modified sequence opt1 from HuMab-7D8_LightChain_VL-Region
gagaucgugcugacccagagccccgccacccucucccugagcccgggcgagcgcgccacgcuguccugccgggcgagccaguccgucagcuccuaccucgccugguaccagcagaagcccgggcaggcgccccgccugcugaucuacgacgccagcaaccgggccaccggcauccccgcccgcuucuccgggagcggcuccgggaccgacuucacccucacgaucagcucccuggagccggaggacuucgccguguacuacugccagcagcggagcaacuggcccaucaccuucggccagggcacccgccuggagaucaag

SEQ ID NO: 8071 - RNA, 321 nt, Artificial Sequence; identical to SEQ ID NO: 8070
  derived and/or modified sequence opt1 from HuMab-7D8_LightChain_V-Region

SEQ ID NO: 8072 - RNA, 324 nt, Artificial Sequence
  derived and/or modified sequence opt1 from huMAb-anti-MSP10.1_LightChain_VJ-Region
gagaucgugcugacccagagccccgacauccucucccugagcccgggcgagcgcgccacccuguccugccgggccagccaggcgcucacggccaaguaccuggccugguaccagcagaagcccgggcaggucccccgccugcucaucuacggcuccagcacccgggccaccgggauccccgaccgcuuccggggcuccgggagcggcaccgacuucacgcugaccaucucccgccuggagccggccgacagcgcgguguacuacugccagcaguacgaggacucccccuggaccuucggccaggggaccaagcucgagaucaag

SEQ ID NO: 8073 - RNA, 324 nt, Artificial Sequence
  derived and/or modified sequence opt1 from huMAb-anti-MSP10.2_LightChain_VJ-Region
gagaucgugcugacccagagccccgacacccucucccugagcccgggcgagacggccacccuguccugccgcgccagccagaccguccggcgcaacucccucgccugguaccagcagaagcccgggcaggcgccccggcugcugaucuacggcgccagcgaccgcgccaccgggauccccgaccgguucuccggcagcggguucggcacggacuucacccucaccguguccggccuggagccggaggacuucgccguguacuacugccagcaguacgggaccagcccccgcacguucggccaggggaccaagcuggagaucaag

SEQ ID NO: 8074 - RNA, 324 nt, Artificial Sequence
  derived and/or modified sequence opt1 from HUMAB-Clone_18_VJ-Region
gagaucgugcugacccagagccccgccacccucucccugagccccggcgagcgcgccacgcuguccugccgggcgagccaguccgucagcuccuaccucgccugguaccagcagaagcccgggcaggcgccccgccugcugaucuacgacgccagcaagcgggccaccggcauccccgcccgcuucuccgggagcggcuccgggaccgacuucacccucacgaucagcucccuggagccggaggacuucgccguguacuacugccagcagcggagcaaguggccgcccuggaccuucggccagggcaccaagguggaguccaag

SEQ ID NO: 8075 - RNA, 324 nt, Artificial Sequence
  derived and/or modified sequence opt1 from HUMAB-Clone_22_VJ-Region
gagaucgugcugacccagagccccgccacccucucccugagccccggcgagcgcgccacgcuguccugccgggcgagccaguccgucagcuccuaccucgccugguaccagcagaagcccgggcaggcgccccgccugcugaucuacgacgccagcaaccgggccaccggcauccccgcccgcuucuccgggagcggcuccgggaccgacuucacccucacgaucagcucccuggagccggaggacuucgccguguacuacugccagcagcggagcaaguggccgcccuggaccuucggccagggcaccaagguggagaucaag

SEQ ID NO: 8076 - RNA, 432 nt, Artificial Sequence
  derived and/or modified sequence opt1 from HuMab-L612_Chain_VDJ-Region_Precursor
auggaguucggccugaccuggcuguuccucguggccaaccugaaggggguccagugcgaggugcagcuccuggacagcggcgggggccuggugcagcccgggggcugccuccgccuguccugcgccgcgagcggcuucaccuucuccagcugcgccauguccuggguccggcaggccccggggaagggccuggagugggugagcgccaucuccgggagcggcggguccacguacuacgccgacagcgugaagggccgcuucaccaucucccgggacaagagcaagaacacccucuaccugcagaugaacucccugcgcgcggaggacaccgccgucuacuacugcgccaagggcgggaacgacauccucacgggcuacuacgccugggggcagggcacccuggugaccgugagcuccggcagcgcguccgcc

SEQ ID NO: 8077 - RNA, 321 nt, Artificial Sequence
  derived and/or modified sequence opt1 from HuMab_LC5002-002_LightChain_V-Region
gacauccagaugacccagagccccuccagccuguccgccagcgugggcgaccgcgucaccaucacgugccgggccucccaggggaucagccgcuggguggcgugguaccagcagaagccggagaaggcccccaagucccucaucuacgccgccagcucccugcagagcggcgugcccucccgguucagcggguccggcagcgggaccgacuucacccugaccaucuccagccuccagcccgaggacuucgccacguacuacugccagcaguacaacuccuacccguggaccuucggccagggcaccaaggucgagaucaag

SEQ ID NO: 8078 - RNA, 357 nt, Artificial Sequence
  derived and/or modified sequence opt1 from HuMab_LC5002-002_gamma1-Chain_V-Region
gaggugcagcugcucgagagcggcgggggccugguccagcccgggggcucccugcgccucagcugcgccgccuccggguucaccuucaacaucuacgcgaugaacugggugcggcaggccccgggcaagggccuggagugggugagcgucaucuccgggcgcggcaucaccacguacuacgccgacagcgugaaggggcgguucaccaucucccgcgacaacagcaagaacacccuguaccuccagaugaacucccugcgggccgacgacaccgccguguacuacugcgcgaagggcagcuccagcuggacggacuucgacuacugggggcagggcacccuggucaccguguccagc

SEQ ID NO: 8079 - RNA, 321 nt, Artificial Sequence
  derived and/or modified sequence opt1 from HuMab_LC5002-003_LightChain_V-Region
gacauccagaugacccagagccccuccagccuguccgccagcgugggcgaccgcgucaccaucacgugccgggccucccaggggaucagcuccuggcucgcgugguaccagcagaagccggagaaggcccccaagagccugaucuacgccgccuccagccugcaguccggcgugcccagccgcuucuccgggagcggcuccgggaccgacuucacccucaccaucagcucccugcagcccgaggacuucgccacguacuacugccagcaguacaacagcuacccguggaccuucggccagggcaccaagguggagaucaag

SEQ ID NO: 8080 - RNA, 357 nt, Artificial Sequence
  derived and/or modified sequence opt1 from HuMab_LC5002-003_gamma1-Chain_V-Region
gaggugcagcugcucgagagcggcggggaccugauccagcccggcgggucccugcgccucagcugcgccgccuccggcuucaccuucaacaucuacgcgaugaacuggguccggcaggccccggggaagggccuggagugggugagcgugaucuccggccgcgggaucaccacguacuacgccgacagcgucaagggccgguucaccaucucccgcgacaacagcaagaacacccuguaccuccagauggacucccugcgggccgaggacaccgccguguacuacugcgcgaaggggagcuccuacuggacggacuucgacuacuggggccaggggacccuggugaccgucagcucc

SEQ ID NO: 8081 - RNA, 321 nt, Artificial Sequence
  derived and/or modified sequence opt1 from HuMab_LC5002-005_LightChain_V-Region
gacauccagaugacccagagccccuccagccuguccgccagcgugggcgaccgcgucaccaucacgugccgggccucccaggggaucagcuccuggcucgcgugguaccagcagaagccggagaaggcccccaagagccugaucuacgccgccuccagccugcaguccggcgugcccagccgcuucuccgggagcggcuccgggaccgacuucacccucaccaucagcucccugcagcccgaggacuucgccacguacuacugccagcaguacaacagccacccgcccaccuucggccagggcaccaagcuggagaucaag

SEQ ID NO: 8082 - RNA, 354 nt, Artificial Sequence
  derived and/or modified sequence opt1 from HuMab_LC5002-005_gamma1-Chain_V-Region
gaggugcagguccuggacagcggcgggggccucgugcagcccgggggcucccugcgccugagcugcaccgccuccggguucaccuuccggcucuacacgaugagcugggugcgccagaccccgggccggggccuggagugggucuccgggaucagcggcuccgggcugagcaccuacuucgccgacuccgugaagggccgcuucaccaucagccgggacaacuccaagaacacgguguaccuccagaugaacagccugcgcgcggaggacaccgccgucuacuacugcgccaaggagggggacuggaucuacuucgacuccuggggccagggcacccuggugaucgugagcucc

SEQ ID NO: 8083 - RNA, 321 nt, Artificial Sequence
  derived and/or modified sequence opt1 from HuMab_LC5002-007_LightChain_V-Region
gagaucgugcugacccagagccccggcacccucucccugagcccgggggagcgcgccacgcuguccugccgggccagccaguccgucagcuccagcuaccucgccugguaccagcagaagcccggccaggcgccccgccugcugaucuacggggccuccagccgggccaucggcauccccgaccgcuucuccgggagcggcuccggcaccgacuucacccucaccaucagccggcuggagccggaggacuucgccguguacuacugccagcacuacggguccagccugacguucggcgggggcaccaagguggagaucaag

SEQ ID NO: 8084 - RNA, 369 nt, Artificial Sequence
  derived and/or modified sequence opt1 from HuMab_LC5002-007__gamma1-Chain_V-Region
caggugcagcugguccagagcggcgccgaggugaagaagcccggguccagcgugaaggucuccugcaaggugagcggcgggaccuucuccagcuacgccuucuccugggugcgccaggcgccgggccaggggcucgaguggaugggccggaucauccccauccugggccgcaccaacuacgcccagaaguuccaggggcgggucacgaucaccgccgacaagagcaccuccaccgccuacauggaggugagcucccugcgcagcgaggacacggccguguacuacugcgcgcgggagggcgagacccucgacuacuucuacuacgggauggacgucuggggccaggggaccaccgugacgguguccagc

SEQ ID NO: 8085 - RNA, 357 nt, Artificial Sequence
  derived and/or modified sequence opt1 from HuMab_LC5002-018_gamma1-Chain_V-Region
gaggugcagcugcucgagagcggcgggggccugguccagcccgggggcucccugcgccucagcugcgccgccuccggguucaccuucaacaucuacgcgaugaacugggugcggcaggccccgggcaagggccuggagugggugagcgucaucuccgggagcggcgugaccacguacuacgccgacuccgugaaggggcgcuucaccaucagccgggacaacuccaagaacacccuguaccuccagaugaacagccugcgcgccgaggacaccgccgucuacuacugcgcgaagggcuccagcugguacguggacuucgacuacugggggcagggcacgcuggugaccgucuccagc

SEQ ID NO: 8086 - RNA, 1347 nt, Artificial Sequence
  derived and/or modified sequence opt1 from Ibalizumab_HeavyChain1
caggugcagcugcagcagagcggccccgaggucgugaagccgggggccuccgugaagaugagcugcaaggccuccggcuacaccuucaccagcuacgucauccacugggugcgccagaagcccgggcagggccucgacuggaucggguacaucaaccccuacaacgacggcacggacuacgacgagaaguucaagggcaaggcgacccugaccuccgacaccagcacguccaccgccuacauggagcugagcucccuccggagcgaggacaccgccguguacuacugcgcccgcgagaaggacaacuacgccaccggggcgugguucgccuacuggggccaggggacgcuggucaccguguccagcgccuccaccaagggccccagcguguucccgcuggcccccugcucccggagcaccuccgagagcacggcggcccucgggugccuggucaaggacuacuuccccgagcccgugaccguguccuggaacagcggcgcccugaccagcggcguccacaccuucccggccgugcuccaguccagcgggcuguacucccugagcuccguggucacggugcccagcuccagccucggcaccaagaccuacacgugcaacguggaccacaagcccuccaacaccaaggucgacaagcgcguggagagcaaguacgggcccccgugccccuccugccccgcccccgaguuccugggcggcccgagcguguuccuguucccgcccaagcccaaggacacccucaugaucucccggacccccgaggugaccugcgucguggucgacgugagccaggaggaccccgagguccaguucaacugguacguggacgggguggagguccacaacgcgaagacgaagccccgcgaggagcaguucaacuccaccuaccggguggugagcguccugaccgugcugcaccaggacuggcucaacggcaaggaguacaagugcaagguguccaacaaggggcugcccagcuccaucgagaagaccaucagcaaggccaagggccagccgcgcgagccccaggucuacacgcugccgcccagccaggaggagaugaccaagaaccaggugucccugaccugccucgugaagggguucuaccccagcgacaucgccgucgagugggaguccaacggccagcccgagaacaacuacaagaccacgcccccggugcuggacagcgacggcuccuucuuccucuacagccggcugaccguggacaagucccgcuggcaggaggggaacgucuucagcugcuccgugaugcacgaggcccugcacaaccacuacacccagaagucccucagccugagccugggcaag

SEQ ID NO: 8087 - RNA, 657 nt, Artificial Sequence
  derived and/or modified sequence opt1 from Ibalizumab_LightChain1
gacaucgugaugacccagagccccgacucccuggccgucagccucggcgagcgcgugaccaugaacugcaaguccagccagucccugcuguacagcacgaaccagaagaacuaccucgccugguaccagcagaagccggggcagucccccaagcugcugaucuacugggcgagcacccgggaguccggcgugcccgaccgcuucagcggguccggcagcgggaccgacuucacccucacgaucuccagcguccaggccgaggacguggccguguacuacugccagcaguacuacuccuaccggaccuucggcggcgggaccaagcuggagaucaagcgcaccgucgccgcccccagcguguucaucuucccgcccuccgacgagcagcucaagagcggcacggcguccguggucugccugcugaacaacuucuacccccgggaggccaaggugcaguggaagguggacaacgcccugcagagcgggaacagccaggaguccgucaccgagcaggacagcaaggacuccaccuacagccucuccagcacccugacgcuguccaaggccgacuacgagaagcacaagguguacgcgugcgaggugacccaccagggccucagcucccccgucaccaagagcuucaaccgcggggagugc

SEQ ID NO: 8088 - RNA, 1329 nt, Artificial Sequence
  derived and/or modified sequence opt1 from Ibritumomab_tiuxetan_HeavyChain
caggccuaccugcagcagagcggcgccgagcucgugcgccccggggccuccgucaagaugagcugcaaggccuccggcuacaccuucaccagcuacaacaugcacugggugaagcagacgccgcggcaggggcuggaguggaucggcgccaucuaccccgggaacggcgacaccuccuacaaccagaaguucaagggcaaggccacccugaccguggacaagagcuccagcacggccuacaugcagcucuccagccugaccuccgaggacagcgcggucuacuucugcgcccgcgugguguacuacuccaacagcuacugguacuucgacgucugggggaccggcaccacggugaccguguccgcccccagcgucuacccccuggccccggugugcggggacaccaccggcuccagcgugacgcucgggugccuggucaagggcuacuuccccgagcccgugacccugaccuggaacuccggcagccucagcuccggggugcacaccuuccccgcgguccugcagagcgaccuguacacgcucuccagcuccgugaccgugaccagcuccaccuggccgagccaguccaucacgugcaacgucgcccaccccgccagcuccaccaagguggacaagaagaucgagccccggggccccaccaucaagccgugcccgcccugcaagugccccgcccccaaccugcucgggggccccagcguguucaucuucccgcccaagaucaaggacguccucaugaucucccugagccccaucgugaccugcguggucguggacgucuccgaggacgaccccgacgugcagaucagcugguucgugaacaacgucgaggugcacacggcccagacccagacccaccgcgaggacuacaacuccacccugcggguggucagcgcgcuccccauccagcaccaggacuggauguccggcaaggaguucaagugcaaggugaacaacaaggaccugcccgccccgaucgagcgcacgaucagcaagcccaaggggagcgugcgggcgccccaggucuacgugcugcccccgcccgaggaggagaugaccaagaagcaggucacccugaccugcauggugacggacuucaugcccgaggacaucuacguggaguggaccaacaacggcaagaccgagcugaacuacaagaacaccgagccggugcuggacuccgacgggagcuacuucauguacuccaagcuccgcgucgagaagaagaacuggguggagcggaacagcuacuccugcagcgugguccacgagggccugcacaaccaccacacgaccaaguccuucagccgc

SEQ ID NO: 8089 - RNA, 627 nt, Artificial Sequence
  derived and/or modified sequence opt1 from Ibritumomab_tiuxetan_LightChain
cagaucgugcugagccagucccccgccauccucagcgccuccccgggcgagaaggucacgaugaccugccgcgcgagcuccagcguguccuacaugcacugguaccagcagaagcccgggagcucccccaagcccuggaucuacgccccgagcaaccuggccuccggcgugcccgcccgguucagcggguccggcagcgggacguccuacagccugaccaucucccgcgucgaggccgaggacgcggccaccuacuacugccagcaguggagcuucaacccgcccaccuucggcgccggcacgaagcucgagcugaagcgggccgacgcggcccccaccguguucaucuucccgcccuccgacgagcagcucaagagcgggaccgccagcguggucugccugcugaacaacuucuacccccgcgaggccaaggugcaguggaagguggacaacgcccugcaguccggcaacagccaggaguccgucaccgagcaggacagcaaggacuccacguacagccucuccagcacccugacccuguccaaggcggacuacgagaagcacaagguguacgccugcgaggugacccaccaggggcucagcucccccgucaccaagagcuucaac

SEQ ID NO: 8090 - RNA, 1368 nt, Artificial Sequence
  derived and/or modified sequence opt1 from Icrucumab_HeavyChain1
caggcccagguggucgagagcggcgggggcguggugcaguccgggcgcagccugcggcucuccugcgccgcgagcggcuucgccuucuccagcuacgggaugcacuggguccgccaggcccccggcaagggccuggaguggguggccgugaucugguacgacggguccaacaaguacuacgccgacagcguccggggccgcuucaccaucucccgggacaacagcgagaacacccuguaccuccagaugaacucccugcgcgcggaggacacggccguguacuacugcgcccgggaccacuacgggagcggcgugcaccacuacuucuacuacgggcuggacgucuggggccagggcaccaccgugaccguguccagcgccuccacgaaggggccgagcgucuucccccucgcgcccuccagcaaguccaccagcggcgggaccgccgcccugggcugccuggugaaggacuacuuccccgagccggugaccgucagcuggaacuccggcgcccucacgagcggggugcacaccuuccccgccgugcugcaguccagcggccuguacucccucagcuccgucgugaccgugcccagcuccagccuggggacccagacguacaucugcaacgucaaccacaagcccuccaacaccaagguggacaagcgcguggagcccaagagcugcgacaagacccacacgugcccgcccugccccgcgccggagcugcucggcgggcccuccgucuuccuguucccgcccaagcccaaggacacccugaugaucagccggacccccgaggugaccugcgucgugguggacgucucccacgaggaccccgaggugaaguucaacugguacguggacggcgucgaggugcacaacgccaagaccaagccccgcgaggagcaguacaacagcacguaccggguggucuccgugcucaccgugcugcaccaggacuggcugaacggcaaggaguacaagugcaaggucagcaacaaggcccucccggcccccaucgagaagaccaucuccaaggccaaggggcagccccgcgagccccagguguacacccugccgcccagccgggaggagaugacgaagaaccaggugagccugaccugccucgucaagggcuucuaccccuccgacaucgcgguggagugggagagcaacgggcagcccgagaacaacuacaagaccaccccgcccgugcuggacuccgacggcagcuucuuccuguacuccaagcucacggucgacaagagccgcuggcagcaggggaacguguucuccugcagcgugaugcacgaggcccugcacaaccacuacacccagaagucccugagccucucccccggcaag

SEQ ID NO: 8091 - RNA, 645 nt, Artificial Sequence
  derived and/or modified sequence opt1 from Icrucumab_LightChain1
gagaucgugcugacccagagccccggcacccucucccugagcccgggggagcgcgccacgcuguccugccgggccagccaguccgucagcuccagcuaccucgcgugguaccagcagaagcccggccaggcgccccgccugcugaucuacggggccuccagccgggccaccggcauccccgaccgcuucuccgggagcggcuccggcaccgacuucacccucacgaucagccggcuggagccggaggacuucgccguguacuacugccagcaguacggguccagcccccugaccuucggcgggggcaccaagguggagaucaagcgcaccgucgccgcccccuccguguucaucuucccgcccagcgacgagcagcucaaguccgggacggccagcguggucugccugcugaacaacuucuacccccgggaggccaaggugcaguggaagguggacaacgcgcuccagagcggcaacucccaggagagcgucaccgagcaggacuccaaggacagcaccuacucccugagcuccacccugacgcucagcaaggccgacuacgagaagcacaagguguacgccugcgaggugacccaccagggccuguccagccccgucaccaaguccuucaaccgcggggagugc

SEQ ID NO: 8092 - RNA, 675 nt, Artificial Sequence
  derived and/or modified sequence opt1 from Idarucizumab_HeavyChain1
caggugcagcugcaggagagcggccccgggcucgucaagccguccgagacccugagccugaccugcacgguguccggcuucagccucaccuccuacaucguggacuggauccgccagccgcccgggaagggccuggaguggaucggggucaucugggccggcggcagcaccggguacaacuccgcccugcggagccgcguguccaucaccaaggacacgagcaagaaccaguucucccucaagcugagcuccgugaccgcggccgacaccgccgucuacuacugcgccagcgccgcguacuacuccuacuacaacuacgacggcuucgccuacugggggcagggcacccuggugacggugagcuccgccagcaccaaggggcccuccgucuucccccucgcccccagcagcaaguccaccagcggcggcaccgcggcccuggggugccuggugaaggacuacuuccccgagcccgugacggucuccuggaacagcggcgcccucaccuccggggugcacaccuucccggccgugcugcagagcuccggccuguacagccucuccagcgucgugaccgugcccuccagcucccugggcacgcagaccuacaucugcaacgucaaccacaagcccagcaacaccaagguggacaagaagguggagcccaaguccugc

SEQ ID NO: 8093 - RNA, 657 nt, Artificial Sequence
  derived and/or modified sequence opt1 from Idarucizumab_LightChain1
gacguggucaugacccagagcccccugucccucccggugacccugggccagcccgccagcaucuccugcaagagcucccagagccugcucuacacggacgggaagaccuaccuguacugguuccugcagcgccccggccagagcccccggcgccucaucuaccugguguccaagcuggacuccggggucccggaccgguucagcggcuccgggagcggcaccgacuucacccucaagaucucccgcguggaggccgaggacgugggcgucuacuacugccugcagagcacgcacuucccccacaccuucgggggcgggaccaagguggagaucaagcggaccguggcggcccccuccgucuucaucuucccgcccagcgacgagcagcugaaguccggcacggccagcguggugugccuccugaacaacuucuacccccgcgaggccaagguccaguggaagguggacaacgcccugcaguccgggaacagccaggagagcgugaccgagcaggacuccaaggacagcaccuacucccucagcuccacccugacgcugagcaaggcggacuacgagaagcacaaggucuacgccugcgaggugacccaccagggccucuccagccccgugaccaaguccuucaaccggggcgagugc

SEQ ID NO: 8094 - RNA, 1332 nt, Artificial Sequence
  derived and/or modified sequence opt1 from Igatuzuab_HeavyChain1
caggugcagcugguccagagcggcgccgaggugaagaagcccggguccagcgugaaggucuccugcaaggccagcggcuucaccuucaccgacuacaagauccacugggugcgccaggcgccggggcagggccucgaguggggguacuucaaccccaacuccggcuacagcacguacgcccagaaguuccagggccgggugaccaucaccgccgacaaguccaccagcacggccuacgagcuguccagccugcgcuccgaggacaccgccgucuacuacugcgcgcggcucagccccgggggcuacuacguggacgccugggggcagggcaccaccgugacggucuccagcgccuccaccaaggggcccagcguguucccgcuggcccccuccagcaaguccaccagcggcggcaccgcggcccuggggugccucgugaaggacuacuuccccgagcccgucacggugagcuggaacuccggcgcccugaccagcggggugcacaccuucccggccguccugcaguccagcggccucuacucccugagcuccguggugaccguccccagcuccagccugggcacgcagaccuacaucugcaacgugaaccacaagcccuccaacaccaagguggacaagaaggucgagcccaagagcugcgacaagacccacacgugcccgcccugccccgcccccgagcuccucgggggcccguccguguuccuguucccgcccaagcccaaggacacccugaucagccgcacccccgaggugaccugcgucguggucgacgugucccacgaggaccccgaggugaaguucaacugguacgucgacgggguggaggugcacaacgcgaagacgaagccccgggaggagcaguacaacagcaccuaccgcgucguguccgugcugaccguccugcaccaggacuggcucaacggcaaggaguacaagugcaaggugagcaacaaggcccugcccgccccgaucgagaagaccaucuccaaggccaaggggcagccccgggagccccagguguacacgcugcccccgagccgcgacgagcucaccaagaaccaggucagccugaccugccuggugaagggcuucuaccccuccgacaucgccguggagugggagagcaacggccagcccgagaacaacuacaagaccacgccgcccguccucgacuccgacgggagcuucuuccuguacuccaagcugaccguggacaagagccgguggcagcagggcaacguguucuccugcagcguccacgaggcgcuccacaaccacuacacccagaagucccugagccugucccccggg

SEQ ID NO: 8095 - RNA, 636 nt, Artificial Sequence
  derived and/or modified sequence opt1 from Igatuzuab_LightChain1
gacauccagacccagagccccuccagccuguccgccagcgugggcgaccgcgucaccaucacgugccgggccucccaggggaucaacaacuaccucaacugguaccagcagaagccgggcaaggcgcccaagcgccugaucuacaacaccaacaaccugcagaccggggugcccagccgguucuccggcagcggguccggcaccgaguucacgcucaccaucagcucccugcagcccgaggacuucgccaccuacuacugccugcagcacaacagcuucccgaccuucggccaggggacgaagcucgagaucaagcgcaccguggccgcccccuccgucuucaucuucccgcccagcgacgagcagcugaaguccggcaccgccagcguggugugccugcucaacaacuucuacccccgggaggcgaagguccaguggaagguggacaacgcccugcaguccgggaacagccaggaguccgugaccgagcaggacagcaaggacagcacguacucccugagcuccacccucacccugagcaaggccgacuacgagaagcacaaggucuacgccugcgaggugacccaccagggccuguccagccccgugacgaaguccuucaaccgcggggagugc

SEQ ID NO: 8096 - RNA, 357 nt, Artificial Sequence
  derived and/or modified sequence opt1 from IGF-IR_HUMAB-1A_HeavyChain
gaggugcagcugguccagagcggcgggggccucgugcaccccgggggcucccugcgccugagcugcgccggguccggcuucaccuuccggaacuacgccauguacugggugcgccaggcgccgggcaaggggcucgagugggucagcgccaucggcuccgggggcgggaccuacuacgccgacagcgugaagggccgguucacgaucucccgcgacaacgccaagaacagccuguaccugcagaugaacucccuccgggccgaggacauggcgguguacuacugcgcccgcgcccccaacuggggcagcgacgccuucgacaucugggggcagggcaccauggucaccguguccagc

SEQ ID NO: 8097 - RNA, 357 nt, Artificial Sequence
  derived and/or modified sequence opt1 from IGF-IR_HUMAB-23_HeavyChain
gaggugcagcugguccagagcggcgggggccucgugcaccccgggggcucccugcgccugagcugcgccggguccggcuucaccuucagcaacuacgccauguacugggugcggcaggcgccgggcaaggggcucgagugggucuccgccaucggcagcgggggcgggaccuacuacgccgacuccgugaagggccgcuucacgaucagccgggacaacgccaagaacucccuguaccugcagaugaacagccuccgcgccgaggacauggcgguguaccacugcgcccgggcccccaacuggggcuccgaggccuucgacaucugggggcagggcaccauggucaccgugagcucc

SEQ ID NO: 8098 - RNA, 321 nt, Artificial Sequence; identical to SEQ ID NO: 7994
  derived and/or modified sequence opt1 from IGF-IR_HUMAB-23_LightChain

SEQ ID NO: 8099 - RNA, 357 nt, Artificial Sequence
  derived and/or modified sequence opt1 from IGF-IR_HUMAB-8_HeavyChain
gaggugcagcugguccagagcggcgggggccucgugcaccccgggggcucccugcgccugagcugcgccggguccggcuucaccuuccggagcuacgccauguacugggugcgccaggcgccgggcaaggggcucgagugggucuccgccaucggcagcgggggcgggaccuacuacgccgacuccgugaagggccgguucacgaucagccgcgacaacgccaagaacucccuguaccugcagaugaacagccuccgggccgaggacauggcgguguacuacugcgcccgcgcccccaacuggggcuccgacgccuucgacaucugggggcagggcaccauggucaccgugagcucc

SEQ ID NO: 8100 - RNA, 321 nt, Artificial Sequence
  derived and/or modified sequence opt1 from IGF-IR_HUMAB-8_LightChain
gacauccagaugacccagagccccuccagccuguccgccagcgugggcgaccgcgucaccaucacgugccgggccucccaggggaucagcuccuggcucgcgugguaccagcagaagccggagaaggcccccaagagccugaucuacgccgccuccagccugcaguccggcgugcccagccgcuucuccgggagcggcuccgggaccgacuucacccucaccaucagcucccugcagcccgaggacuucgccacguacuacugccagcaguacaacagcuacccgcccaccuucggccccggcaccaagguggacaucaag

SEQ ID NO: 8101 - RNA, 708 nt, Artificial Sequence
  derived and/or modified sequence opt1 from ImAb1_LightChain
auggacaugcgcgcccccgcccaguucuucggcauccugcuccugugguucccggggauccggugcgacaucaagaugacccagagccccuccagcauguacgcgucccugggcgagcgcgugaccaucacgugcaaggccagccaggacaucaaguccuaccucagcugguaccagcagaagcccuggaagucccccaagauccugaucuacuacgccaccagccuggccgacggggucccgucccggaucagcggcuccgggagcggccaggacuacucccucaccaucagcucccuggagagcgacgacaccgccacguacuacugccugcagcacggcgagucccccuacaccuucgggggcgggaccaagcucgagaucaagcgcgcggacgccgcccccaccgugagcaucuucccgcccuccagcgagcagcugacgagcggcggggccuccguggucugcuuccugaacaacuucuaccccaaggacaucaacgugaaguggaagaucgacggcagcgagcggcagaacggcgugcucaacuccuggaccgaccaggacagcaaggacuccaccuacagcauguccagcacccugacgcugaccaaggacgaguacgagcgccacaacuccuacacgugcgaggcgacccacaagaccagcaccucccccaucgucaagagcuucaaccggaacgagugc

SEQ ID NO: 8102 - RNA, 681 nt, Artificial Sequence
  derived and/or modified sequence opt1 from ImAb1_gamma1-Chain
augaacuucggcuucagccugaucuuccucgugcugguccugaagggggugcagugcgaggugaagcucgucgaguccggcgggggccuggugaagcccgggggcagccugaagcucuccugcgccgccagcggcuucaccuucuccaacuacgcgaugagcugggugcgccagaccccggagaagcggcuggagugggucgccuccaucagcuccgacggggacacguacuuccccgacaacgugaagggccgcuucaccaucagccgggagaacgccgggaacauccuguuccuccagauguccagccugcgcuccgaggacaccgccauguacuacugcgcccggggcuucaugaucaccuucugggggcagggcacgcuggugaccgucagcgcggccaagaccaccccgcccuccguguacccccucgcccccggcugcggggacacgaccggcagcuccgugacccuggggugccuggucaagggcuacuuccccgagagcgugaccgugacguggaacuccggcagccucagcuccagcguccacaccuuccccgcccugcugcaguccgggcucuacaccaugagcuccagcgugaccgugccguccagcacguggcccucccagaccgugaccugcagcgucgcgcaccccgccuccagcaccacgguggac

SEQ ID NO: 8103 - RNA, 1344 nt, Artificial Sequence
  derived and/or modified sequence opt1 from Imalumab_HeavyChain1
gaggugcagcugcucgagagcggcgggggccugguccagcccgggggcucccugcgccucagcugcgccgccuccggguucaccuucagcaucuacuccaugaacugggugcggcaggcgccgggcaagggccuggagugggugagcuccaucgggagcuccggcgggaccacguacuacgccgacagcgucaagggccgcuucaccaucucccgggacaacagcaagaacacccuguaccuccagaugaacucccugcgcgccgaggacaccgccguguacuacugcgccgggagccaguggcuguacggcauggacguguggggccaggggacgaccgucaccguguccagcgcguccaccaagggccccagcguguucccccucgcccccuccagcaagagcacguccgggggcaccgccgcccugggcugccuggucaaggacuacuucccggagcccgugaccgugagcuggaacuccggggcgcucaccagcggcguccacacguuccccgccgugcugcaguccagcgggcuguacucccucagcuccguggucaccgugcccagcuccagccugggcacccagaccuacaucugcaacgugaaccacaagccguccaacacgaaggucgacaagcggguggagcccaagagcugcgacaagacccacacgugcccgcccugccccgcccccgagcugcucgggggccccuccguguuccuguucccgcccaagcccaaggacacccugaugaucagccgcacccccgaggugaccugcgucguggucgacgugucccacgaggaccccgaggucaaguucaacugguacguggacggcguggagguccacaacgccaagaccaagccgcgggaggagcaguacaacagcaccuaccgcgugguguccguccucacggugcugcaccaggacuggcugaacgggaaggaguacaagugcaaggugagcaacaaggcccuccccgcgcccaucgagaagaccaucagcaaggccaagggccagccccgggagccgcaggucuacacccugccgcccucccgcgaggagaugaccaagaaccaggugagccugacgugccucgugaagggguucuaccccuccgacaucgccgucgagugggagagcaacggccagcccgagaacaacuacaagaccaccccgcccgugcuggacuccgacgggagcuucuuccuguacuccaagcucaccguggacaagagccgguggcagcagggcaacgucuucuccugcagcgugaugcacgaggcccugcacaaccacuacacgcagaagucccugagccucucccccggcaag

SEQ ID NO: 8104 - RNA, 642 nt, Artificial Sequence
  derived and/or modified sequence opt1 from Imalumab_LightChain1
gacauccagaugacgcagagccccuccagccuguccgccagcgugggcgaccgggucaccaucacgugccgguccagccagcgcaucaugaccuaccucaacugguaccagcagaagccggggaaggcccccaagcugcugaucuucguggcgucccacagccaguccggcgugcccagccgguuccgcggguccggcagcgagaccgacuucacccucacgaucuccgggcugcagcccgaggacagcgccaccuacuacugccagcaguccuucuggaccccgcugaccuucggcggcgggacgaaggucgagaucaagcggaccguggccgcccccagcguguucaucuucccgcccuccgacgagcagcucaagagcggcaccgccuccgucgugugccugcugaacaacuucuacccccgcgaggcgaaggugcaguggaaggucgacaacgcccuccagagcgggaacagccaggaguccgugaccgagcaggacagcaaggacuccacguacagccuguccagcacccugacccucuccaaggccgacuacgagaagcacaagguguacgccugcgaggucacccaccagggccugagcucccccgugaccaagagcuucaaccgcggggagugc

SEQ ID NO: 8105 - RNA, 1347 nt, Artificial Sequence
  derived and/or modified sequence opt1 from Imgatuzumab_HeavyChain1
caggugcagcugguccagagcggcgccgaggugaagaagcccggguccagcgugaaggucuccugcaaggccagcggcuucaccuucaccgacuacaagauccacugggugcgccaggcgccggggcagggccucgaguggaugggguacuucaaccccaacuccggcuacagcacguacgcccagaaguuccagggccgggugaccaucaccgccgacaaguccaccagcacggccuacauggagcuguccagccugcgcuccgaggacaccgccgucuacuacugcgcgcggcucagccccgggggcuacuacgugauggacgccugggggcagggcaccaccgugacggucuccagcgccuccaccaaggggcccagcguguucccgcuggcccccuccagcaaguccaccagcggcggcaccgcggcccuggggugccucgugaaggacuacuuccccgagcccgucacggugagcuggaacuccggcgcccugaccagcggggugcacaccuucccggccguccugcaguccagcggccucuacucccugagcuccguggugaccguccccagcuccagccugggcacgcagaccuacaucugcaacgugaaccacaagcccuccaacaccaagguggacaagaaggucgagcccaagagcugcgacaagacccacacgugcccgcccugccccgcccccgagcuccucgggggcccguccguguuccuguucccgcccaagcccaaggacacccugaugaucagccgcacccccgaggugaccugcgucguggucgacgugucccacgaggaccccgaggugaaguucaacugguacgucgacgggguggaggugcacaacgcgaagacgaagccccgggaggagcaguacaacagcaccuaccgcgucguguccgugcugaccguccugcaccaggacuggcucaacggcaaggaguacaagugcaaggugagcaacaaggcccugcccgccccgaucgagaagaccaucuccaaggccaaggggcagccccgggagccccagguguacacgcugcccccgagccgcgacgagcucaccaagaaccaggucagccugaccugccuggugaagggcuucuaccccuccgacaucgccguggagugggagagcaacggccagcccgagaacaacuacaagaccacgccgcccguccucgacuccgacgggagcuucuuccuguacuccaagcugaccguggacaagagccgguggcagcagggcaacguguucuccugcagcgucaugcacgaggcgcuccacaaccacuacacccagaagucccugagccugucccccggg

SEQ ID NO: 8106 - RNA, 639 nt, Artificial Sequence
  derived and/or modified sequence opt1 from Imgatuzumab_LightChain1
gacauccagaugacccagagccccuccagccuguccgccagcgugggcgaccgcgucaccaucacgugccgggccucccaggggaucaacaacuaccucaacugguaccagcagaagccgggcaaggcgcccaagcgccugaucuacaacaccaacaaccugcagaccggggugcccagccgguucuccggcagcggguccggcaccgaguucacgcucaccaucagcucccugcagcccgaggacuucgccaccuacuacugccugcagcacaacagcuucccgaccuucggccaggggacgaagcucgagaucaagcgcaccguggccgcccccuccgucuucaucuucccgcccagcgacgagcagcugaaguccggcaccgccagcguggugugccugcucaacaacuucuacccccgggaggcgaagguccaguggaagguggacaacgcccugcaguccgggaacagccaggaguccgugaccgagcaggacagcaaggacagcacguacucccugagcuccacccucacccugagcaaggccgacuacgagaagcacaaggucuacgccugcgaggugacccaccagggccuguccagccccgugacgaaguccuucaaccgcggggagugc

SEQ ID NO: 8107 - RNA, 1353 nt, Artificial Sequence
  derived and/or modified sequence opt1 from Inclacumab_HeavyChain1
gaggugcagcuggucgagagcggcgggggccucgugcgccccgggggcucccugcggcugagcugcgccgccuccggguucaccuucagcaacuacgacaugcacugggugcgccaggcgaccggcaagggccucgagugggucuccgccaucacggccgccggggacaucuacuaccccggcagcgugaaggggcgguucaccaucucccgcgagaacgccaagaacagccuguaccugcagaugaacucccuccgggcgggcgacaccgccguguacuacugcgcccgcgggcgguacagcggcuccggcagcuacuacaacgacugguucgaccccugggggcagggcacccuggucacgguguccagcgccuccaccaaggggcccagcguguucccccuggcgccgugcucccgcagcaccuccgagagcaccgccgcccucggcugccuggucaaggacuacuuccccgagcccgugacggugagcuggaacuccggcgcccugaccagcgggguccacaccuuccccgccgugcuccaguccagcggccuguacucccugagcuccguggucaccgugccgagcuccagccucgggacgaagaccuacacgugcaacguggaccacaagcccuccaacaccaaggucgacaagcggguggagagcaaguacggcccgcccugcccgcccugccccgcgcccgaguucgagggcgggccguccguguuccuguucccgcccaagcccaaggacacccugaugaucagccgcacccccgaggugaccugcgucguggucgacgugucccaggaggaccccgagguccaguucaacugguacguggacggcguggagguccacaacgccaagaccaagccccgggaggagcaguucaacagcacguaccgcgugguguccguccucaccgugcugcaccaggacuggcugaacgggaaggaguacaagugcaaggugagcaacaagggccuccccuccagcaucgagaagaccaucagcaaggccaaggggcagccgcgggagccccaggucuacacccugccgcccucccaggaggagaugacgaagaaccaggugagccugaccugccucgugaagggcuucuaccccuccgacaucgccgucgagugggagagcaacgggcagcccgagaacaacuacaagaccaccccgcccgugcuggacuccgacggcagcuucuuccuguacucccgccucacgguggacaagagccgguggcaggagggcaacgucuucuccugcagcgugaugcacgaggcccugcacaaccacuacacccagaagucccugagccucucccuggggaag

SEQ ID NO: 8108 - RNA, 642 nt, Artificial Sequence
  derived and/or modified sequence opt1 from Inclacumab_LightChain1
gagaucgugcugacccagagccccgccacccucucccugagcccgggcgagcgcgccacgcuguccugccgggcgagccaguccgucagcuccuaccucgccugguaccagcagaagcccgggcaggcgccccgccugcugaucuacgacgccagcaaccgggccaccggcauccccgcccgcuucuccgggagcggcuccgggaccgacuucacccucacgaucagcucccuggagccggaggacuucgccguguacuacugccagcagcggagcaacuggccccugaccuucggcggcgggaccaagguggagaucaagcgcaccgucgccgcccccuccguguucaucuucccgcccagcgacgagcagcucaaguccggcacggcgagcguggucugccugcugaacaacuucuacccccgggaggccaaggugcaguggaagguggacaacgcccuccaguccgggaacagccaggagagcgucaccgagcaggacuccaaggacagcaccuacucccugagcuccacccugacgcucagcaaggccgacuacgagaagcacaagguguacgccugcgaggugacccaccagggccuguccagccccgucaccaaguccuucaaccgcggggagugc

SEQ ID NO: 8109 - RNA, 1347 nt, Artificial Sequence
  derived and/or modified sequence opt1 from Indatuximab_ravtansine_HeavyChain1
caggugcagcugcagcagagcggcuccgagcucaugaugcccggggccagcgucaagaucuccugcaaggccaccggcuacaccuucagcaacuacuggaucgagugggugaagcagcgccccgggcacggccuggaguggaucggggagauccugcccggcacgggccggaccaucuacaacgagaaguucaaggggaaggcgaccuucaccgccgacaucuccagcaacacggugcagaugcagcucuccagccugaccuccgaggacagcgccgucuacuacugcgcccgccgggacuacuacggcaacuucuacuacgccauggacuacugggggcagggcaccuccgugaccgugagcuccgcgagcacgaaggggcccuccgucuucccccuggccccgugcagccgcuccaccagcgaguccaccgccgcccucggcugccuggugaaggacuacuuccccgagcccgugaccgucagcuggaacagcggcgcgcugacguccggggugcacaccuuccccgccgugcuccagagcuccggccuguacagccuguccagcgucgugaccgugccguccagcucccucgggaccaagacguacacgugcaacgucgaccacaagcccagcaacaccaagguggacaagcggguggaguccaaguacggcccgcccugcccgagcugccccgcccccgaguuccugggcgggcccuccgucuuccuguucccgcccaagcccaaggacacccucaugaucagccgcacccccgaggugaccugcguggucguggacgugucccaggaggacccggagguccaguucaacugguacguggacggcgucgaggugcacaacgccaagaccaagccccgggaggagcaguucaacagcaccuaccgcguggucuccgugcugacggugcugcaccaggacuggcucaacgggaaggaguacaagugcaaggucagcaacaagggccugcccuccagcaucgagaagaccaucagcaaggccaaggggcagccccgggagccccagguguacacccugccgcccucccaggaggagaugaccaagaaccaggugagccucacgugccuggucaagggcuucuaccccuccgacaucgcgguggagugggagagcaacggccagcccgagaacaacuacaagaccaccccgcccgugcuggacuccgacgggagcuucuuccucuacucccgccugaccgucgacaagagccgguggcaggagggcaacguguucuccugcagcgugaugcacgaggcccugcacaaccacuacacgcagaagucccucagccugucccuggggaag

SEQ ID NO: 8110 - RNA, 642 nt, Artificial Sequence
  derived and/or modified sequence opt1 from Indatuximab_ravtansine_LightChain1
gacauccagaugacccagagcaccuccagccuguccgccagccucggcgaccgcgugacgaucuccugcagcgccucccaggggaucaacaacuaccugaacugguaccagcagaagcccgacggcaccgucgagcugcucaucuacuacaccagcacccugcaguccggggugccgagccgguucuccggcagcggguccggcacggacuacagccugaccaucuccaaccucgagcccgaggacaucggcaccuacuacugccagcaguacagcaagcugccccgcaccuucgggggcgggacgaagcuggagaucaagcggaccguggcggcccccuccgucuucaucuucccgcccagcgacgagcagcucaaguccggcaccgccagcguggugugccugcugaacaacuucuacccccgcgaggccaagguccaguggaagguggacaacgcccuccagagcgggaacucccaggagagcgugaccgagcaggacuccaaggacagcacguacucccugagcuccacccugacccucagcaaggcggacuacgagaagcacaaggucuacgccugcgaggugacccaccagggccuguccagccccgugacgaaguccuucaaccggggcgagugc

SEQ ID NO: 8111 - RNA, 1347 nt, Artificial Sequence
  derived and/or modified sequence opt1 from Indusatumab_vedotin_HeavyChain1
caggugcagcugcagcaguggggcgccgggcuccugaagcccagcgagacccugucccugaccugcgccgucuucggcgggagcuucuccggcuacuacuggagcuggauccgccagccgcccgggaagggccuggaguggaucggcgagaucaaccaccgggggaacacgaacgacaaccccucccucaagagccgcgugaccaucuccguggacaccagcaagaaccaguucgcgcucaagcuguccagcgucaccgccgccgacacggccguguacuacugcgcccgggagcgcggcuacaccuacgggaacuucgaccacuggggccaggggacccuggugaccgucuccagcgcguccacgaagggccccagcguguucccgcucgcccccuccagcaaguccaccagcggcgggaccgccgcccugggcugccuggugaaggacuacuuccccgagcccgucaccguguccuggaacagcggggcgcucacgagcggcgugcacaccuucccggccguccugcaguccagcggccuguacucccucagcuccguggugaccguccccagcuccagccuggggacccagacguacaucugcaacgugaaccacaagcccuccaacaccaagguggacaagaaggucgagcccaagagcugcgacaagacccacacgugcccgcccugccccgcccccgagcugcucggcgggccguccguguuccuguucccgcccaagcccaaggacacccugaugaucagccggacccccgaggugaccugcgucgugguggacgucucccacgaggaccccgaggugaaguucaacugguacgucgacggcguggaggugcacaacgccaagaccaagccccgcgaggagcaguacaacagcacguaccgggucguguccgugcucaccguccugcaccaggacuggcugaacgggaaggaguacaagugcaaggugagcaacaaggcccuccccgcgccgaucgagaagaccaucuccaaggccaagggccagccccgcgagccccagguguacacccugcccccgagccgggacgagcugacgaagaaccaggucucccugaccugccucgugaagggcuucuaccccagcgacaucgccguggagugggagagcaacgggcagcccgagaacaacuacaagaccaccccgcccguccuggacuccgacggcagcuucuuccucuacuccaagcugacgguggacaagagccgcuggcagcaggggaacguguucuccugcagcgucaugcacgaggcccugcacaaccacuacacccagaagucccucagccugucccccggcaag

SEQ ID NO: 8112 - RNA, 642 nt, Artificial Sequence
  derived and/or modified sequence opt1 from Indusatumab_vedotin_LightChain1
gagaucgugaugacccagagccccgccacccuguccgucagcccgggcgagcgcgccacgcucuccugccgggcgagccaguccgugagccgcaaccuggccugguaccagcagaagcccgggcaggcgccccggcugcucaucuacggcgccuccacccgcgccaccgggauccccgcccgguucagcggcuccgggagcggcaccgaguucacgcugaccaucggcucccugcagagcgaggacuucgccguguacuacugccagcaguacaagaccuggccgcgcaccuucgggcagggcacgaacgucgagaucaagcggaccguggccgcccccuccguguucaucuucccgcccagcgacgagcagcucaaguccgggaccgcgagcgucgugugccugcugaacaacuucuacccccgcgaggccaaggugcaguggaaggucgacaacgcccuccaguccggcaacagccaggaguccgugaccgagcaggacagcaaggacagcacguacucccugagcuccacccugacccucagcaaggccgacuacgagaagcacaagguguacgccugcgaggucacccaccaggggcuguccagccccgugacgaaguccuucaaccggggcgagugc

SEQ ID NO: 8113 - RNA, 1353 nt, Artificial Sequence
  derived and/or modified sequence opt1 from Inebilizumab_HeavyChain1
gaggugcagcuggucgagagcggcgggggccucgugcagcccgggggcucccugcgccugagcugcgccgccuccggguucaccuucagcuccagcuggaugaacugggugcggcaggcgccgggcaagggccucgagugggucgggcgcaucuaccccggcgacggggacaccaacuacaacgugaaguucaagggccgguucacgaucucccgcgacgacagcaagaacucccuguaccugcagaugaacagccucaagaccgaggacaccgccguguacuacugcgcccgguccggguucaucaccacgguccgcgacuucgacuacuggggccagggcacccuggugaccgugagcuccgccagcaccaaggggcccuccgucuucccccuggccccgagcuccaagagcacguccggcgggaccgcggcccucggcugccuggugaaggacuacuuccccgagcccgugaccgucagcuggaacagcggcgcccugaccuccggggugcacacguuccccgccgugcuccagagcuccggccuguacagccuguccagcgucgugaccgugccguccagcucccucgggacccagaccuacaucugcaacgucaaccacaagcccagcaacacgaagguggacaagcggguggagcccaaguccugcgacaagacccacacgugcccgcccugccccgcgcccgagcugcugggcgggcccagcgucuuccucuucccgcccaagcccaaggacacccugaugaucucccgcacccccgaggugaccugcguggucguggacgucagccacgaggacccggaggugaaguucaacugguacguggacggcgucgaggugcacaacgccaagaccaagccccgggaggagcaguacaacuccaccuaccgcguggucagcgugcugacggugcuccaccaggacuggcugaacggcaaggaguacaagugcaaggucuccaacaaggcccugcccgcccccaucgagaagaccaucagcaaggccaaggggcagccgcgggagccccagguguacacccucccgcccucccgcgaggagaugaccaagaaccaggugagccugacgugccuggucaagggcuucuaccccagcgacaucgcgguggagugggaguccaacgggcagcccgagaacaacuacaagaccacgcccccggugcucgacagcgacggcuccuucuuccuguacagcaagcugaccgucgacaagucccgguggcagcaggggaacguguucagcugcuccgugaugcacgaggcccuccacaaccacuacacccagaagucccugagccugagccccggcaag

SEQ ID NO: 8114 - RNA, 654 nt, Artificial Sequence
  derived and/or modified sequence opt1 from Inebilizumab_LightChain1
gagaucgugcugacccagagccccgacuuccaguccgucaccccgaaggagaaggugacgaucacgugccgcgccagcgaguccguggacaccuucggcaucagcuucaugaacugguuccagcagaagcccgaccagucccccaagcuccugauccacgaggccagcaaccagggguccggcguccccagccgguucuccgggagcggcuccgggaccgacuucacgcugaccaucaacagccucgaggcggaggacgccgccaccuacuacugccagcaguccaaggaggugccguucaccuucggcggcgggacgaagguggagaucaagcgcaccgucgccgcccccagcguguucaucuucccgcccuccgacgagcagcucaagagcggcaccgcguccguggucugccugcugaacaacuucuacccccgggaggccaaggugcaguggaagguggacaacgcccugcagagcgggaacucccaggagagcgucaccgagcaggacagcaaggacuccacguacagccuguccagcacccucacccuguccaaggccgacuacgagaagcacaagguguacgcgugcgaggugacccaccagggccugagcucccccgucaccaagagcuucaaccgcggggagugc

SEQ ID NO: 8115 - RNA, 90 nt, Artificial Sequence
  derived and/or modified sequence opt1 from Insulin_peglispro_Fragment1
uucgugaaccagcaccugugcggcagccaccucgucgaggcccuguaccuggugugcggggagcgcggcuucuucuacaccaagcccacc

SEQ ID NO: 8116 - RNA, 63 nt, Artificial Sequence
  derived and/or modified sequence opt1 from Insulin_peglispro_Fragment2
ggcaucguggagcagugcugcaccagcaucugcucccuguaccagcucgagaacuacugcaac

SEQ ID NO: 8117 - RNA, 495 nt, Artificial Sequence
  derived and/or modified sequence opt1 from Interferon_beta-1b_chain1
agcuacaaccugcucggcuuccugcagcgcuccagcaacuuccagucccagaagcugcucuggcagcugaacgggcggcuggaguacugccucaaggaccgcaugaacuucgacauccccgaggagaucaagcagcugcagcaguuccagaaggaggacgccgcccugaccaucuacgagaugcuccagaacaucuucgcgaucuuccggcaggacagcuccagcaccggcuggaacgagacgaucguggagaaccugcuggccaacgucuaccaccagaucaaccaccucaagaccgugcuggaggagaagcuggagaaggaggacuucacccgcgggaagcucauguccagccugcaccugaagcgguacuacggccgcauccuccacuaccugaaggccaaggaguacucccacugcgccuggaccaucgugcgggucgagauccugcgcaacuucuacuucaucaaccggcucacgggguaccugcgcaac

SEQ ID NO: 8118 - RNA, 1347 nt, Artificial Sequence
  derived and/or modified sequence opt1 from Intetumumab_HeavyChain1
caggugcagcuggucgagagcggcgggggcguggugcagcccgggcgcucccggcgccucagcugcgccgccuccggcuucaccuucagccgguacaccaugcacuggguccgccaggcgccggggaagggccuggaguggguggccgugaucuccuucgacggcagcaacaaguacuacgucgacuccgugaaggggcgguucacgaucagccgcgacaacuccgagaacacccuguaccuccaggugaacauccugcgggccgaggacaccgccgucuacuacugcgcccgcgaggcgcggggcagcuacgccuucgacaucugggggcagggcaccauggugacgguguccagcgccuccaccaaggggcccagcgucuucccccuggcccccuccagcaaguccaccagcggcggcaccgcggcccucgggugccuggugaaggacuacuucccggagcccgugacggucuccuggaacagcggcgcccugaccagcggggugcacaccuuccccgccgugcuccaguccagcggccuguacucccugagcuccgucgugaccgugcccagcuccagccucggcacgcagaccuacaucugcaacgucaaccacaagccguccaacaccaagguggacaagaagguggagcccaagagcugcgacaagacccacacgugcccgcccugcccggcccccgagcugcucgggggccccuccgucuuccuguucccgcccaagcccaaggacacccugaugaucagccgcacccccgaggugaccugcgucgugguggacgucucccacgaggaccccgaggugaaguucaacugguacguggacggggucgaggugcacaacgcgaagacgaagccgcgggaggagcaguacaacagcaccuaccgcguggucuccgugcugaccgugcuccaccaggacuggcugaacggcaaggaguacaagugcaaggucagcaacaaggcccugcccgcccccaucgagaagaccaucuccaaggccaaggggcagccccgggagccccagguguacacgcucccgcccagccgcgacgagcugaccaagaaccaggugucccugaccugccucgucaagggcuucuaccccagcgacaucgccguggagugggagagcaacggccagcccgagaacaacuacaagaccacgccgcccgugcuggacuccgacgggagcuucuuccuguacuccaagcucaccgucgacaagagccgguggcagcagggcaacguguucuccugcagcgugaugcacgaggcgcugcacaaccacuacacccagaagucccugagccucucccccgggaag

SEQ ID NO: 8119 - RNA, 645 nt, Artificial Sequence
  derived and/or modified sequence opt1 from Intetumumab_LightChain1
gagaucgugcugacccagagccccgccacccucucccugagcccgggcgagcgcgccacgcuguccugccgggcgagccaguccgucagcuccuaccucgccugguaccagcagaagcccgggcaggcgccccgccugcugaucuacgacgccagcaaccgggccaccggcauccccgcccgcuucuccgggagcggcuccgggaccgacuucacccucacgaucagcucccuggagccggaggacuucgccguguacuacugccagcagcggagcaacuggccgcccuucaccuucggccccggcaccaagguggacaucaagcgcaccgucgccgcccccuccguguucaucuucccgcccagcgacgagcagcugaaguccgggacggcgagcguggucugccuccugaacaacuucuacccccgggaggccaaggugcaguggaagguggacaacgcccugcaguccggcaacagccaggagagcgucaccgagcaggacuccaaggacagcaccuacucccucagcuccacccugacgcugagcaaggccgacuacgagaagcacaagguguacgccugcgaggugacccaccaggggcucuccagccccgucaccaaguccuucaaccgcggcgagugc

SEQ ID NO: 8120 - RNA, 1347 nt, Artificial Sequence; identical to SEQ ID NO: 7978
  derived and/or modified sequence opt1 from Iodine_(124I)_Girentuximab_HeavyChain1

SEQ ID NO: 8121 - RNA, 642 nt, Artificial Sequence; identical to SEQ ID NO: 7979
  derived and/or modified sequence opt1 from Iodine_(124I)_Girentuximab_LightChain1

SEQ ID NO: 8122 - RNA, 1335 nt, Artificial Sequence
  derived and/or modified sequence opt1 from Iodine_(131I)_derlotuxiab_biotin_HeavyChain1
caggugcagcugaaggagagcggccccgggcucgucgccccgucccagagccuguccaucacgugcaccgugagcggcuucucccugaccgacuacggggugcgcuggauccggcagccgcccggcaaggggcucgaguggcugggcgucaucuggggcgggggcagcaccuacuacaacuccgcccucaagagccgccucuccaucagcaaggacaacuccaagagccagguguuccugaagaacucccugcagaccgacgacaccgcguacuacugcgccaaggagaagcggcgcggguacuacuacgccgacuacuggggccaggggacgagcgugaccgucuccagcgccuccaccaagggccccagcguguucccccucgcccccuccagcaagagcaccuccggcgggacggcggcccugggcugccuggugaaggacuacuuccccgagcccgucaccgugagcuggaacuccggggcccucaccagcggcgugcacaccuucccggccguccugcaguccagcggccuguacucccucagcuccguggugacgguccccagcuccagccuggggacccagaccuacaucugcaacgugaaccacaagcccuccaacaccaagguggacaagaaggcggagcccaagagcugcgacaagacgcacacgugcccgcccugccccgcccccgagcugcucggcgggccguccgucuuccuguucccgcccaagcccaaggacacccugaucagccggacccccgaggugaccugcguggucguggacgugucccacgaggaccccgaggucaaguucaacugguacguggacggcgucgaggugcacaacgccaagaccaagccccgcgaggagcaguacaacagcaccuaccggguggucuccgugcucaccgugcugcaccaggacuggcugaacgggaaggaguacaagugcaaggucagcaacaaggcccuccccgccccgaucgagaagacgaucagcaaggcgaagggccagccccgcgagccccagguguacacccugcccccgucccgggacgagcugaccaagaaccaggugagccugaccugccuggucaagggcuucuaccccuccgacaucgccguggagugggagagcaacgggcagcccgagaacaacuacaagacgaccccgcccgugcuggacuccgacggcagcuucuuccucuacuccaagcugaccgucgacaagagccgcuggcagcaggggaacguguucuccugcagcgugcacgaggcccugcacaaccacuacacccagaagucccucagccugucccccggcaag

SEQ ID NO: 8123 - RNA, 639 nt, Artificial Sequence
  derived and/or modified sequence opt1 from Iodine_(131I)_derlotuxiab_biotin_LightChain1
gagaacgugcugacccagagccccgccaucuccgccagcccgggcgagaaggucaccacgugccgcgcguccagcuccgugagcuccagcuaccuccacugguaccagcagaaguccggggccagccccaagcuguggaucuacuccaccagcaaccuggccuccggcgugcccgcccgguucagcggguccggcagcgggaccuccuacagccucaccaucuccagcgucgaggccgaggacgcggccacguacuacugccagcaguacagcggcuacccccugaccuucggcgggggcaccaagcuggagaucaagcgcaccguggccgccccguccguguucaucuucccgcccagcgacgagcagcucaaguccgggacggcgagcgucgugugccugcugaacaacuucuacccccgggaggccaaggugcaguggaaggucgacaacgcccuccaguccggcaacagccaggaguccgugaccgagcaggacagcaaggacuccaccuacagccuguccagcacccugacgcucuccaaggccgacuacgagaagcacaagguguacgccugcgaggucacccaccaggggcugagcucccccgugaccaagagcuucaaccgcggcgagugc

SEQ ID NO: 8124 - RNA, 1350 nt, Artificial Sequence
  derived and/or modified sequence opt1 from Iodine_(131I)_Derlotuximab_biotin_HeavyChain1
caggugcagcugaaggagagcggccccgggcucgucgccccgucccagagccuguccaucacgugcaccgugagcggcuucucccugaccgacuacggggugcgcuggauccggcagccgcccggcaaggggcucgaguggcugggcgucaucuggggcgggggcagcaccuacuacaacuccgcccucaagagccgccucuccaucagcaaggacaacuccaagagccagguguuccugaagaugaacucccugcagaccgacgacaccgcgauguacuacugcgccaaggagaagcggcgcggguacuacuacgccauggacuacuggggccaggggacgagcgugaccgucuccagcgccuccaccaagggccccagcguguucccccucgcccccuccagcaagagcaccuccggcgggacggcggcccugggcugccuggugaaggacuacuuccccgagcccgucaccgugagcuggaacuccggggcccucaccagcggcgugcacaccuucccggccguccugcaguccagcggccuguacucccucagcuccguggugacgguccccagcuccagccuggggacccagaccuacaucugcaacgugaaccacaagcccuccaacaccaagguggacaagaaggcggagcccaagagcugcgacaagacgcacacgugcccgcccugccccgcccccgagcugcucggcgggccguccgucuuccuguucccgcccaagcccaaggacacccugaugaucagccggacccccgaggugaccugcguggucguggacgugucccacgaggaccccgaggucaaguucaacugguacguggacggcgucgaggugcacaacgccaagaccaagccccgcgaggagcaguacaacagcaccuaccggguggucuccgugcucaccgugcugcaccaggacuggcugaacgggaaggaguacaagugcaaggucagcaacaaggcccuccccgccccgaucgagaagacgaucagcaaggcgaagggccagccccgcgagccccagguguacacccugcccccgucccgggacgagcugaccaagaaccaggugagccugaccugccuggucaagggcuucuaccccuccgacaucgccguggagugggagagcaacgggcagcccgagaacaacuacaagacgaccccgcccgugcuggacuccgacggcagcuucuuccucuacuccaagcugaccgucgacaagagccgcuggcagcaggggaacguguucuccugcagcgugaugcacgaggcccugcacaaccacuacacccagaagucccucagccugucccccggcaag

SEQ ID NO: 8125 - RNA, 645 nt, Artificial Sequence
  derived and/or modified sequence opt1 from Iodine_(131I)_Derlotuximab_biotin_LightChain1
gagaacgugcugacccagagccccgccaucauguccgccagcccgggcgagaaggucaccaugacgugccgcgcguccagcuccgugagcuccagcuaccuccacugguaccagcagaaguccggggccagccccaagcuguggaucuacuccaccagcaaccuggccuccggcgugcccgcccgguucagcggguccggcagcgggaccuccuacagccucaccaucuccagcgucgaggccgaggacgcggccacguacuacugccagcaguacagcggcuacccccugaccuucggcgggggcaccaagcuggagaucaagcgcaccguggccgccccguccguguucaucuucccgcccagcgacgagcagcucaaguccgggacggcgagcgucgugugccugcugaacaacuucuacccccgggaggccaaggugcaguggaaggucgacaacgcccuccaguccggcaacagccaggaguccgugaccgagcaggacagcaaggacuccaccuacagccuguccagcacccugacgcucuccaaggccgacuacgagaagcacaagguguacgccugcgaggucacccaccaggggcugagcucccccgugaccaagagcuucaaccgcggcgagugc

SEQ ID NO: 8126 - RNA, 1344 nt, Artificial Sequence
  derived and/or modified sequence opt1 from Ipilimumab_HeavyChain
caggugcagcuggucgagagcggcgggggcguggugcagcccgggcgcucccuccggcugagcugcgccgccuccggcuucaccuucagcuccuacaccaugcacuggguccgccaggcgccggggaagggccuggagugggugacguucaucagcuacgacggcaacaacaaguacuacgccgacuccgugaaggggcgguucaccaucagccgcgacaacuccaagaacacccucuaccugcagaugaacagccugcgggccgaggacaccgccaucuacuacugcgcccgcacgggcuggcucgggcccuucgacuacuggggccaggggacccuggucaccguguccagcgcguccaccaagggccccagcguguucccccuggccccguccagcaaguccacgagcggcgggaccgccgcccucggcugccuggucaaggacuacuuccccgagcccgugaccguguccuggaacagcggggcgcugaccagcggcguccacacguuccccgccgugcuccaguccagcggccuguacucccugagcuccguggucaccgugccgagcuccagccucgggacccagaccuacaucugcaacgugaaccacaagcccuccaacacgaaggucgacaagcggguggagcccaagagcugcgacaagacccacacgugcccgcccugccccgcccccgagcugcugggcgggcccuccguguuccucuucccgcccaagcccaaggacacccugaugaucagccgcacccccgaggugaccugcgucguggucgacgugucccacgaggacccggaggucaaguucaacugguacguggacggcguggagguccacaacgccaagaccaagccccgggaggagcaguacaacagcaccuaccgcgugguguccguccugacggugcuccaccaggacuggcugaacgggaaggaguacaagugcaaggugagcaacaaggcccugcccgcgcccaucgagaagaccaucuccaaggccaagggccagccgcgggagccccaggucuacacccucccgcccagccgcgacgagcugaccaagaaccaggugucccugacgugccucgugaagggcuucuaccccagcgacaucgccgucgagugggagagcaacgggcagcccgagaacaacuacaagaccacgcccccggugcuggacuccgacggcagcuucuuccuguacuccaagcucaccguggacaagagccgguggcagcaggggaacgucuucuccugcagcgugaugcacgaggcccugcacaaccacuacacccagaagucccugagccucucccccggcaag

SEQ ID NO: 8127 - RNA, 645 nt, Artificial Sequence
  derived and/or modified sequence opt1 from Ipilimumab_LightChain
gagaucgugcugacccagagccccggcacccucucccugagcccgggggagcgcgccacgcuguccugccgggccagccaguccgucggcagcuccuaccucgcgugguaccagcagaagcccgggcaggcgccccgccugcugaucuacggcgccuucagccgggccaccgggauccccgaccgcuucuccggcagcggcuccgggaccgacuucacccucacgaucagccggcuggagccggaggacuucgccguguacuacugccagcaguacggcuccagccccuggaccuucgggcagggcaccaagguggagaucaagcgcaccgucgccgcccccuccguguucaucuucccgcccagcgacgagcagcugaaguccgggacggccagcguggucugccuccugaacaacuucuacccccgggaggccaaggugcaguggaagguggacaacgcgcugcaguccggcaacagccaggagagcgucaccgagcaggacuccaaggacagcaccuacucccucagcuccacccugacgcugagcaaggccgacuacgagaagcacaagguguacgccugcgaggugacccaccagggccucuccagccccgucaccaaguccuucaaccgcggggagugc

SEQ ID NO: 8128 - RNA, 186 nt, Artificial Sequence
  derived and/or modified sequence opt1 from Iratumumab_HeavyChain1
caggugcagcugcagcaguggggcgccgggcuccugaagcccagcgagacccugucccugaccugcgccgucuacggcgggagcuucuccgcguacuacuggagcuggauccgccagccgcccggcaaggggcucgaguggaucggcgacuacuggggccaggggucccuggugacggugagcucc

SEQ ID NO: 8129 - RNA, 321 nt, Artificial Sequence
  derived and/or modified sequence opt1 from Iratumumab_LightChain1
gacauccagaugacccagagccccaccucccugagcgccuccgugggcgaccgcgucacgaucacgugccgggccagccaggggaucuccagcuggcucaccugguaccagcagaagccggagaaggcgcccaagucccugaucuacgccgccagcucccugcagagcggcgugcccucccgcuucagcggguccggcagcgggaccgacuucacccucaccaucuccagccugcagcccgaggacuucgccaccuacuacugccagcaguacgacuccuacccgaucaccuucggccagggcacgcggcuggagaucaag

SEQ ID NO: 8130 - RNA, 1350 nt, Artificial Sequence
  derived and/or modified sequence opt1 from Isatuximab_HeavyChain1
caggugcagcugguccagagcggcgccgagguggccaagcccgggaccuccgugaagcucagcugcaaggcguccggcuacaccuucacggacuacuggaugcagugggucaagcagcgcccggggcagggccuggaguggaucgggaccaucuaccccggcgacggcgacaccggguacgcccagaaguuccagggcaaggccacccugacggccgacaagagcuccaagaccguguacaugcaccucagcucccuggccagcgaggacuccgcgguguacuacugcgcccgcggggacuacuacggcagcaacucccuggacuacugggggcagggcaccagcgucaccguguccagcgccuccacgaagggccccagcguguucccccucgccccguccagcaaguccaccagcgggggcaccgcggcccuggggugccuggucaaggacuacuuccccgagcccgugaccgugagcuggaacuccggcgcccucacgagcggcguccacaccuuccccgccgugcugcaguccagcgggcuguacucccucagcuccguggucaccgugccgagcuccagccugggcacccagacguacaucugcaacgugaaccacaagcccuccaacaccaaggucgacaagaagguggagcccaagagcugcgacaagacccacacgugcccgcccugccccgcccccgagcugcucgggggccccuccguguuccuguucccgcccaagcccaaggacacccugaugaucagccggacccccgaggugaccugcgucguggucgacgugucccacgaggacccggaggucaaguucaacugguacguggacgggguggagguccacaacgcgaagaccaagccccgggaggagcaguacaacagcacguaccgcgugguguccguccucaccgugcugcaccaggacuggcugaacggcaaggaguacaagugcaaggugagcaacaaggcccuccccgcccccaucgagaagaccaucuccaaggccaagggccagccgcgggagccccaggucuacacccugccgcccagccgcgacgagcugacgaagaaccaggugagccugaccugccucgugaagggguucuaccccuccgacaucgccgucgagugggagagcaacggccagcccgagaacaacuacaagaccacgcccccggugcuggacuccgacgggagcuucuuccucuacuccaagcugaccguggacaagagccgguggcagcagggcaacgucuucuccugcagcgugaugcacgaggcgcugcacaaccacuacacccagaagucccucagccugucccccgggaag

SEQ ID NO: 8131 - RNA, 642 nt, Artificial Sequence
  derived and/or modified sequence opt1 from Isatuximab_LightChain1
gacaucgugaugacccagagccaccuguccaugagcaccucccucggcgaccccgucagcaucacgugcaaggccucccaggacgugagcaccguggucgccugguaccagcagaagccggggcagagcccccgccggcugaucuacagcgcguccuaccgcuacaucggcgugcccgaccgguucaccgggagcggcgccgggaccgacuucacguucaccaucuccagcgugcaggccgaggaccuggccgucuacuacugccagcagcacuacuccccgcccuacaccuucggcggcgggaccaagcucgagaucaagcgcacgguggccgcgcccagcguguucaucuucccgcccuccgacgagcagcugaaguccggcaccgccuccgucgugugccugcucaacaacuucuacccccgggaggccaaggugcaguggaaggucgacaacgcccugcagagcgggaacucccaggagagcgugaccgagcaggacagcaaggacuccaccuacagccuguccagcacgcucacccuguccaaggcggacuacgagaagcacaagguguacgccugcgaggucacccaccagggccugagcucccccgugaccaagagcuucaaccgcggggagugc

SEQ ID NO: 8132 - RNA, 1347 nt, Artificial Sequence
  derived and/or modified sequence opt1 from Itolizumab_HeavyChain1
gaggugcagcuggucgagagcggcgggggccucgugaagcccgggggcucccugaagcugagcugcgccgccuccggguucaaguucagccgcuacgcgauguccugggugcggcaggccccgggcaagcgccucgagugggucgccaccaucagcuccggcgggagcuacaucuacuaccccgacuccgugaagggccgguucaccaucagccgcgacaacgugaagaacacgcuguaccugcagauguccagccuccgguccgaggacaccgccauguacuacugcgcccgccgggacuacgaccuggacuacuucgacagcugggggcagggcacccuggucaccguguccagcgcguccacgaaggggcccagcguguucccccucgccccguccagcaagagcaccuccggcggcaccgccgcccuggggugccuggucaaggacuacuuccccgagcccgugaccgugagcuggaacuccggcgcgcucacgagcgggguccacaccuuccccgccgugcugcaguccagcggccuguacucccucagcuccguggucaccgugccgagcuccagccugggcacccagacguacaucugcaacgugaaccacaagcccuccaacaccaaggucgacaagaagguggagcccaagagcugcgacaagacccacacgugcccgcccugccccgcccccgagcugcucgggggccccuccguguuccuguucccgcccaagcccaaggacacccugaugaucagccgcacccccgaggugaccugcgucguggucgacgugucccacgaggacccggaggucaaguucaacugguacguggacgggguggagguccacaacgccaagaccaagccccgggaggagcaguacaacagcacguaccgcgugguguccguccucaccgugcugcaccaggacuggcugaacggcaaggaguacaagugcaaggugagcaacaaggcccuccccgcgcccaucgagaagaccaucagcaaggccaaggggcagccgcgggagccccaggucuacacccugccgcccucccgcgacgagcugacgaagaaccaggugagccugaccugccucgugaagggcuucuaccccuccgacaucgccgucgagugggagagcaacggccagcccgagaacaacuacaagaccacgcccccggugcuggacuccgacgggagcuucuuccucuacuccaagcugaccguggacaagagccgguggcagcagggcaacgucuucuccugcagcgugaugcacgaggcccugcacaaccacuacacccagaagucccucagccugucccccgggaag

SEQ ID NO: 8133 - RNA, 642 nt, Artificial Sequence
  derived and/or modified sequence opt1 from Itolizumab_LightChain1
gacauccagaugacgcagagccccuccagccuguccgccagcgugggcgaccgcgucaccaucacgugcaaggccucccgggacauccgcagcuaccucaccugguaccagcagaagccggggaaggcgcccaagacccugaucuacuacgccaccucccuggccgacggcgugcccagccgguucuccgggagcggcuccgggcaggacuacagccucacgaucuccagccuggaguccgacgacaccgccaccuacuacugccugcagcacggcgagagccccuucacccucggcuccgggacgaagcuggagaucaagcgcaccguggccgcgccgagcgucuucaucuucccgcccuccgacgagcagcucaagagcggcaccgccagcguggugugccugcugaacaacuucuacccccgggaggccaagguccaguggaagguggacaacgcccugcaguccgggaacagccaggaguccgugaccgagcaggacagcaaggacuccacguacagccucuccagcacccugacccuguccaaggcggacuacgagaagcacaaggucuacgccugcgaggugacccaccagggccucagcucccccgugaccaagagcuucaaccgcggggagugc

SEQ ID NO: 8134 - RNA, 1335 nt, Artificial Sequence
  derived and/or modified sequence opt1 from Ixekizumab_HeavyChain1
caggugcagcugguccagagcggcgccgaggugaagaagcccggguccagcgugaaggucuccugcaaggccagcggcuacuccuucaccgacuaccacauccacugggugcgccaggcgccggggcagggccucgaguggaugggggugaucaaccccauguacggcaccacggacuacaaccagcgguucaagggccgcgucaccaucaccgccgacgagagcaccuccacggccuacauggagcugagcucccugcggagcgaggacaccgccguguacuacugcgcccgcuacgacuacuucaccgggaccggcguguacugggggcagggcacgcucgucaccguguccagcgcguccaccaaggggcccagcguguucccccuggccccgugcucccggagcaccuccgagagcacggccgcccugggcugccucgucaaggacuacuuccccgagcccgugaccguguccuggaacagcggcgcgcugaccagcgggguccacaccuuccccgccgugcugcaguccagcggccucuacucccugagcuccguggucacggugccgagcuccagccuggggaccaagaccuacacgugcaacguggaccacaagcccuccaacaccaaggucgacaagcgcguggagagcaaguacggcccgcccugcccgcccugccccgcccccgaguuccucggcgggcccuccguguuccuguucccgcccaagcccaaggacacccugaugaucagccggacccccgaggugaccugcgucgucguggacgugucccaggaggaccccgagguccaguucaacugguacguggacggcguggagguccacaacgccaagacgaagccccgcgaggagcaguucaacagcaccuaccgggugguguccguccucaccgugcugcaccaggacuggcugaacgggaaggaguacaagugcaaggugagcaacaagggccuccccuccagcaucgagaagaccaucuccaaggccaaggggcagccgcgcgagccccaggucuacacgcugccgcccagccaggaggagaugaccaagaaccaggugagccugaccugccucgugaagggcuucuaccccuccgacaucgcggucgagugggagagcaacggccagcccgagaacaacuacaagaccacgcccccggugcuggacuccgacgggagcuucuuccuguacucccggcucaccguggacaagagccgcuggcaggagggcaacgucuucuccugcagcgugaugcacgaggcccugcacaaccacuacacccagaagucccugagccucucccugggg

SEQ ID NO: 8135 - RNA, 657 nt, Artificial Sequence
  derived and/or modified sequence opt1 from Ixekizumab_LightChain1
gacaucgugaugacccagacgccccugagccucuccgucaccccgggccagcccgccagcaucuccugccgcagcucccggagccuggugcacucccgcgggaacaccuaccugcacugguaccuccagaagcccggccagagcccccagcugcugaucuacaagguguccaaccgguucaucggggucccggaccgcuucagcggcuccgggagcggcaccgacuucacccucaagaucucccggguggaggccgaggacgugggcgucuacuacugcagccaguccacgcaccuccccuucaccuucgggcagggcaccaagcuggagaucaagcgcaccguggcggcccccagcguguucaucuucccgcccuccgacgagcagcucaagagcgggacggccuccgucgugugccugcugaacaacuucuacccccgggaggccaaggugcaguggaaggucgacaacgcccugcagagcggcaacagccaggaguccgugaccgagcaggacagcaaggacuccaccuacagccuguccagcacccugacgcucuccaaggcggacuacgagaagcacaagguguacgccugcgaggucacccaccaggggcugagcucccccgugaccaagagcuucaaccgcggcgagugc

SEQ ID NO: 8136 - RNA, 1347 nt, Artificial Sequence
  derived and/or modified sequence opt1 from Labetuzumab_govitecan_HeavyChain1
gaggugcagcuggucgagagcggcgggggcguggugcagcccgggcgcucccuccggcugagcugcuccgccagcggcuucgacuucaccaccuacuggauguccuggguccgccaggccccggggaagggccuggaguggaucggcgagauccaccccgacagcuccaccaucaacuacgcgcccagccucaaggaccgguucaccaucucccgcgacaacgccaagaacacccuguuccugcagauggacagccuccggcccgaggacaccgggguguacuucugcgccucccuguacuucggcuucccgugguucgccuacugggggcagggcacgcccgugaccgucagcuccgccagcaccaaggggcccuccguguucccccuggcgccgagcuccaagagcaccuccggcggcacggccgcccucgggugccuggugaaggacuacuuccccgagcccgucaccgugagcuggaacagcggcgcccugaccuccggggugcacaccuuccccgcgguccuccagagcuccggccuguacagccuguccagcguggugacggucccguccagcucccucggcacccagaccuacaucugcaacgugaaccacaagcccagcaacaccaagguggacaagcgcgucgagcccaaguccugcgacaagacgcacacgugcccgcccugccccgcccccgagcugcucgggggccccagcguguuccucuucccgcccaagcccaaggacacccugaugaucucccggacccccgaggugaccugcgucgugguggacgucagccacgaggacccggaggugaaguucaacugguacgucgacgggguggaggugcacaacgccaagaccaagccccgcgaggagcaguacaacuccaccuaccgggucgugagcgugcugaccguccuccaccaggacuggcugaacggcaaggaguacaagugcaagguguccaacaaggcccugcccgcccccaucgagaagacgaucagcaaggcgaaggggcagccgcgcgagccccagguguacacccugcccccgucccgggaggagaugaccaagaaccaggucagccugaccugccuggugaagggcuucuaccccagcgacaucgccguggagugggaguccaacggccagcccgagaacaacuacaagacgacgcccccgguccucgacagcgacggguccuucuuccuguacagcaagcugaccguggacaagucccgcuggcagcagggcaacguguucagcugcuccgucaugcacgaggcccuccacaaccacuacacccagaagucccugagccugagccccgggaag

SEQ ID NO: 8137 - RNA, 639 nt, Artificial Sequence
  derived and/or modified sequence opt1 from Labetuzumab_govitecan_LightChain1
gacauccagcugacccagagccccuccagccucuccgccagcgugggcgaccgcgucaccaucacgugcaaggccucccaggacguggggaccagcguggcgugguaccagcagaagccgggcaaggcccccaagcugcugaucuacuggaccuccacccggcacacggggguccccagccgcuucuccggcagcggguccggcaccgacuucaccuucaccaucagcucccuccagcccgaggacaucgccacguacuacugccagcaguacagccuguaccgguccuucggccaggggaccaagguggagaucaagcgcaccguggccgccccgagcgucuucaucuucccgcccuccgacgagcagcucaagagcggcaccgcguccguggugugccugcugaacaacuucuacccccgggaggccaagguccaguggaagguggacaacgcccugcagagcgggaacagccaggaguccgugacggagcaggacagcaaggacuccaccuacagccucuccagcacccugacccuguccaaggccgacuacgagaagcacaaggucuacgcgugcgaggugacgcaccagggccucagcucccccgugaccaagagcuucaaccgcggggagugc

SEQ ID NO: 8138 - RNA, 1341 nt, Artificial Sequence
  derived and/or modified sequence opt1 from Lambrolizumab_HeavyChain1
caggugcagcugguccagagcggcguggaggugaagaagcccggggccuccgucaaggugagcugcaaggccuccggcuacaccuucaccaacuacuacauguacugggugcgccaggcgcccgggcagggccucgaguggaugggcgggaucaaccccagcaacggcgggacgaacuucaacgagaaguucaagaaccgggucacccugaccaccgacuccagcacgaccaccgccuacauggagcugaagucccuccaguucgacgacaccgccguguacuacugcgcccgccgggacuaccgcuucgacaugggcuucgacuacugggggcagggcacgaccgugaccgucagcuccgccagcaccaaggggcccuccguguucccccuggcgccgugcagccgguccacgagcgaguccaccgccgcccugggcugccucgugaaggacuacuuccccgagcccgucaccgugagcuggaacuccggcgcccugaccagcggggugcacacguuccccgcgguccugcaguccagcggccucuacagccuguccagcguggugaccgucccguccagcucccuggggaccaagaccuacacgugcaacguggaccacaagcccagcaacaccaagguggacaagcgcgucgaguccaaguacggcccgcccugcccgcccugccccgcccccgaguuccucggcgggccgagcguguuccuguucccgcccaagcccaaggacacccugaugaucucccggacccccgaggugacgugcgucguggucgacgugagccaggaggaccccgaggugcaguucaacugguacgucgacggcguggaggugcacaacgccaagaccaagccccgcgaggagcaguucaacuccaccuaccgggucgugagcgugcucaccguccugcaccaggacuggcugaacgggaaggaguacaagugcaagguguccaacaagggccuccccagcuccaucgagaagacgaucagcaaggccaaggggcagccgcgcgagccccagguguacacccugccgcccucccaggaggagaugaccaagaaccaggucagccugaccugccucgugaagggcuucuaccccuccgacaucgccguggagugggagagcaacggccagcccgagaacaacuacaagacgaccccgcccguccuggacagcgacggguccuucuuccuguacagccggcucaccguggacaagucccgcuggcaggagggcaacguguucagcugcuccgucaugcacgaggcgcugcacaaccacuacacccagaagucccugagccucagccuggggaag

SEQ ID NO: 8139 - RNA, 654 nt, Artificial Sequence
  derived and/or modified sequence opt1 from Lambrolizumab_LightChain1
gagaucgugcugacccagagccccgccacccucucccugagcccgggcgagcgcgccacgcuguccugccgggcgagcaagggggucuccaccagcggcuacuccuaccuccacugguaccagcagaagcccgggcaggcgccccgccugcugaucuaccucgccagcuaccuggaguccggcgugcccgcccgguucagcggguccggcagcggcaccgacuucacccugacgaucuccagccucgagccggaggacuucgccguguacuacugccagcacucccgcgaccugccccugaccuucgggggcgggaccaaggucgagaucaagcggaccguggccgcccccagcguguucaucuucccgcccuccgacgagcagcucaagagcggcacggccuccgucgugugccugcugaacaacuucuacccccgcgaggccaaggugcaguggaaggucgacaacgcgcuccagagcgggaacagccaggaguccgugaccgagcaggacagcaaggacuccaccuacagccuguccagcacccugacgcucuccaaggccgacuacgagaagcacaagguguacgccugcgaggucacccaccagggccugagcucccccgugaccaagagcuucaaccggggcgagugc

SEQ ID NO: 8140 - RNA, 669 nt, Artificial Sequence
  derived and/or modified sequence opt1 from Lampalizumab_HeavyChain1
gaggugcagcugguccagagcggccccgagcucaagaagccgggggccuccgugaaggugagcugcaaggccuccggcuacaccuucaccaacuacgggaugaacuggguccgccaggcgcccggccaggggcuggaguggaugggcuggaucaacacguacaccggcgagaccaccuacgccgacgacuucaaggggcgguucguguucagccuggacacguccgugagcaccgccuaccuccagaucuccagccugaaggccgaggacaccgccgucuacuacugcgagcgcgagggcggggugaacaacuggggccaggggacccuggugacggucuccagcgcguccaccaagggccccagcguguucccccucgccccguccagcaaguccaccagcggcgggaccgccgcccugggcugccuggugaaggacuacuuccccgagcccgucacgguguccuggaacagcggggcgcucaccuccggcgugcacaccuuccccgccguccugcagagcagcggccuguacucccucagcuccguggugaccgucccgagcuccagccuggggacgcagaccuacaucugcaacgugaaccacaagcccuccaacaccaagguggacaagaaggucgagcccaagagcugcgacaagacccacacg

SEQ ID NO: 8141 - RNA, 642 nt, Artificial Sequence
  derived and/or modified sequence opt1 from Lampalizumab_LightChain1
gacauccaggugacccagagccccuccagccuguccgccagcgucggcgaccgcgugaccaucacgugcaucaccuccaccgacaucgacgacgacaugaacugguaccagcagaagccggggaaggugcccaagcuccugaucagcggcgggaacacccugcggcccggcguccccucccgcuucagcggguccggcagcggcacggacuucacccucaccaucuccagccugcagccggaggacguggccaccuacuacugccugcaguccgacagccuccccuacacguucgggcagggcaccaagguggagaucaagcggaccgucgcggcccccuccguguucaucuucccgcccagcgacgagcagcugaaguccgggaccgccagcguggucugccugcucaacaacuucuacccccgcgaggccaaggugcaguggaagguggacaacgcccugcaguccggcaacagccaggagagcgucacggagcaggacuccaaggacagcaccuacucccugagcuccacccucacccugagcaaggcggacuacgagaagcacaagguguacgccugcgaggugacgcaccaggggcuguccagccccgucaccaaguccuucaaccggggcgagugc

SEQ ID NO: 8142 - RNA, 1353 nt, Artificial Sequence
  derived and/or modified sequence opt1 from Lanadelumab_HeavyChain1
gaggugcagcugcucgagagcggcgggggccugguccagcccgggggcucccugcgccucagcugcgccgccuccggguucaccuucagccacuacaucaugaugugggugcggcaggcgccgggcaagggccuggaguggguguccgggaucuacagcuccggcgggaucaccgucuacgccgacagcgugaagggccgcuucacgaucucccgggacaacagcaagaacacccuguaccuccagaugaacucccugcgcgccgaggacaccgccguguacuacugcgccuaccggcgcaucggggucccccggcgcgacgaguucgacaucuggggccagggcaccauggugacggugagcuccgcgagcaccaaggggcccuccgucuucccccuggccccgagcuccaagagcaccuccggcgggaccgccgcccucggcugccuggugaaggacuacuuccccgagcccgugacggucagcuggaacagcggcgcgcugaccuccggggugcacaccuuccccgccgugcuccagagcuccggccuguacagccuguccagcgucgugaccgugccguccagcucccucgggacgcagaccuacaucugcaacgucaaccacaagcccagcaacaccaagguggacaagcggguggagcccaaguccugcgacaagacccacacgugcccgcccugccccgcccccgagcugcugggcgggcccagcgucuuccucuucccgcccaagcccaaggacacccugaugaucucccgcacccccgaggugaccugcguggucguggacgucagccacgaggacccggaggugaaguucaacugguacguggacggcgucgaggugcacaacgccaagacgaagccccgggaggagcaguacaacuccaccuaccgcguggucagcgugcugaccgugcuccaccaggacuggcugaacggcaaggaguacaagugcaaggucuccaacaaggcccugcccgcgcccaucgagaagaccaucagcaaggccaaggggcagccgcgggagccccagguguacacgcucccgcccucccgcgaggagaugaccaagaaccaggugagccugaccugccuggucaagggcuucuaccccagcgacaucgccguggagugggaguccaacgggcagcccgagaacaacuacaagaccacgcccccggugcucgacagcgacggcuccuucuuccuguacagcaagcugaccgucgacaagucccgguggcagcaggggaacguguucagcugcuccgugaugcacgaggcccuccacaaccacuacacccagaagucccugagccugagccccggc

SEQ ID NO: 8143 - RNA, 639 nt, Artificial Sequence
  derived and/or modified sequence opt1 from Lanadelumab_LightChain1
gacauccagaugacccagagccccuccacccugagcgccuccgugggcgaccgcgucacgaucacgugccgggccagccaguccaucagcuccuggcucgcgugguaccagcagaagccggggaaggcccccaagcugcugaucuacaaggccagcacccucgaguccggcgugcccagccgcuucuccgggagcggcuccgggaccgaguucacccugaccaucagcucccugcagcccgacgacuucgccaccuacuacugccagcaguacaacaccuacuggacguucggccagggcaccaagguggagaucaagcggaccgucgccgcgccgagcguguucaucuucccgcccuccgacgagcagcucaagagcgggaccgccuccguggucugccugcugaacaacuucuacccccgcgaggccaaggugcaguggaagguggacaacgcccuccagagcggcaacagccaggaguccgucacggagcaggacagcaaggacuccaccuacagccuguccagcacccugacccucuccaaggcggacuacgagaagcacaagguguacgccugcgaggugacgcaccaggggcugagcucccccgucaccaagagcuucaaccggggcgagugc

SEQ ID NO: 8144 - RNA, 1317 nt, Artificial Sequence
  derived and/or modified sequence opt1 from Landogrozumab_HeavyChain1
gaggugcagcuggucgagagcggcgggggccucgugcagcccgggggcucccugcgccugagcugcgccgccuccgggcucaccuucagccgguacccgauguccugggugcgccaggcgcccggcaagggccuggucugggugagcgccaucaccuccagcgggggcuccacguacuacagcgacaccgugaaggggcgguucaccaucucccgcgacaacgccaagaacacccuguaccuccagaugaacagccugcgggccgaggacacggccgucuacuacugcgcgcgccugcccgacuacuggggccaggggacccucgugaccguguccagcgccuccaccaagggccccagcgucuucccgcuggcccccugcucccggagcacguccgagagcaccgccgcgcugggcugccucgugaaggacuacuuccccgagcccgugaccgucagcuggaacuccggggcccugaccagcggcgugcacacguucccggccgugcugcaguccagcgggcucuacucccugagcuccgucgugaccgugcccagcuccagccugggcaccaagaccuacacgugcaacgucgaccacaagcccuccaacaccaagguggacaagcgcguggagagcaaguacgggcccccgugcccgcccugccccgcccccgaguuccucggcggccccuccgucuuccuguucccgcccaagcccaaggacacccugaugaucagccggacccccgaggugacgugcguggucguggacgucucccaggaggaccccgaggugcaguucaacugguacguggacggggucgaggugcacaacgccaagaccaagccccgcgaggagcaguucaacagcaccuaccggguggucuccgugcucaccgugcugcaccaggacuggcugaacggcaaggaguacaagugcaaggucagcaacaaggggcucccguccagcaucgagaagacgaucagcaaggcgaagggccagccccgcgagccccagguguacacccugcccccgucccaggaggagaugaccaagaaccaggugagccugaccugccucgucaagggcuucuaccccuccgacaucgccguggagugggagagcaacgggcagcccgagaacaacuacaagacgaccccgcccgugcuggacuccgacggcagcuucuuccuguacucccggcucaccgucgacaagagccgcuggcaggaggggaacguguucuccugcagcgugaugcacgaggcccugcacaaccacuacacccagaagucccugagccucucccugggc

SEQ ID NO: 8145 - RNA, 645 nt, Artificial Sequence
  derived and/or modified sequence opt1 from Landogrozumab_LightChain1
gagaucgugcugacccagagccccggcacccucucccugagcccgggggagcgcgccacgcuguccugccgggccagcuccagcgucuccagcuccuaccuccacugguaccagcagaagcccggccaggcgccccgccugcugaucuacagcaccuccaaccucguggccgggauccccgaccgguucagcggcuccgggagcggcaccgacuucacccugacgaucucccgccuggagccggaggacuucgccguguacuacugccagcaccacagcggcuaccacuucaccuucgggggcgggaccaaggucgagaucaagcggaccguggccgcccccuccguguucaucuucccgcccagcgacgagcagcucaaguccggcacggcgagcgucgugugccugcugaacaacuucuacccccgcgaggccaaggugcaguggaaggucgacaacgcccuccagagcgggaacucccaggagagcgugaccgagcaggacuccaaggacagcaccuacucccugagcuccacccugacgcucagcaaggccgacuacgagaagcacaagguguacgcgugcgaggucacccaccagggccuguccagccccgugaccaaguccuucaaccggggcgagugc

SEQ ID NO: 8146 - RNA, 1344 nt, Artificial Sequence
  derived and/or modified sequence opt1 from Laprituximab_emtansine_HeavyChain1
caggugcagcugguccagagcggcgccgagguggccaagcccggggcguccgugaagcucagcugcaaggccuccggcuacaccuucaccagcuacuggaugcagugggucaagcagcgcccggggcagggccuggagugcaucgggacgaucuaccccggcgacggcgacaccaccuacacccagaaguuccaggggaaggccacgcugaccgccgacaaguccagcuccaccgccuacaugcagcucagcucccugcggagcgaggacuccgcgguguacuacugcgcccgcuacgacgcccccggcuacgccauggacuacugggggcagggcacccuggugacggucagcuccgcgagcaccaaggggcccuccguguucccgcucgcccccagcuccaagagcaccuccggcggcaccgccgcccuggggugccuggugaaggacuacuuccccgagcccgucacggugagcuggaacagcggcgcccucaccuccggggugcacaccuucccggcgguccugcagagcuccggccuguacagccucuccagcguggugaccguccccuccagcucccugggcacgcagaccuacaucugcaacgugaaccacaagcccagcaacaccaagguggacaagaaggucgagcccaaguccugcgacaagacccacacgugcccgcccugccccgcccccgagcugcucgggggcccgagcguguuccuguucccgcccaagcccaaggacacccugaugaucucccggacccccgaggugaccugcgucgugguggacgucagccacgaggaccccgaggugaaguucaacugguacgucgacgggguggaggugcacaacgccaagacgaagccccgcgaggagcaguacaacuccaccuaccgggucgugagcgugcucaccguccugcaccaggacuggcugaacggcaaggaguacaagugcaagguguccaacaaggcccuccccgccccgaucgagaagaccaucagcaaggcgaaggggcagccccgcgagccccagguguacacgcugcccccgucccgggacgagcugaccaagaaccaggucagccugaccugccucgugaagggcuucuaccccagcgacaucgccguggagugggaguccaacggccagcccgagaacaacuacaagaccacgccgcccguccuggacagcgacggguccuucuuccucuacagcaagcugaccguggacaagucccgcuggcagcagggcaacguguucagcugcuccgucaugcacgaggcccugcacaaccacuacacccagaagucccucagccugagccccggg

SEQ ID NO: 8147 - RNA, 642 nt, Artificial Sequence
  derived and/or modified sequence opt1 from Laprituximab_emtansine_LightChain1
gacauccagaugacccagagccccuccagccuguccgccagcgugggcgaccgcgucaccaucacgugccgggccucccaggacaucaacaacuaccucgcgugguaccagcacaagccggggaagggccccaagcugcugauccacuacaccagcacccuccaccccgggauccccucccgcuucagcggcuccgggagcggccgggacuacuccuucagcaucuccagccuggagccggaggacaucgccaccuacuacugccugcaguacgacaaccuccuguacacguucggccaggggaccaagcuggagaucaagcgcaccguggccgcccccuccguguucaucuucccgcccagcgacgagcagcucaaguccggcaccgccagcgucgugugccugcugaacaacuucuacccccgggaggcgaaggugcaguggaaggucgacaacgcccuccaguccgggaacagccaggagagcgugacggagcaggacuccaaggacagcaccuacucccugagcuccacccugacccucagcaaggccgacuacgagaagcacaagguguacgccugcgaggucacgcaccagggccuguccagccccgugaccaaguccuucaaccgcggggagugc

SEQ ID NO: 8148 - RNA, 1314 nt, Artificial Sequence
  derived and/or modified sequence opt1 from Lealesoab_HeavyChain1
caggugcagcugcaggagagcggccccgagcucaagaagccgggggagaccgucaagaucuccugcaaggccagcggcuacaccuuccgcaacuacgggaacugggugaagcaggcccccggcaaggggcugaaguggggcuggaucaacaccuacaccggcgagcccaccuacgcggacgacuucaaggggcgguucgccuucucccuggagaccagcgccuccacggccuaccuccagaucaacaacgugaagaacgaggacaccgccaccuacuucugcgcgcgcaagggcugggacuucaacgggagcucccuggacuacuggggccaggggaccacggucaccgugagcuccgccaagaccacgcccccgagcguguacccccuggcccccggcuccgccgcgcagaccaacagcgucacccucggcugccuggugaagggguacuuccccgagccggugaccgucaccuggaacuccggcagccuguccagcggggugcacacguuccccgccgugcuccaguccgaccuguacacccugagcuccagcgucaccgugcccagcagcccccggccguccgagaccgugacgugcaacgucgcccaccccgccuccagcaccaagguggacaagaagaucgugccccgcgacugcggcugcaagcccugcaucugcaccgucccggagguguccagcguguucaucuucccgcccaagcccaaggacguccucaccaucacgcugacccccaaggugaccugcguggucguggacaucuccaaggacgaccccgagguccaguucagcugguucguggacgacguggagguccacaccgcccagacgcagccccgggaggagcaguucaacuccaccuuccgcagcguguccgagcugcccauccaccaggacuggcucaacggcaaggaguucaagugccgggugaacagcgcggccuucccggcccccaucgagaagaccaucuccaagaccaaggggcgccccaaggcgccccaggucuacacgaucccgccgcccaaggagcaggccaaggacaaggugagccugaccugcaucaccgacuucuuccccgaggacaucaccguggaguggcaguggaacggccagcccgccgagaacuacaagaacacgcagcccaucaacaccaacggguccuacuucgucuacagcaagcugaacgugcagaaguccaacugggaggccggcaacaccuucacgugcagcgugcuccacgaggggcugcacaaccaccacaccgagaagucccugagccacagccccggcaag

SEQ ID NO: 8149 - RNA, 654 nt, Artificial Sequence
  derived and/or modified sequence opt1 from Lealesoab_LightChain1
gacauccagcugacccagacgccccucagccugccggugucccugggcgaccaggccagcaucuccugccgcagcucccagagcaucgugcacuccaacgggaacaccuaccucgagugguaccugcagaagcccggccagagccccaaccugcucaucuacaagguguccaaccgguucagcggggugcccgaccgcuucuccggcagcggguccggcaccgacuucacccugaagaucagccgggucgaggccgaggaccugggcguguacuacugcuuccaggggucccacgugccgcccaccuucggcgggggcacgaagcucgagaucaagcgcgcggacgccgcccccaccgucagcaucuucccgcccuccagcgagcagcugaccuccgggggcgccagcguggugugcuuccugaacaacuucuaccccaaggacaucaacgucaaguggaagaucgacggcagcgagcggcagaacggggugcucaacuccuggaccgaccaggacagcaaggacuccacguacagcuccagcacccugacccugaccaaggacgaguacgagcgccacaacuccuacacgugcgaggccacccacaagaccagcaccucccccaucgucaagagcuucaaccggaacgagugc

SEQ ID NO: 8150 - RNA, 1335 nt, Artificial Sequence
  derived and/or modified sequence opt1 from Lebrikizumab_HeavyChain1
caggugacccugcgcgagagcggccccgcccucgucaagcccacccagacgcugacccugaccugcaccguguccggguucagccucuccgccuacagcgugaacuggauccggcagccgcccggcaaggcgcuggaguggcuggccaugaucuggggcgacgggaagaucgucuacaacuccgcccucaagagccgccugacgaucuccaaggacaccagcaagaaccagguggugcugaccaugaccaacauggaccccgucgacacggccaccuacuacugcgccggggacggcuacuacccguacgcgauggacaacuggggccaggggucccucgugaccgugagcuccgccagcaccaagggccccuccgucuucccccuggcccccugcagccgguccacgagcgaguccaccgccgcgcuggggugccucgugaaggacuacuucccggagcccgugaccgucagcuggaacuccggcgcccugaccagcggggugcacacguuccccgccgugcugcagagcuccggccucuacagccuguccagcgucgugaccgugcccuccagcucccugggcaccaagaccuacacgugcaacgucgaccacaagccgagcaacaccaagguggacaagcgcguggaguccaaguacgggccgcccugcccgcccugccccgcccccgaguuccucggcgggcccagcgucuuccuguucccgcccaagcccaaggacacccugaugaucucccggacccccgaggugacgugcguggucguggacgucagccaggaggaccccgaggugcaguucaacugguacguggacggcgucgaggugcacaacgccaagaccaagccccgcgaggagcaguucaacuccaccuaccggguggucagcgugcucaccgugcugcaccaggacuggcugaacggcaaggaguacaagugcaaggucuccaacaaggggcuccccagcuccaucgagaagacgaucagcaaggcgaagggccagccccgcgagccccagguguacacccugccgcccucccaggaggagaugaccaagaaccaggugagccugaccugccucgucaagggguucuaccccagcgacaucgccguggagugggaguccaacggccagcccgagaacaacuacaagacgaccccgcccgugcuggacagcgacggguccuucuuccuguacagccggcucaccgucgacaagucccgcuggcaggagggcaacguguucagcugcuccgugaugcacgaggcccugcacaaccacuacacccagaagucccugagccucagccugggcaag

SEQ ID NO: 8151 - RNA, 654 nt, Artificial Sequence
  derived and/or modified sequence opt1 from Lebrikizumab_LightChain1
gacaucgugaugacccagagccccgacucccugagcgucucccucggcgagcgcgccaccaucaacugccgggccagcaaguccguggacagcuacgggaacuccuucaugcacugguaccagcagaagccgggccagccgcccaagcugcugaucuaccucgcgagcaaccuggaguccggggugcccgaccgcuucagcggcuccgggagcggcacggacuucacccugaccaucuccagccuccaggccgaggacgucgccguguacuacugccagcagaacaacgaggacccccggaccuucggcgggggcacgaagguggagaucaagcgcaccgucgccgcccccuccguguucaucuucccgcccagcgacgagcagcugaaguccgggaccgcgagcguggucugccugcucaacaacuucuacccccgggaggccaaggugcaguggaagguggacaacgcccugcaguccggcaacagccaggagagcgucaccgagcaggacuccaaggacagcacguacucccugagcuccacccucacccugagcaaggccgacuacgagaagcacaagguguacgcgugcgaggugacccaccaggggcuguccagccccgucacgaaguccuucaaccgcggcgagugc

SEQ ID NO: 8152 - RNA, 1227 nt, Artificial Sequence
  derived and/or modified sequence opt1 from Lenercept_chain1
cuggugccccaccucggcgaccgcgagaagcgggacagcgucugcccgcaggggaaguacauccacccccagaacaacuccaucugcugcaccaagugccacaagggcaccuaccuguacaacgacugccccgggcccggccaggacacggacugccgcgagugcgagagcggguccuucaccgccagcgagaaccaccuccggcacugccucuccugcagcaagugccgcaaggagaugggccagguggagaucuccagcugcaccguggaccgggacaccgucugcggcugccgcaagaaccaguaccggcacuacugguccgagaaccuguuccagugcuucaacugcagccugugccucaacgggacggugcaccuguccugccaggagaagcagaacaccgugugcacgugccacgccggcuucuuccugcgcgagaacgagugcgucagcugcuccaacugcaagaagucccucgagugcaccaagcugugccugccgcagaucgagaacgugaaggggaccgaggacagcggcaccaccgacaagacccacacgugcccgcccugccccgcgcccgagcuccucgggggccccagcguguuccuguucccgcccaagcccaaggacacccugaugaucucccggacccccgaggugaccugcgucguggucgacgugagccacgaggaccccgaggugaaguucaacugguacgucgacggcguggaggugcacaacgccaagacgaagccccgcgaggagcaguacaacuccaccuaccgggucgugagcgugcugaccguccugcaccaggacuggcucaacgggaaggaguacaagugcaaggugagcaacaaggcccugccggcccccaucgagaagaccaucuccaaggccaagggccagccccgcgagccccagguguacacgcugccgcccagccgggaggagaugaccaagaaccaggucucccugaccugccuggugaagggguucuaccccagcgacaucgcggucgagugggaguccaacggccagcccgagaacaacuacaagaccacgccgcccgugcuggacagcgacggcuccuucuuccucuacagcaagcugaccguggacaagucccgcuggcagcaggggaacgucuucagcugcuccgugaugcacgaggcccugcacaaccacuacacccagaagucccucagccugagccccggcaag

SEQ ID NO: 8153 - RNA, 1347 nt, Artificial Sequence
  derived and/or modified sequence opt1 from Lenzilumab_HeavyChain1
caggugcagcugguccagagcggcgccgaggugaagaagcccggggccuccgugaaggucagcugcaaggcguccggcuacagcuucaccaacuacuacauccacugggugcgccaggccccggggcagcggcucgaguggaugggcuggaucaacgccgggaacggcaacaccaaguacucccagaaguuccagggccgcgugacgaucacccgggacaccagcgccuccaccgccuacauggagcugagcucccugcgcagcgaggacacggcggucuacuacugcgugcggcgccagcgguuccccuacuacuucgacuacugggggcagggcacccucgugaccgucuccagcgccuccaccaaggggcccagcguguucccccuggccccguccagcaaguccacgagcggcgggaccgccgcgcugggcugccucgugaaggacuacuuccccgagcccgucaccguguccuggaacagcggcgcccugaccagcggggugcacacguuccccgccguccugcaguccagcggccucuacucccugagcuccguggugaccgucccgagcuccagccuggggacccagaccuacaucugcaacgugaaccacaagcccuccaacacgaagguggacaagcgcgucgagcccaagagcugcgacaagacccacacgugcccgcccugccccgcccccgagcuccugggcggccccuccguguuccuguucccgcccaagcccaaggacacccucaugaucagccggacccccgaggugaccugcgucguggucgacgugucccacgaggacccggaggugaaguucaacugguacgucgacgggguggaggugcacaacgccaagaccaagccccgcgaggagcaguacaacagcaccuaccgggucguguccgugcugacgguccugcaccaggacuggcucaacggcaaggaguacaagugcaaggugagcaacaaggcgcugcccgcccccaucgagaagaccaucuccaaggccaaggggcagccgcgcgagccccagguguacacccugccgcccagccgggaggagaugaccaagaaccaggucucccucacgugccuggugaagggcuucuaccccagcgacaucgccguggagugggagagcaacgggcagcccgagaacaacuacaagaccacgcccccgguccuggacuccgacggcagcuucuuccucuacuccaagcugaccguggacaagagccgcuggcagcagggcaacguguucuccugcagcgucaugcacgaggcccugcacaaccacuacacccagaagucccucagccugucccccgggaag

SEQ ID NO: 8154 - RNA, 642 nt, Artificial Sequence
  derived and/or modified sequence opt1 from Lenzilumab_LightChain1
gagaucgugcugacccagagccccgccacccucuccgucagcccgggcgagcgcgccacgcuguccugccgggcgagccaguccguggggaccaacguggccugguaccagcagaagcccggccaggcgccccgcguccugaucuacagcaccuccagccgggccaccgggaucacggaccgcuucuccggcagcggguccggcaccgacuucacccucaccaucagccggcuggagcccgaggacuucgccguguacuacugccagcaguucaacaaguccccgcugacguucggcgggggcaccaagguggagaucaagcgcaccgucgccgcccccagcguguucaucuucccgcccuccgacgagcagcucaagagcgggaccgccuccguggucugccugcugaacaacuucuacccccgggaggccaaggugcaguggaagguggacaacgcgcuccagagcggcaacucccaggagagcgucacggagcaggacagcaaggacuccaccuacagccuguccagcacccugacccucuccaaggccgacuacgagaagcacaagguguacgccugcgaggugacgcaccaggggcugagcucccccgucaccaagagcuucaaccgcggcgagugc

SEQ ID NO: 8155 - RNA, 1326 nt, Artificial Sequence
  derived and/or modified sequence opt1 from Lerdelimumab_HeavyChain1
gaggugcagcuggucgagagcggcgggggcguggugcagcccgggcgcucccuccggcugagcugcgccgccuccggcuucaccuucagcuccuacgggaugcacuggguccgccaggcgccgggcaagggccuggaguggguggccgugaucugguacgacgggagcaacaaguacuacgccgacuccgucaagggccgguucaccaucagccgcgacaacuccaagaacacgcucuaccugcagauggacagccugcgggccgaggacaccgccguguacuacugcgggcgcacccucgaguccagccuguggggccaggggacccuggugacggucuccagcgcguccaccaagggccccagcguguucccccucgcccccugcucccggagcaccuccgagagcaccgccgcccugggcugccuggugaaggacuacuucccggagcccgucacggugagcuggaacuccggggcgcucaccagcggcgugcacaccuuccccgccguccugcaguccagcgggcuguacucccucagcuccguggugaccguccccagcuccagccugggcacgaagaccuacacgugcaacguggaccacaagccguccaacaccaagguggacaagcgcgucgagagcaaguacggcccgcccugccccuccugccccgcccccgaguuccucgggggccccagcguguuccuguucccgcccaagcccaaggacacccugaugaucucccggacccccgaggugaccugcgucguggucgacgugagccaggaggaccccgaggugcaguucaacugguacgucgacgggguggaggugcacaacgccaagaccaagccgcgcgaggagcaguucaacuccacguaccgggucgugagcgugcugaccguccuccaccaggacuggcugaacggcaaggaguacaagugcaagguguccaacaaggggcugcccagcagcaucgagaagaccaucuccaaggccaagggccagccccgcgagccccagguguacacccucccgcccagccaggaggagaugacgaagaaccaggucucccugaccugccuggugaagggcuucuaccccagcgacaucgcgguggagugggaguccaacgggcagcccgagaacaacuacaagaccaccccgcccguccucgacagcgacggcuccuucuuccuguacagccggcugacgguggacaagucccgcuggcaggaggggaacguguucagcugcuccgucaugcacgaggcccuccacaaccacuacacccagaagucccugagccugagccucggcaag

SEQ ID NO: 8156 - RNA, 645 nt, Artificial Sequence
  derived and/or modified sequence opt1 from Lerdelimumab_LightChain1
agcuccgagcugacccaggaccccgccgugagcgucgcccucggccagaccgugcgcaucacgugccagggggacucccugcggagcuacuacgcguccugguaccagcagaagccgggccaggcccccgugcuggucaucuacgggaagaacaaccgccccagcggcauccccgaccgguucuccgggagcuccagcggcaacaccgccucccucaccaucaccggcgcccaggccgaggacgaggcggacuacuacugcaacagccgcgacuccagcuccacgcaccgcgggguguucggcgggggcaccaagcugaccgugcuggggcagccgaaggccgcccccagcgucacccucuucccgcccuccagcgaggagcugcaggccaacaaggcgacgcuggugugccucaucuccgacuucuaccccggcgccgugaccgucgccuggaaggccgacagcagccccgugaaggccggcguggagaccaccacgcccuccaagcagagcaacaacaaguacgcggccuccagcuaccugucccugacccccgagcaguggaagucccaccggagcuacagcugccaggucacccacgagggguccaccguggagaagacgguggccccgaccgagugcagc

SEQ ID NO: 8157 - RNA, 1353 nt, Artificial Sequence
  derived and/or modified sequence opt1 from Lexatumumab_HeavyChain1
gaggugcagcugguccagagcggcgggggcguggagcgccccgggggcucccuccggcugagcugcgccgccuccggguucaccuucgacgacuacggcaugagcugggugcgccaggcgccgggcaaggggcuggagugggucuccggcaucaacuggaacgggggcagcaccggguacgccgacuccgugaagggccgggugacgaucagccgcgacaacgccaagaacucccucuaccugcagaugaacagccugcgggccgaggacaccgccgucuacuacugcgcgaagauccucggcgccgggcgcggcugguacuucgaccugugggggaagggcaccaccgugacgguguccagcgccuccaccaagggccccagcgucuucccccuggcccccuccagcaaguccaccagcgggggcaccgcggcccucgggugccuggugaaggacuacuucccggagcccgugacggucuccuggaacagcggcgcccugaccagcggggugcacaccuuccccgccgugcuccaguccagcggccuguacucccugagcuccgucgugaccgugcccagcuccagccucggcacgcagaccuacaucugcaacgucaaccacaagccguccaacaccaagguggacaagcggguggagcccaagagcugcgacaagacccacacgugcccgcccugcccggcccccgagcugcucgggggccccuccgucuuccuguucccgcccaagcccaaggacacccugaugaucagccgcacccccgaggugaccugcguggucguggacgucucccacgaggaccccgaggugaaguucaacugguacguggacggggucgaggugcacaacgcgaagacgaagccgcgggaggagcaguacaacagcaccuaccgcguggucuccgugcugaccgugcuccaccaggacuggcugaacggcaaggaguacaagugcaaggucagcaacaaggcccugcccgcccccaucgagaagaccaucuccaaggccaaggggcagccccgggagccccagguguacacgcucccgcccagccgcgaggagaugaccaagaaccaggugucccugaccugccuggucaagggcuucuaccccagcgacaucgccguggagugggagagcaacggccagcccgagaacaacuacaagaccacgccgcccgugcucgacuccgacgggagcuucuuccuguacuccaagcugaccgucgacaagagccgguggcagcagggcaacguguucuccugcagcgugaugcacgaggcgcuccacaaccacuacacccagaagucccugagccugucccccgggaag

SEQ ID NO: 8158 - RNA, 1353 nt, Artificial Sequence; identical to SEQ ID NO: 8157
  derived and/or modified sequence opt1 from Lexatumumab_HeavyChain

SEQ ID NO: 8159 - RNA, 642 nt, Artificial Sequence
  derived and/or modified sequence opt1 from Lexatumumab_LightChain1
agcuccgagcugacccaggaccccgccgugagcgucgcccucggccagaccgugcgcaucacgugccagggggacucccugcggagcuacuacgcguccugguaccagcagaagccgggccaggcccccgugcuggucaucuacgggaagaacaaccgccccagcggcauccccgaccgguucuccgggagcuccagcggcaacaccgccucccucaccaucaccggcgcccaggccgaggacgaggcggacuacuacugcaacagccgcgacuccagcgggaaccacgugguguucggcgggggcacgaagcugaccguccuggggcagccgaaggccgcccccuccgugacccucuucccgcccagcuccgaggagcugcaggccaacaaggcgacccuggugugccucaucagcgacuucuaccccggcgccgucacgguggccuggaaggccgacuccagccccgugaaggccggcgucgagaccaccacccccagcaagcaguccaacaacaaguacgcggccagcuccuaccugagccugacgcccgagcaguggaagucccaccggagcuacuccugccaggugacccacgaggggagcaccguggagaagaccgucgccccgacggagugcucc

SEQ ID NO: 8160 - RNA, 642 nt, Artificial Sequence; identical to SEQ ID NO: 8159
  derived and/or modified sequence opt1 from Lexatumumab_LightChain

SEQ ID NO: 8161 - RNA, 1377 nt, Artificial Sequence
  derived and/or modified sequence opt1 from Libivirumab_HeavyChain1
caggugcagcuggucgagagcggcgggggcguggugcgccccgggcggucccuccgccugagcugcgccgccuccggcuucgcguucagcgacuacuccaucaacuggguccggcaggccccggggaagggccuggaguggguggccaucaucagcuacgacggccgcaucaccuacuaccgggacuccgugaaggggcgcuucaccaucagccgggacgacuccaagaacacgcucuaccugcagaugaacagccugcgcaccgaggacaccgccgucuacuacugcgcccggcaguacuacgacuucugguccggcagcuccguggggcgcaacuacgacggcauggacgugugggggcucggcaccacggucaccgugagcuccgcgagcaccaagggccccuccguguucccccuggcccccagcuccaagagcaccagcgggggcacggccgcccuggggugccucgucaaggacuacuucccggagcccgugaccguguccuggaacagcggcgcgcugaccuccggcguccacaccuuccccgccgugcugcagagcuccgggcucuacagccuguccagcguggucacggugcccuccagcucccugggcacccagaccuacaucugcaacgugaaccacaagccgagcaacaccaaggucgacaagcggguggagcccaaguccugcgacaagacgcacacgugcccgcccugccccgcccccgagcuccucgggggccccagcguguuccuguucccgcccaagcccaaggacacccucaugaucucccgcacccccgaggugaccugcgucgucguggacgugagccacgaggaccccgaggucaaguucaacugguacguggacgggguggagguccacaacgccaagaccaagccgcgggaggagcaguacaacuccaccuaccgcguggugagcguccugaccgugcugcaccaggacuggcucaacggcaaggaguacaagugcaagguguccaacaaggcccugcccgcgcccaucgagaagacgaucagcaaggccaagggccagccccgggagccgcaggucuacacccugccgcccagccgcgaggagaugaccaagaaccaggugucccugaccugccuggugaagggguucuaccccagcgacaucgccgucgagugggaguccaacggccagcccgagaacaacuacaagacgaccccgcccgugcuggacagcgacggguccuucuuccucuacagcaagcugaccguggacaagucccgguggcagcagggcaacgucuucagcugcuccgugaugcacgaggcccugcacaaccacuacacccagaagucccucagccugagccccgggaag

SEQ ID NO: 8162 - RNA, 657 nt, Artificial Sequence
  derived and/or modified sequence opt1 from Libivirumab_LightChain1
gacaucgugaugacccagagcccccugucccucagcgucaccccgggcgagcccgccuccaucagcugccgcuccagccagucccugcugcaccggagcgggaacaacuaccucgacugguaccugcagaagcccggccacagcccccagcugcucaucuacguggggagcaaccgcgccuccggcgugccggaccgguucagcggguccggcagcggcacggaguacacccugaagaucucccgcgucgaggcggaggacguggggguguacuacugcaugcaggcccugcagacgccccggaccuucggccaggggacgaagcucgagaucaagcgcaccgucgccgcccccagcguguucaucuucccgcccuccgacgagcagcugaaguccggcaccgccuccguggucugccugcucaacaacuucuacccccgggaggcgaaggugcaguggaagguggacaacgcccugcagagcgggaacagccaggaguccgucaccgagcaggacagcaaggacuccacguacagccuguccagcacccucacccuguccaaggccgacuacgagaagcacaagguguacgccugcgaggugacccaccagggccugagcucccccgucaccaagagcuucaaccgcggcgagugc

SEQ ID NO: 8163 - RNA, 1350 nt, Artificial Sequence
  derived and/or modified sequence opt1 from Lifastuzumab_HeavyChain
gaggugcagcuggucgagagcggcgggggccucgugcagcccgggggcucccugcgccugagcugcgccgccuccggguucagcuucuccgacuucgcgaugagcugggugcggcaggccccgggcaagggccucgagugggucgccaccaucgggcgcguggccuuccacaccuacuaccccgacuccaugaagggccgguucacgaucagccgcgacaacuccaagaacacccuguaccugcagaugaacagccuccgggccgaggacaccgcgguguacuacugcgcccgccaccggggguucgacgucggccacuucgacuucugggggcagggcacccuggugacgguguccagcgccuccaccaagggccccagcgucuucccccuggccccguccagcaaguccaccagcgggggcaccgcggcccucgggugccuggugaaggacuacuuccccgagcccgugacggucuccuggaacagcggcgcccugaccagcggcgugcacaccuuccccgccgugcuccaguccagcgggcuguacucccugagcuccgucgugaccgugccgagcuccagccucggcacgcagaccuacaucugcaacgucaaccacaagcccuccaacaccaagguggacaagaagguggagcccaagagcugcgacaagacccacacgugcccgcccugccccgcccccgagcugcucgggggccccuccgucuuccuguucccgcccaagcccaaggacacccugaugaucagccgcacccccgaggugaccugcguggucguggacgucucccacgaggacccggaggugaaguucaacugguacguggacggggucgaggugcacaacgcgaagacgaagccccgggaggagcaguacaacagcaccuaccgcguggucuccgugcugaccgugcuccaccaggacuggcugaacggcaaggaguacaagugcaaggucagcaacaaggcccugcccgcccccaucgagaagaccaucuccaaggccaagggccagccgcgggagccccagguguacacgcucccgcccagccgcgaggagaugaccaagaaccaggugucccugaccugccuggucaagggguucuaccccagcgacaucgccguggagugggagagcaacggccagcccgagaacaacuacaagaccacgcccccggugcucgacuccgacgggagcuucuuccuguacuccaagcugaccgucgacaagagccgguggcagcagggcaacguguucuccugcagcgugaugcacgaggcgcuccacaaccacuacacccagaagucccugagccugucccccgggaag

SEQ ID NO: 8164 - RNA, 657 nt, Artificial Sequence
  derived and/or modified sequence opt1 from Lifastuzumab_LightChain
gacauccagaugacgcagagccccuccagccuguccgccagcgugggcgaccgcgucaccaucacgugccgguccagcgagacccucgugcacuccagcgggaacaccuaccuggagugguaccagcagaagccgggcaaggcccccaagcugcucaucuaccgcguguccaaccgguucagcgggguccccucccgcuucagcggcuccgggagcggcaccgacuucacgcugaccaucuccagccugcagcccgaggacuucgcgaccuacuacugcuuccagggcuccuucaacccgcucaccuucgggcagggcacgaagguggagaucaagcggaccguggccgcccccagcgucuucaucuucccgcccuccgacgagcagcucaagagcgggaccgccagcguggugugccugcugaacaacuucuacccccgcgaggccaagguccaguggaagguggacaacgcgcugcaguccggcaacagccaggaguccgugaccgagcaggacagcaaggacuccacguacagccuguccagcacccucacccuguccaaggccgacuacgagaagcacaaggucuacgccugcgaggugacccaccaggggcugagcucccccgugaccaagagcuucaaccggggcgagugc

SEQ ID NO: 8165 - RNA, 1347 nt, Artificial Sequence
  derived and/or modified sequence opt1 from Lifastuzumab_vedotin_HeavyChain1
gugcagcuggucgagagcggcgggggccucgugcagcccgggggcucccugcgccugagcugcgccgccuccggguucagcuucuccgacuucgcgaugagcugggugcggcaggccccgggcaagggccucgagugggucgccaccaucgggcgcguggccuuccacaccuacuaccccgacuccaugaagggccgguucacgaucagccgcgacaacuccaagaacacccuguaccugcagaugaacagccuccgggccgaggacaccgcgguguacuacugcgcccgccaccggggguucgacgucggccacuucgacuucugggggcagggcacccuggugacgguguccagcgccuccaccaagggccccagcgucuucccccuggccccguccagcaaguccaccagcgggggcaccgcggcccucgggugccuggugaaggacuacuuccccgagcccgugacggucuccuggaacagcggcgcccugaccagcggcgugcacaccuuccccgccgugcuccaguccagcgggcuguacucccugagcuccgucgugaccgugccgagcuccagccucggcacgcagaccuacaucugcaacgucaaccacaagcccuccaacaccaagguggacaagaagguggagcccaagagcugcgacaagacccacacgugcccgcccugccccgcccccgagcugcucgggggccccuccgucuuccuguucccgcccaagcccaaggacacccugaugaucagccgcacccccgaggugaccugcguggucguggacgucucccacgaggacccggaggugaaguucaacugguacguggacggggucgaggugcacaacgcgaagacgaagccccgggaggagcaguacaacagcaccuaccgcguggucuccgugcugaccgugcuccaccaggacuggcugaacggcaaggaguacaagugcaaggucagcaacaaggcccugcccgcccccaucgagaagaccaucuccaaggccaagggccagccgcgggagccccagguguacacgcucccgcccagccgcgaggagaugaccaagaaccaggugucccugaccugccuggucaagggguucuaccccagcgacaucgccguggagugggagagcaacggccagcccgagaacaacuacaagaccacgcccccggugcucgacuccgacgggagcuucuuccuguacuccaagcugaccgucgacaagagccgguggcagcagggcaacguguucuccugcagcgugaugcacgaggcgcuccacaaccacuacacccagaagucccugagccugucccccgggaag

SEQ ID NO: 8166 - RNA, 657 nt, Artificial Sequence; identical to SEQ ID NO: 8164
  derived and/or modified sequence opt1 from Lifastuzumab_vedotin_LightChain1

SEQ ID NO: 8167 - RNA, 1359 nt, Artificial Sequence
  derived and/or modified sequence opt1 from Ligelizumab_HeavyChain1
caggugcagcugguccagagcggcgccgaggugaugaagcccggguccagcgugaaggucuccugcaaggccagcggcuacaccuucuccugguacuggcucgagugggugcgccaggcgccggggcacggccuggaguggaugggggagaucgaccccggcaccuucaccaccaacuacaacgagaaguucaaggcccgggugaccuucaccgccgacacgagcaccuccaccgccuacauggagcugagcucccuccgcagcgaggacaccgccgucuacuacugcgcgcgguucucccacuucagcggcuccaacuacgacuacuucgacuacugggggcagggcacgcuggugaccgugagcuccgccagcaccaaggggcccuccgucuucccccuggccccgagcuccaagagcaccagcggcgggacggccgcgcucggcugccuggugaaggacuacuuccccgagcccgugaccgucuccuggaacagcggcgcccugaccuccggggugcacaccuuccccgccgugcuccagagcuccggccuguacagccuguccagcgucgugacggugccguccagcucccucgggacccagaccuacaucugcaacgucaaccacaagcccagcaacaccaagguggacaagaagguggagcccaaguccugcgacaagacgcacacgugcccgcccugccccgcccccgagcugcugggcggccccagcgucuuccucuucccgcccaagcccaaggacacccugaugaucucccgcacccccgaggugaccugcguggucguggacgucagccacgaggacccggaggugaaguucaacugguacguggacggggucgaggugcacaacgccaagaccaagccccgggaggagcaguacaacuccaccuaccgcguggucagcgugcugaccgugcuccaccaggacuggcugaacggcaaggaguacaagugcaaggucuccaacaaggcgcugcccgcccccaucgagaagacgaucagcaaggccaaggggcagccgcgggagccccagguguacacccucccgcccagccgcgacgagcugaccaagaaccaggugucccugaccugccucgucaagggcuucuaccccagcgacaucgccguggagugggaguccaacgggcagcccgagaacaacuacaagacgacgcccccggugcuggacagcgacggcuccuucuuccuguacagcaagcucaccgucgacaagucccgguggcagcagggcaacguguucagcugcuccgugaugcacgaggcccugcacaaccacuacacccagaagucccugagccucagccccgggaag

SEQ ID NO: 8168 - RNA, 642 nt, Artificial Sequence
  derived and/or modified sequence opt1 from Ligelizumab_LightChain1
gagaucgugaugacccagagccccgccacccuguccgucagcccgggcgagcgcgccacgcucuccugccgggcgagccaguccaucgggaccaacauccacugguaccagcagaagcccggccaggcgccccgccugcugaucuacuacgccagcgaguccaucagcgggauccccgcccgguucuccggcagcggguccggcaccgaguucacccucacgaucagcucccugcagagcgaggacuucgccguguacuacugccagcaguccuggagcuggccgaccaccuucggcgggggcaccaagguggagaucaagcgcacggucgccgcccccuccguguucaucuucccgcccagcgacgagcagcugaaguccgggaccgccagcguggucugccuccugaacaacuucuacccccgggaggccaaggugcaguggaagguggacaacgcgcugcagagcggcaacucccaggagagcgucaccgagcaggacuccaaggacagcaccuacucccucagcuccacgcugacccugagcaaggccgacuacgagaagcacaagguguacgccugcgaggugacccaccaggggcucuccagccccgucaccaaguccuucaaccgcggcgagugc

SEQ ID NO: 8169 - RNA, 1329 nt, Artificial Sequence; identical to SEQ ID NO: 7717
  derived and/or modified sequence opt1 from Lilotomab_HeavyChain1

SEQ ID NO: 8170 - RNA, 642 nt, Artificial Sequence; identical to SEQ ID NO: 7718
  derived and/or modified sequence opt1 from Lilotomab_LightChain1

SEQ ID NO: 8171 - RNA, 1338 nt, Artificial Sequence
  derived and/or modified sequence opt1 from Lintuzumab_HeavyChain1
caggugcagcugguccagagcggcgccgaggugaagaagcccggguccagcgugaaggucuccugcaaggccagcggcuacaccuucaccgacuacaacaugcacugggugcgccaggcgccggggcagggccucgaguggaucggguacaucuaccccuacaacggcggcacgggguacaaccagaaguucaaguccaaggccaccaucaccgccgacgagagcaccaacacggccuacauggagcuguccagccugcgguccgaggacaccgccguguacuacugcgcgcgcggccggcccgccauggacuacugggggcagggcacccucgucaccgugagcuccgccagcacgaaggggcccuccguguucccgcuggcccccagcuccaagagcaccuccggcggcaccgcggcccuggggugccucgucaaggacuacuuccccgagcccgugaccgugagcuggaacuccggcgcccugacgagcgggguccacaccuucccggccgugcugcagagcuccggccucuacagccuguccagcguggucaccgugcccuccagcucccugggcacccagacguacaucugcaacgugaaccacaagcccagcaacaccaaggucgacaagaagguggagcccaaguccugcgacaagacccacacgugcccgcccugccccgcccccgagcuccucgggggcccgagcguguuccuguucccgcccaagcccaaggacacccugaugaucucccgcacccccgaggugaccugcgucguggucgacgugagccacgaggaccccgaggucaaguucaacugguacguggacgggguggagguccacaacgcgaagaccaagccccgggaggagcaguacaacuccacguaccgcguggugagcguccugaccgugcugcaccaggacuggcucaacggcaaggaguacaagugcaagguguccaacaaggcccugcccgccccgaucgagaagaccaucagcaaggccaaggggcagccccgggagccccaggucuacacccugcccccgucccgcgacgagcucacgaagaaccaggugagccugaccugccuggugaagggcuucuaccccuccgacaucgccgucgagugggagagcaacggccagcccgagaacaacuacaagaccaccccgcccgugcucgacagcgacggguccuucuuccuguacagcaagcugacgguggacaagucccgguggcagcagggcaacgucuucagcugcuccgugaugcacgaggcgcuccacaaccacuacacccagaagucccugagccugagccccgggaag

SEQ ID NO: 8172 - RNA, 654 nt, Artificial Sequence
  derived and/or modified sequence opt1 from Lintuzumab_LightChain1
gacauccagaugacccagagccccuccagccuguccgccagcgugggcgaccgcgucaccaucacgugccgggccuccgagagcguggacaacuacgggaucuccuucaugaacugguuccagcagaagccgggcaaggcgcccaagcuccugaucuacgccgccagcaaccagggguccggcgugcccagccgcuucuccgggagcggcuccggcaccgacuucacccugaccaucagcucccuccagcccgacgacuucgccacguacuacugccagcagagcaaggaggucccguggaccuucgggcagggcaccaagguggagaucaagcggaccguggccgcgcccuccgucuucaucuucccgcccagcgacgagcagcugaaguccgggacggccagcguggugugccugcucaacaacuucuacccccgcgaggccaagguccaguggaagguggacaacgcccugcagagcggcaacucccaggagagcgugaccgagcaggacuccaaggacagcaccuacucccugagcuccacccucacgcugagcaaggcggacuacgagaagcacaaggucuacgccugcgaggugacccaccaggggcuguccagccccgugaccaaguccuucaaccggggcgagugc

SEQ ID NO: 8173 - RNA, 1350 nt, Artificial Sequence
  derived and/or modified sequence opt1 from Lirilumab_HeavyChain1
caggugcagcugguccagagcggcgccgaggugaagaagcccggguccagcgugaaggucuccugcaaggccagcggcgggaccuucuccuucuacgcgaucagcugggugcgccaggccccgggccaggggcucgaguggaugggcggcuucauccccaucuucggggccgccaacuacgcccagaaguuccagggccgggugaccaucacggcggacgaguccaccagcaccgccuacauggagcuguccagccugcgcuccgacgacaccgccgucuacuacugcgcccggauccccagcggguccuacuacuacgacuacgacauggacguguggggccaggggacgaccgugaccgucagcuccgcgagcaccaagggccccuccguguucccgcucgcccccugcagccgcuccacgagcgagagcaccgccgcccugggcugccuggugaaggacuacuuccccgagcccgucaccguguccuggaacagcggggcccucaccuccggcgugcacacguucccggcgguccugcagagcuccgggcuguacagccucuccagcguggugaccguccccuccagcucccugggcaccaagaccuacacgugcaacguggaccacaagcccagcaacaccaagguggacaagcgggucgaguccaaguacgggcccccgugcccgcccugccccgcccccgaguuccucggcggccccagcguguuccucuucccgcccaagcccaaggacacccugaugaucucccgcacccccgaggugacgugcgucguggucgacgugagccaggaggaccccgaggugcaguucaacugguacgucgacgggguggaggugcacaacgccaagaccaagccccgggaggagcaguucaacuccaccuaccgcgucgugagcgugcugaccguccuccaccaggacuggcugaacggcaaggaguacaagugcaagguguccaacaaggggcugccgagcagcaucgagaagacgaucuccaaggccaagggccagccccgggagccccagguguacacccugcccccgagccaggaggagaugaccaagaaccaggucucccugaccugccuggugaagggcuucuaccccagcgacaucgccguggagugggaguccaacgggcagcccgagaacaacuacaagacgaccccgcccguccucgacagcgacggcuccuucuuccuguacagccgccugaccguggacaagucccgguggcaggaggggaacguguucagcugcuccgucaugcacgaggcgcuccacaaccacuacacccagaagucccugagccugagccucggcaag

SEQ ID NO: 8174 - RNA, 642 nt, Artificial Sequence
  derived and/or modified sequence opt1 from Lirilumab_LightChain1
gagaucgugcugacccagagccccgucacccucucccugagcccgggcgagcgcgccacgcuguccugccgggccagccaguccgugagcuccuaccucgcgugguaccagcagaagcccgggcaggcgccccgccugcugaucuacgacgccagcaaccgggccaccggcauccccgcccgcuucuccgggagcggcuccgggaccgacuucacccucacgaucagcucccuggagccggaggacuucgccguguacuacugccagcagcggagcaacuggauguacaccuucggccagggcaccaagcuggagaucaagcgcaccgucgccgcccccuccguguucaucuucccgcccagcgacgagcagcucaaguccgggacggccagcguggucugccugcugaacaacuucuacccccgggaggcgaaggugcaguggaagguggacaacgcccuccaguccggcaacagccaggagagcgucaccgagcaggacuccaaggacagcaccuacucccugagcuccacccugacgcucagcaaggccgacuacgagaagcacaagguguacgccugcgaggugacccaccaggggcuguccagccccgucaccaaguccuucaaccgcggcgagugc

SEQ ID NO: 8175 - RNA, 1344 nt, Artificial Sequence
  derived and/or modified sequence opt1 from Lodelcizumab_HeavyChain1
caggugcagcugguccagagcggcgccgaggugaagaagcccggggccuccgugaaggucagcugcaaggcguccggcuacaccuucagcaccauguacauguccugggugcgccaggccccggggcagggccucgaguggauggggcggaucgaccccgccaacgagcacacgaacuacgcccagaaguuccagggccgcgugaccaugacccgggacaccagcaucuccacggccuacauggagcugagccgccugaccuccgacgacaccgcggucuacuacugcgcccggagcuacuacuacuacaacauggacuacuggggccaggggacccucgugacgguguccagcgccuccaccaagggccccagcgucuucccccuggccccguccagcaaguccaccagcgggggcaccgcggcccuggggugccucgugaaggacuacuuccccgagcccgugacggucuccuggaacagcggcgcccugaccagcggcgugcacaccuuccccgccgugcugcaguccagcgggcucuacucccugagcuccgucgugaccgugccgagcuccagccugggcacgcagaccuacaucugcaacgucaaccacaagcccuccaacaccaagguggacaagcgcguggagcccaagagcugcgacaagacccacacgugcccgcccugccccgcccccgaggcggccgggggccccuccgucuuccucuucccgcccaagcccaaggacacccugaugaucagccggacccccgaggugaccugcguggucguggacgucucccacgaggacccggaggugaaguucaacugguacguggacggcgucgaggugcacaacgccaagacgaagccccgcgaggagcaguacaacagcaccuaccggguggucuccgugcugaccgugcuccaccaggacuggcugaacgggaaggaguacaagugcaaggucagcaacaaggcccugcccgcccccaucgagaagaccaucuccaaggcgaagggccagccgcgcgagccccagguguacacgcucccgcccagccgggaggagaugaccaagaaccaggugucccugaccugccuggucaagggguucuaccccagcgacaucgccguggagugggagagcaacggccagcccgagaacaacuacaagaccacgcccccggugcucgacuccgacgggagcuucuuccuguacuccaagcugaccgucgacaagagccgcuggcagcagggcaacguguucuccugcagcgugaugcacgaggcccuccacaaccacuacacccagaagucccugagccugucccccggcaag

SEQ ID NO: 8176 - RNA, 639 nt, Artificial Sequence
  derived and/or modified sequence opt1 from Lodelcizumab_LightChain1
cagaucgugcugacccagagccccgccacccucuccgucagccccggcgagcgcgccacgcuguccugccgggcgagccaguccgugagcuacaugcacugguaccagcagaagcccgggcaggcgccccgccugcucaucuacggcguguuccggcgcgccaccgggauccccgaccgguucuccggcagcggguccggcaccgacuucacccugacgaucggccgccuggagccggaggacuucgccgucuacuacugccuccaguggagcuccgacccgcccaccuucgggcagggcaccaagcuggagaucaagcggaccguggccgcccccagcguguucaucuucccgcccuccgacgagcagcucaagagcgggacggccuccgucgugugccugcugaacaacuucuacccccgcgaggccaaggugcaguggaaggucgacaacgcccugcagagcggcaacucccaggagagcgugaccgagcaggacuccaaggacagcaccuacagccucuccagcacccugacgcuguccaaggcggacuacgagaagcacaagguguacgccugcgaggucacccaccaggggcucagcucccccgugaccaagagcuucaaccggggcgagugc

SEQ ID NO: 8177 - RNA, 1356 nt, Artificial Sequence
  derived and/or modified sequence opt1 from Lokivetmab_HeavyChain1
gaggugcagcuggucgagagcggcggggaccucgugaagcccggcgggucccugcgccugagcugcguggccuccggcuucaccuucagcaacuacgggauguccuggguccggcaggcccccggcaagggccuccaguggguggcgaccaucagcuacgggggcuccuacacguacuaccccgacaacaucaaggggcgcuucaccaucagccgggacaacgccaagaacacccuguaccugcagaugaacucccuccgcgccgaggacaccgccauguacuacugcgugcggggcuacggguacgacacgauggacuacuggggccagggcacccuggucaccgugagcuccgccagcaccacggcgcccuccguguucccccuggccccgagcugcggguccaccagcggcuccaccgucgcccucgccugccuggugagcggguacuuccccgagcccgugaccgucuccuggaacagcggcagccugacguccggcgugcacaccuuccccagcgugcuccaguccagcgggcuguacucccugagcuccauggucaccgugccgagcucccgcuggcccagcgagaccuucacgugcaacguggcgcaccccgccuccaagaccaaggucgacaagcccgugccgaagcgggagaacggccgcgugccccggccgcccgacugccccaagugccccgcccccgagaugcucgggggccccagcgucuucaucuucccgcccaagcccaaggacacccugcugaucgcccgcacccccgaggugacgugcguggucguggaccucgacccggaggaccccgagguccagaucuccugguucguggacgggaagcagaugcagaccgccaagacccagccccgggaggagcaguucaacggcaccuaccgcguggucagcgugcugcccaucggccaccaggacuggcugaaggggaagcaguucacgugcaaggugaacaacaaggcgcucccgucccccaucgagcggaccaucagcaaggcccgcggccaggcccaccagcccuccgucuacgugcugccgcccagccgggaggagcuguccaagaacaccgugagccugaccugccucaucaaggacuucuucccgcccgacaucgacgucgaguggcagagcaacgggcagcaggagcccgaguccaaguaccgcacgaccccgccccagcuggacgaggacggcagcuacuuccucuacuccaagcugagcguggacaagucccgguggcagcgcggggacaccuucaucugcgccgugaugcacgaggcccugcacaaccacuacacccaggagagccucucccacagccccggc

SEQ ID NO: 8178 - RNA, 651 nt, Artificial Sequence
  derived and/or modified sequence opt1 from Lokivetmab_LightChain1
gagaucgugaugacccagagccccgccucccugagccucucccaggaggagaaggucaccaucacgugcaaggccagccaguccgugagcuucgcgggcaccgggcugaugcacugguaccagcagaagccgggccaggcccccaagcugcucaucuaccgcgccuccaaccuggaggccggggugcccagccgguucuccggcagcggguccggcaccgacuucagcuucaccaucuccagccuggagcccgaggacgucgccguguacuacugccagcagucccgcgaguacccguggacguucggccaggggaccaagcucgagaucaagcggaacgacgcgcagcccgccguguaccuguuccagcccagccccgaccagcugcacaccggcuccgccagcgucgugugccuccugaacuccuucuacccgaaggacaucaacgugaaguggaaggucgacggggugauccaggacaccggcauccaggagagcgugacggagcaggacaaggacagcaccuacucccugagcuccacccucaccaugagcuccacggaguaccugagccacgagcuguacuccugcgagaucacccacaagagccuccccuccacccugaucaagagcuuccagcgcuccgagugc

SEQ ID NO: 8179 - RNA, 1344 nt, Artificial Sequence
  derived and/or modified sequence opt1 from Lorvotuzumab_mertansine_HeavyChain1
caggugcagcuggucgagagcggcgggggcguggugcagcccgggcgcucccuccggcugagcugcgccgccuccggcuucaccuucagcuccuucgggaugcacuggguccgccaggcgccgggcaagggccuggaguggguggccuacaucagcuccgggagcuucaccaucuacuacgccgacuccgugaagggccgguucacgaucagccgcgacaacuccaagaacacccucuaccugcagaugaacagccugcgggccgaggacaccgccgucuacuacugcgcgcgcaugcggaagggguacgccauggacuacuggggccaggggacccucgugacgguguccagcgccuccaccaagggccccagcgucuucccccuggcccccuccagcaaguccaccagcggcgggaccgcggcccugggcugccucgugaaggacuacuucccggagcccgugacggucagcuggaacuccggggcccugaccagcggcgugcacaccuuccccgccgugcugcaguccagcggccucuacucccugagcuccgucgugaccgugcccagcuccagccuggggacgcagaccuacaucugcaacgucaaccacaagccguccaacaccaagguggacaagaagguggagcccaagagcugcgacaagacccacacgugcccgcccugcccggcccccgagcuccugggcgggcccuccgucuuccuguucccgcccaagcccaaggacacccucaugaucagccgcacccccgaggugaccugcguggucguggacgucucccacgaggaccccgaggugaaguucaacugguacguggacggcgucgaggugcacaacgcgaagacgaagccgcgggaggagcaguacaacagcaccuaccgcguggucuccgugcugaccgugcugcaccaggacuggcucaacgggaaggaguacaagugcaaggucagcaacaaggcccugcccgcccccaucgagaagaccaucuccaaggccaagggccagccccgggagccccagguguacacgcugccgcccagccgcgacgagcucaccaagaaccaggugagccugaccugccuggucaagggcuucuaccccuccgacaucgccguggagugggagagcaacgggcagcccgagaacaacuacaagaccacgccgcccgugcucgacuccgacggcagcuucuuccuguacuccaagcugaccgucgacaagagccgguggcagcaggggaacguguucuccugcagcgugaugcacgaggcgcuccacaaccacuacacccagaagucccugagccugucccccggcaag

SEQ ID NO: 8180 - RNA, 657 nt, Artificial Sequence
  derived and/or modified sequence opt1 from Lorvotuzumab_mertansine_LightChain1
gacguggucaugacccagagcccccugucccucccggugacccugggccagcccgccagcaucuccugccgcagcucccagaucaucauccacagcgacgggaacacguaccuggagugguuccagcagcggcccggccagagcccccgccggcucaucuacaagguguccaaccgcuucuccggggucccggaccgguucagcggcuccgggagcggcaccgacuucacccugaagaucucccgcguggaggccgaggacgugggcgucuacuacugcuuccaggggagccacgugccccacaccuucggccaggggacgaagguggagaucaagcggaccgucgcggcccccuccguguucaucuucccgcccagcgacgagcagcugaaguccggcaccgccagcguggucugccuccugaacaacuucuacccccgcgaggccaaggugcaguggaagguggacaacgcccugcaguccgggaacagccaggagagcgucaccgagcaggacuccaaggacagcacguacucccucagcuccacccugacccugagcaaggcggacuacgagaagcacaagguguacgccugcgaggugacccaccagggccucuccagccccgucacgaaguccuucaaccggggcgagugc

SEQ ID NO: 8181 - RNA, 336 nt, Artificial Sequence
  derived and/or modified sequence opt1 from Lpathomab_VL
gacguggucaugacccagacgccccugagccucccggugucccugggcgaccaggccagcaucuccugcaccagcgggcagucccuggugcacaucaacggcaacaccuaccuccacugguaccugcagaagcccgggcagagccccaagcugcucaucuacaaggucuccaaccuguucagcggcgugcccgaccgcuucuccgggagcggcuccggcaccgacuucacccugaagaucagccggguggaggccgaggaccucggggucuacuucugcucccagagcacgcacuucccguucaccuucggcaccgggaccaagcuggagaucaag

SEQ ID NO: 8182 - RNA, 366 nt, Artificial Sequence
  derived and/or modified sequence opt1 from Lpathomab_gamma1-Chain_VDJ-Region
caggugcagcugcagcagagcggcgccgagcucguccgccccgggaccuccgugaaggugagcugcaaggccuccggcuacggguucaucaacuaccugaucgaguggaucaagcagcggccgggccaggggcuggaguggaucggccucaucaaccccggcagcgacuacaccaacuacaacgagaacuucaaggggaaggcgacgcugaccgccgacaaguccagcuccaccgccuacaugcaccugagcucccucaccagcgaggacuccgccgucuacuucugcgcccgccgguucggcuacuacgggagcggcaacuacuucgacuacugggggcagggcacgacccugaccguguccagc

SEQ ID NO: 8183 - RNA, 1350 nt, Artificial Sequence
  derived and/or modified sequence opt1 from Lucatumumab_HeavyChain1
caggugcagcuggucgagagcggcgggggcguggugcagcccgggcgcucccuccggcugagcugcgccgccuccggcuucaccuucagcuccuacgggaugcacuggguccgccaggcgccgggcaagggccuggaguggguggccgugaucagcuacgaggaguccaaccgguaccacgccgacagcgucaaggggcgcuucaccaucucccgggacaacagcaagaucacgcucuaccugcagaugaacucccugcgcaccgaggacaccgccguguacuacugcgcccgggacggcgggaucgcggcccccggccccgacuacugggggcagggcacccucgugacggucagcuccgccagcaccaagggccccuccguguucccgcuggcccccgcgagcaaguccaccagcgggggcaccgccgcccuggggugccucgugaaggacuacuuccccgagcccgucacgguguccuggaacagcggcgcccugaccagcggcgugcacaccuucccggccguccugcaguccagcgggcucuacucccugagcuccguggugaccguccccagcuccagccugggcacgcagaccuacaucugcaacgugaaccacaagcccuccaacaccaagguggacaagcgcgucgagcccaagagcugcgacaagacccacacgugcccgcccugccccgcgcccgagcuccucgggggcccguccguguuccuguucccgcccaagcccaaggacacccucaugaucagccggacccccgaggugaccugcgucguggucgacgugucccacgaggaccccgaggugaaguucaacugguacgucgacgggguggaggugcacaacgccaagacgaagccccgcgaggagcaguacaacagcaccuaccgggucguguccgugcugaccguccugcaccaggacuggcucaacggcaaggaguacaagugcaaggugagcaacaaggcccugcccgccccgaucgagaagaccaucuccaaggccaagggccagccccgcgagccccagguguacacgcugcccccgagccgggaggagaugaccaagaaccaggucucccugaccugccuggugaagggguucuaccccagcgacaucgcgguggagugggagagcaacggccagcccgagaacaacuacaagaccacgccgcccguccuggacuccgacgggagcuucuuccucuacuccaagcugaccguggacaagagccgcuggcagcagggcaacguguucuccugcagcgucaugcacgaggcccugcacaaccacuacacccagaagucccucagccugucccccgggaag

SEQ ID NO: 8184 - RNA, 657 nt, Artificial Sequence
  derived and/or modified sequence opt1 from Lucatumumab_LightChain1
gacaucgugaugacccagagcccccugucccucaccgucacgccgggcgagcccgccagcaucuccugccgcagcucccagagccugcuguacuccaacggguacaacuaccucgacugguaccugcagaagcccggccagagcccccaggugcugaucucccucgggagcaaccgggccuccggcgugccggaccgcuucagcggguccggcagcggcaccgacuucacccugaagaucucccgggucgaggcggaggacguggggguguacuacugcaugcaggcccgccagacccccuucacguucggccccgggaccaaggucgacauccggcgcaccguggccgcccccagcguguucaucuucccgcccuccgacgagcagcucaagagcggcaccgccuccgucgugugccugcugaacaacuucuacccccgggaggcgaaggugcaguggaaggucgacaacgcccugcagagcgggaacagccaggaguccgugacggagcaggacagcaaggacuccaccuacagccucuccagcacccugacccuguccaaggccgacuacgagaagcacaagguguacgccugcgaggucacgcaccagggccucagcucccccgugaccaagagcuucaaccgcggcgagugc

SEQ ID NO: 8185 - RNA, 324 nt, Artificial Sequence
  derived and/or modified sequence opt1 from Lulizumab_pegol_LightChain1
gacauccagaugacccagagccccuccagccuguccgccagcgugggcgaccgcgucaccaucacgugccgggccucccgcccgaucuggcccuuccucgagugguaccagcagaagcccgggaaggcgcccaagcugcugaucuacuucaccagccggcuccgccacggcgugccgucccgguucagcggguccggcagcgggaccugcuucacccugacgaucuccagccugcagcccgaggacuucgccaccuacuacugccuccagaacguggccaaccccgccaccuucucccagggcaccaaggucgagaucaagcgc

SEQ ID NO: 8186 - RNA, 324 nt, Artificial Sequence; identical to SEQ ID NO: 8185
  derived and/or modified sequence opt1 from Lulizumab_pegol_LightChain

SEQ ID NO: 8187 - RNA, 1194 nt, Artificial Sequence
  derived and/or modified sequence opt1 from Lumiliximab_HeavyChain1
gaggugcagcuggucgagagcggcgggggccucgccaagcccgggggcucccugcgccugagcugcgccgcguccggguuccgguucaccuucaacaacuacuacauggacugggugcgccaggccccgggccagggccucgagugggugcugaccacggggagcgacuccuggggccaggggguccuggugaccgugagcuccgccagcaccaagggccccuccgucuucccccucgcccccagcuccaagagcaccuccgggggcacggccgcgcugggcugccuggugaaggacuacuucccggagcccgugaccgucagcuggaacuccggggcccucaccagcggcgugcacaccuuccccgccgugcugcaguccagcgggcuguacucccucagcagcgucgugacggugcccuccagcucccugggcacccagaccuacaucugcaacgucaaccacaagccgagcaacaccaagguggacaagaagguggagcccaaguccugcgacaagacgcacacgugcccgcccugcccggcccccgagcugcucggcgggcccagcgucuuccuguucccgcccaagcccaaggacacccugaugaucucccggacccccgaggugaccugcguggucguggacgugagccacgaggaccccgaggucaaguucaacugguacguggacggcgucgaggugcacaacgcgaagaccaagccgcgcgaggagcaguacaacuccaccuaccggguggucagcgugcucaccgugcugcaccaggacuggcugaacgggaaggaguacaagugcaaggucuccaacaaggcccuccccgcccccaucgagaagacgaucagcaaggccaagggccagccccgcgagccccagguguacacccugccgcccucccgggacgagcugaccaagaaccaggugagccugaccugccucgucaagggguucuaccccuccgacaucgccguggagugggagagcaacggccagcccgagaacaacuacaagacgaccccgcccgugcuggacuccgacggcagcuucuuccucuacuccaagcugaccgucgacaagagccgcuggcagcaggggaacguguucagcugcuccgugaugcacgaggcgcugcacaaccacuacacccagaagucccucagccugagccccggcaag

SEQ ID NO: 8188 - RNA, 642 nt, Artificial Sequence
  derived and/or modified sequence opt1 from Lumiliximab_LightChain1
gacauccagaugacccagagccccuccagccuguccgccagcgugggcgaccgcgucaccaucacgugccgggccucccaggacauccgcuacuaccucaacugguaccagcagaagccggggaaggcgcccaagcugcugaucuacguggccagcucccuccagagcggcgugcccucccgguucagcggguccggcagcgggaccgaguucacccugaccgucuccagccugcagcccgaggacuucgccacguacuacugccuccagguguacuccaccccgcgcaccuucggccagggcaccaagguggagaucaagcggacggucgccgcccccagcguguucaucuucccgcccuccgacgagcagcucaagagcgggaccgcguccguggucugccugcugaacaacuucuacccccgcgaggccaaggugcaguggaagguggacaacgcccugcagagcggcaacagccaggaguccgucaccgagcaggacagcaaggacuccaccuacagccuguccagcacgcucacccuguccaaggccgacuacgagaagcacaagguguacgcgugcgaggugacccaccaggggcugagcucccccgucaccaagagcuucaaccggggcgagugc

SEQ ID NO: 8189 - RNA, 1347 nt, Artificial Sequence
  derived and/or modified sequence opt1 from Lumretuzumab_HeavyChain1
caggugcagcugguccagagcggcgccgaggugaagaagcccggggccuccgugaaggucagcugcaaggcguccggcuacaccuuccgcagcuccuacaucagcugggugcggcaggccccggggcagggccucgaguggaugggguggaucuacgccggcaccggcucccccagcuacaaccagaagcugcaggggcgcgugaccaugaccaccgacaccuccacgagcaccgccuacauggagcugcggucccuccgcagcgacgacaccgccgucuacuacugcgcgcggcaccgcgacuacuacuccaacagccugaccuacuggggccaggggacgcuggugaccguguccagcgccuccaccaagggccccagcgucuucccccucgccccguccagcaagagcaccuccgggggcacggccgcgcugggcugccuggugaaggacuacuuccccgagcccgugaccgucagcuggaacuccggggcccucaccagcggcgugcacaccuuccccgccgugcugcaguccagcgggcuguacucccucagcuccgucgugacggugccgagcuccagccugggcacccagaccuacaucugcaacgucaaccacaagcccuccaacaccaagguggacaagaagguggagcccaagagcugcgacaagacgcacacgugcccgcccugccccgcccccgagcugcucggcgggcccuccgucuuccuguucccgcccaagcccaaggacacccugaugaucagccggacccccgaggugaccugcguggucguggacgucucccacgaggacccggaggugaaguucaacugguacguggacggcgucgaggugcacaacgccaagaccaagccccgcgaggagcaguacaacagcaccuaccggguggucuccgugcucaccgugcugcaccaggacuggcugaacgggaaggaguacaagugcaaggucagcaacaaggcgcuccccgcccccaucgagaagacgaucagcaaggccaagggccagccgcgcgagccccagguguacacccugccgcccucccgggacgagcugaccaagaaccaggugagccugaccugccucgucaagggguucuaccccuccgacaucgccguggagugggagagcaacggccagcccgagaacaacuacaagacgacgcccccggugcuggacuccgacggcagcuucuuccucuacuccaagcugaccgucgacaagagccgcuggcagcaggggaacguguucuccugcagcgugaugcacgaggcccugcacaaccacuacacccagaagucccucagccugucccccggc

SEQ ID NO: 8190 - RNA, 660 nt, Artificial Sequence
  derived and/or modified sequence opt1 from Lumretuzumab_LightChain1
gacaucgugaugacccagagccccgacucccuggccgucagccucggcgagcgggccaccaucaacugcaaguccagccaguccgugcugaacagcgggaaccagaagaacuaccugacgugguaccagcagaagccgggccagccgcccaagcuccugaucuacugggcguccacccgggagagcggggugcccgaccgcuucuccggcagcggguccggcaccgacuucacccugacgaucagcucccuccaggccgaggacgucgccguguacuacugccagagcgacuacuccuaccccuacaccuucggccaggggaccaagcuggagaucaagcggaccguggccgcccccagcgucuucaucuucccgcccuccgacgagcagcucaagagcggcacggcguccguggugugccugcugaacaacuucuacccccgcgaggccaagguccaguggaagguggacaacgcccugcagagcgggaacagccaggaguccgugaccgagcaggacagcaaggacuccaccuacagccucuccagcacccugacgcuguccaaggccgacuacgagaagcacaaggucuacgcgugcgaggugacccaccagggccucagcucccccgugaccaagagcuucaaccgcggggagugc

SEQ ID NO: 8191 - RNA, 1329 nt, Artificial Sequence; identical to SEQ ID NO: 7717
  derived and/or modified sequence opt1 from Lutetium_(177Lu)_lilotomab_satetraxetan_HeavyChain1

SEQ ID NO: 8192 - RNA, 642 nt, Artificial Sequence; identical to SEQ ID NO: 7718
  derived and/or modified sequence opt1 from Lutetium_(177Lu)_lilotomab_satetraxetan_LightChain1

SEQ ID NO: 8193 - RNA, 1350 nt, Artificial Sequence
  derived and/or modified sequence opt1 from Margetuximab_HeavyChain1
caggugcagcugcagcagagcggccccgagcucgucaagccgggggccucccugaagcugagcugcaccgccuccggcuucaacaucaaggacaccuacauccacugggugaagcagcgccccgagcaggggcucgaguggaucggccggaucuaccccacgaacggguacacccgcuacgaccccaaguuccaggacaaggcgaccaucaccgccgacacgagcuccaacaccgccuaccuccaggugagccggcugaccuccgaggacaccgccgucuacuacugcagccgcuggggcggcgacggguucuacgccauggacuacuggggccagggggcguccgugacggugagcuccgccagcaccaagggcccguccgucuucccccuggcccccagcuccaagagcaccuccgggggcaccgccgcgcugggcugccuggugaaggacuacuuccccgagccggugacggucagcuggaacuccggggcccucaccagcggcgugcacaccuuccccgccgugcugcagagcuccgggcuguacagccucuccagcgucgugaccgugcccuccagcucccugggcacgcagaccuacaucugcaacgucaaccacaagcccagcaacaccaagguggacaagcggguggagccgaaguccugcgacaagacccacacgugcccgcccugccccgccccggagcuggucggcgggcccagcguguuccuccugccgcccaagcccaaggacacccugaugaucucccgcacccccgaggugaccugcgucgugguggacgucagccacgaggaccccgaggugaaguucaacugguacgucgacggcguggaggugcacaacgccaagacgaagcccccggaggagcaguacaacuccacccuccgggucgugagcgugcugaccguccugcaccaggacuggcucaacgggaaggaguacaagugcaagguguccaacaaggcgcugcccgcccccaucgagaagaccaucagcaaggccaagggccagccccgcgagccccagguguacacgcugccgcccucccgggacgagcucaccaagaaccaggucagccugaccugccuggugaagggguucuaccccuccgacaucgccguggagugggagagcaacggccagcccgagaacaacuacaagaccacgccccucguccuggacagcgacggcuccuucuuccuguacagcaagcucaccguggacaagucccgcuggcagcaggggaacguguucagcugcuccgucaugcacgaggcccugcacaaccacuacacccagaagucccugagccucagccccggcaag

SEQ ID NO: 8194 - RNA, 642 nt, Artificial Sequence
  derived and/or modified sequence opt1 from Margetuximab_LightChain1
gacaucgugaugacccagagccacaaguucauguccaccagcgucggcgaccgcguguccaucacgugcaaggccagccaggacgugaacaccgccgucgcgugguaccagcagaagcccgggcacuccccgaagcugcucaucuacagcgccuccuuccgguacaccggcgugcccgaccgcuucaccgggagccgguccggcacggacuucaccuucaccaucagcuccgugcaggccgaggaccuggccgucuacuacugccagcagcacuacaccacgccgcccaccuucgggggcggcaccaagguggagaucaagcgcaccguggccgcgcccagcgucuucaucuucccgcccuccgacgagcagcucaagagcgggacggccuccguggugugccugcugaacaacuucuacccccgggaggccaagguccaguggaagguggacaacgcccugcagagcggcaacucccaggagagcgugaccgagcaggacuccaaggacagcaccuacagccucuccagcacccugacgcuguccaaggcggacuacgagaagcacaaggucuacgccugcgaggugacccaccaggggcucagcucccccgugaccaagagcuucaaccgcggcgagugc

SEQ ID NO: 8195 - RNA, 762 nt, Artificial Sequence
  derived and/or modified sequence opt1 from Marzeptacog_alfa_HeavyChain1
aucgugggcgggaaggucugccccaagggcgagugcccguggcagguccugcuccuggugaacggggcccagcugugcggcgggacccucaucaacaccaucuggguggugagcgccgcgcacugcuucgacaagaucaagaacuggcgcaaccugaucgccgugcugggcgagcacgaccucuccgagcacgacggcgacgagcagagccggcgcgucgcccaggugaucauccccuccacguacgugcccgggaccaccaaccacgacaucgcccugcugcggcuccaccagcccgucgugcugaccgaccacguggucccgcugugccuccccgagcgcacguucagcgagcggacccuggccuucgugcgcuucucccuggugagcggcugggggcggcuccuggaccgcggcgcgaccgcccuggagcuccagguccugaacgugccccggcugaugacccaggacugccuccagcagucccgcaaggugggggacagccccaacaucacggaguacauguucugcgccggcuacuccgacggcagcaaggacuccugcaagggggacagcggcgggccgcacgccacccacuaccggggcaccugguaccugaccggcaucgucuccugggggcagggcugcgcgacgguggggcacuucggcguguacacccgcgucagccaguacaucgaguggcugcagaagcucaugcgguccgagccccgccccggggugcugcugcgggcccccuucccg

SEQ ID NO: 8196 - RNA, 456 nt, Artificial Sequence
  derived and/or modified sequence opt1 from Marzeptacog_alfa_LightChain1
gccaacgccuuccuggaggagcuccgccccggcagccuggagcgggagugcaaggaggagcagugcuccuucgaggaggcgcgcgagaucuucaaggacgccgagcggaccaagcuguucuggaucagcuacuccgacggggaccagugcgccagcuccccgugccagaacggcgggagcugcaaggaccagcuccaguccuacaucugcuucugccugcccgccuucgagggccgcaacugcgagacccacaaggacgaccagcugaucugcgugaacgagaacgggggcugcgagcaguacugcagcgaccacacgggcaccaagcgguccugccgcugccacgagggguacagccuccuggccgacggcgucuccugcaacgcgaccguggaguaccccugcgggaagauccccauccuggagaagcggaacgccagcaagccgcagggccgc

SEQ ID NO: 8197 - RNA, 669 nt, Artificial Sequence
  derived and/or modified sequence opt1 from Matuzumab_HeavyChain1_variant_3c08_H
caggugcagcugguccagagcggcgccgaggugaagaagcccggggccuccgugaaggucagcugcaaggcguccggcuacaccuucaccagccacuggaugcacugggugcgccaggccccggggcagggccucgaguggaucggggaguucaaccccuccaacggccggacgaacuacaacgagaaguucaagagcaaggccaccaugaccguggacaccuccacgaacaccgccuacauggagcugagcucccugcgcagcgaggacaccgccgucuacuacugcgcgucccgggacuacgacuacgacggccgcuacuucgacuacugggggcagggcacccucgugacggugagcuccgccagcaccaaggggcccuccgucuucccccuggccccgagcuccaagagcaccuccggcgggaccgccgcgcugggcugccucgugaaggacuacuuccccgagcccgugacggucagcuggaacagcggcgcccugaccuccggggugcacaccuuccccgccgugcugcagagcuccggccucuacagccuguccagcgucgugaccgugccguccagcucccuggggacgcagaccuacaucugcaacgucaaccacaagcccagcaacaccaagguggacaagaagguggagcccaagucc

SEQ ID NO: 8198 - RNA, 669 nt, Artificial Sequence
  derived and/or modified sequence opt1 from Matuzumab_HeavyChain1_variant_3c09_C
caggugcagcugguccagagcggcgccgaggugaagaagcccggggccuccgugaaggucagcugcaaggcguccggcuacaccuucaccagccacuggaugcacugggugcgccaggccccggggcagggccucgaguggaucggggaguucaaccccuccaacggccggacgaacuacaacgagaaguucaagagcaaggccaccaugaccguggacaccuccacgaacaccgccuacauggagcugagcucccugcgcagcgaggacaccgccgucuacuacugcgcgucccgggacuacgacuacgccggccgcuacuucgacuacugggggcagggcacccucgugacggugagcuccgccagcaccaaggggcccuccgucuucccccuggccccgagcuccaagagcaccuccggcgggaccgcggcccugggcugccucgugaaggacuacuuccccgagcccgugacggucagcuggaacagcggcgcccugaccuccggggugcacaccuuccccgccgugcugcagagcuccggccucuacagccuguccagcgucgugaccgugccguccagcucccuggggacgcagaccuacaucugcaacgucaaccacaagcccagcaacaccaagguggacaagaagguggagcccaagucc

SEQ ID NO: 8199 - RNA, 636 nt, Artificial Sequence
  derived and/or modified sequence opt1 from Matuzumab_LightChain1_variant_3c08_L
gacauccagaugacccagagccccuccagccuguccgccagcgugggcgaccgcgucaccaucacgugcuccgccagcuccagcgugaccuacauguacugguaccagcagaagccggggaaggcgcccaagcuccugaucuacgacaccuccaaccuggccagcggcgugcccucccgguucagcggguccggcagcgggaccgacuacacguucaccaucuccagccuccagcccgaggacaucgccaccuacuacugccagcagugguccagccacaucuucaccuucggccagggcacgaaggucgagaucaagcgcaccguggccgccccguccguguucaucuucccgcccagcgacgagcagcucaagagcgggaccgcguccgucgugugccugcugaacaacuucuacccccgggaggccaaggugcaguggaaggucgacaacgcccugcagagcggcaacucccaggagagcgugaccgagcaggacuccaaggacagcacguacucccugagcuccacccucacccugagcaaggccgacuacgagaagcacaagguguacgcgugcgaggucacccaccaggggcuguccagccccgugacgaaguccuucaaccgcggcgag

SEQ ID NO: 8200 - RNA, 636 nt, Artificial Sequence; identical to SEQ ID NO: 8199
  derived and/or modified sequence opt1 from Matuzumab_LightChain1_variant_3c09_B

SEQ ID NO: 8201 - RNA, 1341 nt, Artificial Sequence
  derived and/or modified sequence opt1 from Mavrilimumab_HeavyChain1
caggugcagcugguccagagcggcgccgaggugaagaagcccggggccuccgugaaggucagcugcaagguguccggcuacacccucaccgagcugagcauccacugggugcgccaggcgccggggaagggccuggaguggaugggcggcuucgaccccgaggagaacgagaucgucuacgcccagcgguuccagggccgcgugacgaugaccgaggacaccuccaccgacacggccuacauggagcucagcucccugcggagcgaggacaccgccguguacuacugcgccaucgucggguccuucagcccccugacccucggccugugggggcagggcaccauggugacgguguccagcgcguccaccaaggggcccagcgucuucccgcuggcccccugcucccgcagcaccuccgagagcaccgccgcccucggcugccuggugaaggacuacuuccccgagcccgugacggucuccuggaacagcggcgcgcugaccagcggggugcacaccuucccggccgugcuccaguccagcggccuguacucccugagcuccgucgugaccgugcccagcuccagccucgggacgaagaccuacacgugcaacgucgaccacaagcccuccaacaccaagguggacaagcggguggagagcaaguacgggcccccgugccccuccugccccgcccccgaguuccugggcgggccgagcgucuuccuguucccgcccaagcccaaggacacccucaugaucucccgcacccccgaggugaccugcgucgugguggacgucagccaggaggaccccgaggugcaguucaacugguacguggacggcgucgaggugcacaacgccaagaccaagccccgggaggagcaguucaacuccacguaccgcguggucagcgugcugaccgugcugcaccaggacuggcucaacgggaaggaguacaagugcaaggucuccaacaagggccugcccagcuccaucgagaagaccaucagcaaggccaaggggcagccgcgggagccccagguguacacccugccgcccagccaggaggagaugacgaagaaccaggugucccugaccugccucgucaagggcuucuaccccagcgacaucgcgguggagugggaguccaacggccagcccgagaacaacuacaagaccacgcccccggugcuggacagcgacggguccuucuuccucuacagccgccugaccgucgacaagucccgguggcaggagggcaacguguucagcugcuccgugaugcacgaggcccugcacaaccacuacacccagaagucccucagccugagccuggggaag

SEQ ID NO: 8202 - RNA, 651 nt, Artificial Sequence
  derived and/or modified sequence opt1 from Mavrilimumab_LightChain1
cagagcgugcugacccagcccccguccgucagcggcgcccccgggcagcgcgugaccaucuccugcacgggcagcggguccaacaucggcgcccccuacgacgugagcugguaccagcagcuccccgggaccgcgccgaagcugcugaucuaccacaacaacaagcggcccuccggcguccccgaccgcuucagcggcuccaagagcgggaccuccgccagccucgccaucaccggccugcaggccgaggacgaggccgacuacuacugcgcgacgguggaggccgggcuguccggcagcguguucgggggcggcaccaagcucaccguccuggggcagcccaaggccgccccguccgugacccuguucccgcccagcuccgaggagcuccaggcgaacaaggccacgcuggugugccugaucagcgacuucuaccccggcgccgucaccguggccuggaaggccgacuccagccccgugaaggcgggggucgagaccaccacgcccagcaagcaguccaacaacaaguacgccgccagcuccuaccucagccugacccccgagcaguggaagucccaccggagcuacuccugccaggugacccacgagggcagcaccguggagaagacggucgcccccaccgagugcucc

SEQ ID NO: 8203 - RNA, 1359 nt, Artificial Sequence
  derived and/or modified sequence opt1 from MDX-1303_HeavyChain1
caggugcagcuggucgagagcggcgggggcguggugcagcccgggcgcucccuccggcugagcugcgccgccuccggcuucaccuucagcuacuacgggaugcacuggguccgccaggcgccgggcaagggccuggaguggguggccgugaucuggcacgacgaguccaucgucuacuacgccgacagcgugaaggggcgguucaccaucucccgcgacaacagcaagaacacgcucuaccugcagaugaacucccugcgggccgaggacaccgccguguacuacugcacccgcgaccccggcgaccccuacuacuacuacuacgggcucgacgucuggggccaggggaccacggugaccgugagcuccgcgagcaccaagggccccuccgucuucccgcuggcccccagcuccaagagcaccuccggcgggacggccgcccugggcugccucgugaaggacuacuuccccgagcccgugaccgucagcuggaacuccggggcgcugaccagcggcgugcacaccuucccggccgugcugcagagcuccggccucuacagccuguccagcgucgugacggugcccuccagcucccuggggacccagaccuacaucugcaacgucaaccacaagcccagcaacaccaagguggacaagcggguggagcccaaguccugcgacaagacgcacacgugcccgcccugccccgcccccgagcuccugggcgggccgagcgucuuccuguucccgcccaagcccaaggacacccucaugaucucccgcacccccgaggugaccugcgucgugguggacgucagccacgaggaccccgaggugaaguucaacugguacguggacggcgucgaggugcacaacgccaagaccaagccccgggaggagcaguacaacuccaccuaccgcguggucagcgugcugaccgugcugcaccaggacuggcucaacgggaaggaguacaagugcaaggucuccaacaaggcccugcccgcgccgaucgagaagacgaucagcaaggccaagggccagccccgggagccccagguguacacccugcccccgucccgcgaggagaugaccaagaaccaggugagccugaccugccucgucaagggcuucuaccccuccgacaucgccguggagugggagagcaacgggcagcccgagaacaacuacaagacgaccccgcccgugcuggacagcgacggcuccuucuuccucuacagcaagcugaccgucgacaagucccgguggcagcaggggaacguguucagcugcuccgugaugcacgaggcccugcacaaccacuacacccagaagucccucagccugagccccggcaag

SEQ ID NO: 8204 - RNA, 645 nt, Artificial Sequence
  derived and/or modified sequence opt1 from MDX-1303_LightChain1
gagaucgugcugacccagagccccggcacccucucccugagcccgggggagcgcgccacgcuguccugccgggccagccaguccgucagcuccagcuaccucgcgugguaccagcagaagcccggccaggcgccccgccugcugaucuacggggccuccagccgggccaccggcauccccgaccgcuucuccgggagcggcuccggcaccgacuucacccucacgaucagccggcuggagccggaggacuucgccguguacuacugccagcaguacggguccagcauguacaccuucggccaggggaccaagcuggagaucaagcgcaccguggccgcccccuccgucuucaucuucccgcccagcgacgagcagcucaaguccggcacggccagcguggugugccugcugaacaacuucuacccccgggaggccaagguccaguggaagguggacaacgcgcuccagagcgggaacucccaggagagcgugaccgagcaggacuccaaggacagcaccuacucccugagcuccacccugacgcucagcaaggccgacuacgagaagcacaaggucuacgccugcgaggugacccaccagggccuguccagccccgugaccaaguccuucaaccgcggcgagugc

SEQ ID NO: 8205 - RNA, 1347 nt, Artificial Sequence
  derived and/or modified sequence opt1 from Mepolizumab_HeavyChain1
caggugacccugcgcgagagcggccccgcccucgucaagccgacccagacgcugacccugaccugcaccguguccggguucagccucacguccuacagcgugcacuggguccggcagccgcccggcaaggggcuggaguggcugggcgugaucugggccuccgggggcaccgacuacaacagcgcgcucaugucccgccugagcaucuccaaggacaccagccggaaccaggugguccugaccaugacgaacauggaccccguggacaccgccaccuacuacugcgcccgcgacccgcccuccagccuccugcggcuggacuacuggggccgcgggacccccgugacggucuccagcgccuccaccaagggccccagcguguucccgcucgcccccuccagcaaguccaccagcgggggcaccgcggcccuggggugccuggugaaggacuacuuccccgagcccgucacggugagcuggaacuccggcgcccucaccagcggcgugcacaccuuccccgccguccugcaguccagcgggcuguacucccucagcuccguggugaccguccccagcuccagccugggcacgcagaccuacaucugcaacgugaaccacaagcccuccaacaccaagguggacaagcgggucgagcccaagagcugcgacaagacccacacgugcccgcccugccccgcgcccgagcugcucgggggcccguccguguuccuguucccgcccaagcccaaggacacccugaugaucagccgcacccccgaggugaccugcgucguggucgacgugucccacgaggaccccgaggugaaguucaacugguacgucgacggcguggaggugcacaacgccaagacgaagccccgggaggagcaguacaacagcaccuaccgcgucguguccgugcucaccguccugcaccaggacuggcugaacgggaaggaguacaagugcaaggugagcaacaaggcccuccccgccccgaucgagaagaccaucuccaaggccaagggccagccccgggagccccagguguacacgcugccgcccagccgcgaggagaugaccaagaaccaggucagccugaccugccucgugaagggguucuaccccuccgacaucgcgguggagugggagagcaacggccagcccgagaacaacuacaagaccacgccgcccguccuggacuccgacgggagcuucuuccuguacuccaagcucaccguggacaagagccgguggcagcagggcaacguguucuccugcagcgucaugcacgaggcccugcacaaccacuacacccagaagucccugagccucucccccggcaag

SEQ ID NO: 8206 - RNA, 660 nt, Artificial Sequence
  derived and/or modified sequence opt1 from Mepolizumab_LightChain1
gacaucgugaugacccagagccccgacucccuggccgucagccucggcgagcgcgccaccaucaacugcaaguccagccagucccugcugaacagcgggaaccagaagaacuaccucgcgugguaccagcagaagccgggccagccgcccaagcugcugaucuacggggccuccacgcgggagagcggcgugcccgaccgcuucuccgggagcggcuccggcaccgacuucacccucaccaucagcucccugcaggccgaggacguggccgucuacuacugccagaacgugcacagcuuccccuucacguucgggggcgggaccaagcuggagaucaagcggaccguggccgcgcccuccgucuucaucuucccgcccagcgacgagcagcucaaguccggcaccgccagcguggugugccugcugaacaacuucuacccccgcgaggccaagguccaguggaagguggacaacgcccuccaguccgggaacagccaggagagcgugacggagcaggacuccaaggacagcaccuacucccugagcuccacccugacccucagcaaggcggacuacgagaagcacaaggucuacgccugcgaggugacgcaccagggccuguccagccccgugaccaaguccuucaaccggggcgagugc

SEQ ID NO: 8207 - RNA, 1350 nt, Artificial Sequence
  derived and/or modified sequence opt1 from Metelimumab_HeavyChain1
gaggugcagcuggucgagagcggcgggggcguggugcagcccgggcgcucccuccggcugagcugcgccgccuccggcuucaccuucagcuccuacgggaugcacuggguccgccaggcgccgggcaaggagcuggaguggguggccgugaucagcuacgacggcuccaucaaguacuacgccgacagcgucaaggggcgguucaccaucucccgcgacaacagcaagaacacccucuaccugcagaugaacucccugcgggccgaggacaccgccguguacuacugcgcgcgcaccggcgaguacagcggguacgacaccgacccccaguacuccuggggccaggggacgaccgugaccgucagcuccgccagcaccaagggccccuccguguucccccucgccccgugcagccgguccacgagcgagagcaccgccgcgcugggcugccuggugaaggacuacuuccccgagcccgucaccguguccuggaacagcggggcccucaccuccggcgugcacacguuccccgccguccugcagagcuccgggcuguacagccucuccagcguggugaccgucccguccagcucccugggcaccaagaccuacacgugcaacguggaccacaagcccagcaacaccaagguggacaagcgcgucgaguccaaguacggcccgcccugccccagcugccccgcccccgaguuccucgggggccccuccguguuccuguucccgcccaagcccaagcccacccugaugaucagccggaccccggaggugacgugcgucguggucgacgugucccaggaggaccccgaggugcaguucaacugguacgucgacgggguggaggugcacaacgccaagaccaagccccgcgaggagcaguucaacagcaccuaccgggucguguccgugcugaccguccuccaccaggacuggcugaacggcaaggaguacaagugcaaggugagcaacaaggggcugcccagcuccaucgagaagacgaucagcaaggcgaagggccagccgcgcgagccccagguguacacccucccgcccucccaggaggagaugaccaagaaccaggucagccugaccugccuggugaagggcuucuaccccuccgacaucgccguggagugggagagcaacgggcagcccgagaacaacuacaagacgacgcccccgguccucgacuccgacggcagcuucuuccuguacucccggcugaccguggacaagagccgcuggcaggaggggaacguguucuccugcagcgucaugcacgaggcccuccacaaccacuacacccagaagucccugagccugucccucggcaag

SEQ ID NO: 8208 - RNA, 639 nt, Artificial Sequence
  derived and/or modified sequence opt1 from Metelimumab_LightChain1
gagaucgugcugacccagagccccuccagccucuccgccagcgucggcgaccgcgugaccaucacgugccgggccucccaggggaucggcgacgaccuggggugguaccagcagaagccgggcaaggcgcccauccugcucaucuacgggaccagcacccugcaguccggcgugcccagccgcuucuccggcagcggguccggcaccgacuucacgcugaccaucaacagccuccagcccgaggacuucgccaccuacuacugccugcaggacuccaacuacccgcugaccuucgggggcgggacgcggcucgagaucaagcgcaccgucgccgcccccagcguguucaucuucccgcccuccgacgagcagcucaagagcggcaccgccuccguggucugccugcugaacaacuucuacccccgggaggcgaaggugcaguggaagguggacaacgcccugcagagcggcaacucccaggagagcgucaccgagcaggacagcaaggacuccacguacagccuguccagcacccucacccuguccaaggccgacuacgagaagcacaagguguacgccugcgaggugacccaccaggggcugagccccgucacgaaguccuucaaccgcggcgagugc

SEQ ID NO: 8209 - RNA, 1350 nt, Artificial Sequence
  derived and/or modified sequence opt1 from Milatuzumab_HeavyChain1
caggugcagcugcagcagagcggcuccgagcucaagaagcccggggccagcgucaagguguccugcaaggccagcggcuacaccuucaccaacuacggggugaacuggaucaagcaggcgccgggccaggggcugcaguggaugggcuggaucaaccccaacacgggcgagcccaccuucgacgacgacuucaaggggcgcuucgccuucucccuggacaccagcgucuccaccgccuaccuccagaucagcucccugaaggccgacgacacggccguguacuucugcagccggucccgcggcaagaacgaggcgugguucgccuacugggggcagggcacccuggugaccgucagcuccgccagcaccaaggggcccuccguguucccgcucgcccccagcuccaagagcacguccggcggcaccgcggcccuggggugccuggugaaggacuacuuccccgagcccgucaccgugagcuggaacagcggcgcccucaccuccggggugcacacguucccggccguccugcagagcuccggccuguacagccucuccagcguggugaccguccccuccagcucccugggcacccagaccuacaucugcaacgugaaccacaagcccagcaacacgaagguggacaagcgggucgagcccaaguccugcgacaagacccacacgugcccgcccugccccgcccccgagcugcucgggggcccgagcguguuccuguucccgcccaagcccaaggacacccugaugaucucccgcacccccgaggugaccugcgucgugguggacgucagccacgaggaccccgaggugaaguucaacugguacgucgacgggguggaggugcacaacgcgaagaccaagccccgggaggagcaguacaacuccaccuaccgcgucgugagcgugcucacgguccugcaccaggacuggcugaacggcaaggaguacaagugcaagguguccaacaaggcccuccccgccccgaucgagaagaccaucagcaaggccaaggggcagccccgggagccccagguguacacccugcccccgucccgcgaggagaugaccaagaaccaggucagccugacgugccucgugaagggcuucuaccccagcgacaucgccguggagugggaguccaacggccagcccgagaacaacuacaagaccaccccgcccguccuggacagcgacggguccuucuuccuguacagcaagcucaccguggacaagucccgguggcagcagggcaacguguucagcugcuccgucaugcacgaggcgcugcacaaccacuacacgcagaagucccugagccucagccccgggaag

SEQ ID NO: 8210 - RNA, 657 nt, Artificial Sequence
  derived and/or modified sequence opt1 from Milatuzumab_LightChain1
gacauccagcugacccagagcccccucucccugcccgugacccugggccagcccgccagcaucuccugccgcagcucccagagccucguccaccggaacgggaacacguaccugcacugguuccagcagcgccccggccagagcccccggcugcucaucuacaccguguccaaccgcuucuccggggugccggaccgguucagcggcuccgggagcggcaccgacuucacccugaagaucucccgcgucgaggccgaggacgugggcguguacuucugcagccaguccagccacgucccgcccacguucggggcgggcacccggcuggagaucaagcgcaccguggccgcccccuccguguucaucuucccgcccagcgacgagcagcucaaguccgggaccgccagcgucgugugccugcugaacaacuucuacccccgggaggccaaggugcaguggaaggucgacaacgcgcuccagagcggcaacucccaggagagcgugacggagcaggacuccaaggacagcaccuacucccugagcuccacccugacccucagcaaggccgacuacgagaagcacaagguguacgccugcgaggucacgcaccaggggcuguccagccccgugaccaaguccuucaaccgcggcgagugc

SEQ ID NO: 8211 - RNA, 1341 nt, Artificial Sequence
  derived and/or modified sequence opt1 from Mirvetuximab_HeavyChain1
caggugcagcugguccagagcggcgccgagguggugaagcccggggccuccgucaagaucagcugcaaggcguccggcuacaccuucaccggguacuucaugaacugggugaagcagagcccgggccagucccucgaguggaucgggcgcauccaccccuacgacggcgacacguucuacaaccagaaguuccagggcaaggccacccugaccguggacaagagcuccaacaccgcccacauggagcugcucagccugacguccgaggacuucgccgucuacuacugcacccgguacgacgggagccgcgccauggacuacuggggccaggggaccaccgugacgguguccagcgcguccaccaagggccccagcgucuucccccuggccccguccagcaaguccaccagcgggggcaccgccgcccucggcugccuggugaaggacuacuuccccgagcccgugacggucuccuggaacagcggggcgcugaccagcggcgugcacaccuuccccgccgugcuccaguccagcgggcuguacucccugagcuccgucgugaccgugccgagcuccagccucggcacgcagaccuacaucugcaacgucaaccacaagcccuccaacaccaagguggacaagaagguggagcccaagagcugcgacaagacccacacgugcccgcccugccccgcccccgagcugcugggcgggcccuccgucuuccucuucccgcccaagcccaaggacacccugaugaucagccggacccccgaggugaccugcguggucguggacgucucccacgaggacccggaggugaaguucaacugguacguggacggcgucgaggugcacaacgccaagacgaagccccgcgaggagcaguacaacagcaccuaccggguggucuccgugcugaccgugcuccaccaggacuggcugaacgggaaggaguacaagugcaaggucagcaacaaggcccugcccgcgcccaucgagaagaccaucuccaaggccaagggccagccgcgcgagccccagguguacacgcucccgcccagccgggacgagcugaccaagaaccaggugucccugaccugccucgucaagggguucuaccccagcgacaucgccguggagugggagagcaacggccagcccgagaacaacuacaagaccacgcccccggugcuggacuccgacggcagcuucuuccuguacuccaagcucaccgucgacaagagccgcuggcagcaggggaacguguucuccugcagcgugaugcacgaggcccugcacaaccacuacacccagaagucccugagccucucccccggc

SEQ ID NO: 8212 - RNA, 654 nt, Artificial Sequence
  derived and/or modified sequence opt1 from Mirvetuximab_LightChain1
gacaucgugcugacccagagcccccucucccuggccgucagccugggccagccggccaucaucuccugcaaggcgagccaguccgugagcuucgccgggaccucccucaugcacugguaccaccagaagcccggccagcagccccgccugcugaucuaccgggccagcaaccucgaggccggggugcccgaccgcuucuccggcagcggguccaagacggacuucacccugaccaucagcccggucgaggccgaggacgcggccaccuacuacugccagcagucccgggaguaccccuacacguucggcggcgggaccaagcuggagaucaagcgcaccguggccgcccccagcguguucaucuucccgcccuccgacgagcagcucaagagcggcaccgcguccgucgugugccugcugaacaacuucuacccccgggaggccaaggugcaguggaaggucgacaacgcccuccagagcgggaacucccaggagagcgugacggagcaggacagcaaggacuccaccuacagccuguccagcacccugacccucuccaaggccgacuacgagaagcacaagguguacgccugcgaggucacgcaccagggccugagcucccccgugaccaagagcuucaaccgcggggagugc

SEQ ID NO: 8213 - RNA, 1344 nt, Artificial Sequence
  derived and/or modified sequence opt1 from Modotuximab_HeavyChain1
caggugcagcugcagcagcccggcgccgagcucgucgagcccgggggcagcgugaagcuguccugcaaggccagcggguacaccuucaccucccacuggaugcacugggugaagcagcgccccggccaggggcuggaguggaucggcgagaucaaccccagcuccggccggaacaacuacaacgagaaguucaagagcaaggcgacgcucaccgucgacaaguccagcuccaccgccuacaugcaguucagcucccugaccagcgaggacuccgccguguacuacugcgugcgcuacuacggguacgacgaggccauggacuacuggggccaggggacgagcgucaccguguccagcgccuccaccaagggccccagcguguucccgcuggcgcccuccagcaagagcaccuccgggggcacggccgcccucggcugccuggucaaggacuacuuccccgagcccgugaccgugagcuggaacuccggggcccugaccagcggcguccacaccuucccggcggugcuccaguccagcgggcuguacucccugagcuccguggucacggugcccagcuccagccucggcacccagaccuacaucugcaacgugaaccacaagcccuccaacaccaaggucgacaagcggguggagcccaagagcugcgacaagacgcacacgugcccgcccugccccgcccccgagcugcugggcgggccguccguguuccucuucccgcccaagcccaaggacacccugaugaucagccgcaccccggaggugaccugcgucguggucgacgugucccacgaggaccccgaggucaaguucaacugguacguggacggcguggagguccacaacgccaagaccaagccccgggaggagcaguacaacagcaccuaccgcgugguguccguccugaccgugcuccaccaggacuggcugaacgggaaggaguacaagugcaaggugagcaacaaggcccugcccgccccgaucgagaagacgaucagcaaggcgaagggccagccccgggagccccaggucuacacccucccgcccucccgcgaggagaugaccaagaaccaggugagccugaccugccuggugaagggguucuaccccuccgacaucgccgucgagugggagagcaacggccagcccgagaacaacuacaagacgaccccgcccgugcucgacuccgacggcagcuucuuccuguacuccaagcugaccguggacaagagccgguggcagcaggggaacgucuucuccugcagcgugaugcacgaggcccuccacaaccacuacacccagaagucccugagccugucccccggc

SEQ ID NO: 8214 - RNA, 657 nt, Artificial Sequence
  derived and/or modified sequence opt1 from Modotuximab_LightChain1
gacaucgugaugacccaggccgccuucagcaaccccgucacccugggcacguccgcgagcaucuccugccgcagcuccaagagccuccugcacuccaacgggaucaccuaccuguacugguaccuccagaagccgggccagagcccccagcugcugaucuaccagauguccaaccucgccagcggggugcccgaccgguucuccagcuccggcagcgggaccgacuucacccugcgcaucucccggguggaggccgaggacgucggcguguacuacugcgcccagaaccuggagcuccccuacacguucggcgggggcaccaagcuggagaucaagcgcaccguggccgcgccgagcgucuucaucuucccgcccuccgacgagcagcucaagagcgggaccgccuccguggugugccugcugaacaacuucuacccccgggaggccaagguccaguggaagguggacaacgcccugcagagcggcaacagccaggaguccgugacggagcaggacagcaaggacuccaccuacagccucuccagcacccugacccuguccaaggcggacuacgagaagcacaaggucuacgccugcgaggugacgcaccaggggcucagcucccccgugaccaagagcuucaaccgcggcgagugc

SEQ ID NO: 8215 - RNA, 1347 nt, Artificial Sequence
  derived and/or modified sequence opt1 from Mogamulizumab_HeavyChain1
gaggugcagcuggucgagagcggcggggaccucgugcagcccggccgcucccugcggcugagcugcgccgccuccggguucaucuucagcaacuacggcauguccugggugcgccaggcgccggggaagggccucgagugggucgccaccaucagcuccgccagcaccuacuccuacuaccccgacagcgugaagggccgguucacgaucucccgcgacaacgccaagaacagccuguaccugcagaugaacucccuccggguggaggacaccgcccuguacuacugcgggcgccacagcgacggcaacuucgcguucggguacuggggccaggggacccuggucaccguguccagcgccuccacgaagggccccagcguguucccccucgccccguccagcaagagcaccuccggcgggaccgccgcgcugggcugccuggucaaggacuacuuccccgagcccgugaccgugagcuggaacuccggggcccucacgagcggcguccacaccuuccccgccgugcugcaguccagcggccuguacucccucagcuccguggucaccgugccgagcuccagccuggggacccagacguacaucugcaacgugaaccacaagcccuccaacaccaaggucgacaagaagguggagcccaagagcugcgacaagacccacacgugcccgcccugccccgcccccgagcugcucggcgggcccuccguguuccuguucccgcccaagcccaaggacacccugaugaucagccggacccccgaggugaccugcgucguggucgacgugucccacgaggacccggaggucaaguucaacugguacguggacggcguggagguccacaacgccaagaccaagccccgcgaggagcaguacaacagcacguaccgggugguguccguccucaccgugcugcaccaggacuggcugaacgggaaggaguacaagugcaaggugagcaacaaggcgcuccccgcccccaucgagaagaccaucagcaaggccaagggccagccgcgcgagccccaggucuacacccugccgcccucccgggacgagcugacgaagaaccaggugagccugaccugccucgugaagggcuucuaccccuccgacaucgccgucgagugggagagcaacgggcagcccgagaacaacuacaagaccacgcccccggugcuggacuccgacggcagcuucuuccucuacuccaagcugaccguggacaagagccgcuggcagcaggggaacgucuucuccugcagcgugaugcacgaggcccugcacaaccacuacacccagaagucccucagccugucccccggcaag

SEQ ID NO: 8216 - RNA, 657 nt, Artificial Sequence
  derived and/or modified sequence opt1 from Mogamulizumab_LightChain1
gacgugcugaugacgcagagcccccucucccugccggucacccccggcgagcccgccagcaucuccugccgcagcucccggaacaucgugcacaucaacggggacacguaccuggagugguaccuccagaagcccggccagagcccgcagcugcugaucuacaagguguccaaccgcuucagcgggguccccgaccgguucuccggcagcggguccggcaccgacuucacccucaagaucagccgcguggaggccgaggacgugggcgucuacuacugcuuccaggggucccugcugcccuggaccuucggccaggggacgaagguggagaucaagcggaccguggcggcccccagcgucuucaucuucccgcccuccgacgagcagcucaagagcggcaccgccuccguggugugccugcugaacaacuucuacccccgcgaggccaagguccaguggaagguggacaacgcccuccagagcgggaacucccaggagagcgugaccgagcaggacagcaaggacuccacguacagccuguccagcacccugacccucuccaaggcggacuacgagaagcacaaggucuacgccugcgaggugacccaccagggccugagcucccccgugaccaagagcuucaaccggggcgagugc

SEQ ID NO: 8217 - RNA, 1356 nt, Artificial Sequence
  derived and/or modified sequence opt1 from Monalizumab_HeavyChain1
caggugcagcugguccagagcggcgccgaggugaagaagcccggggccuccgugaaggucagcugcaaggcguccggcuacaccuucaccagcuacuggaugaacugggugcgccaggcccccgggcagggccucgaguggauggggcggaucgaccccuacgacuccgagacgcacuacgcccagaagcugcagggccgcgugaccaugaccaccgacacgagcaccuccaccgccuacauggagcugcggagccuccgcuccgacgacaccgccgucuacuacugcgcgcggggcggguacgacuucgacgugggcacgcuguacugguucuucgacgugugggggcagggcaccaccgucaccgugagcuccgccagcacgaaggggcccuccguguucccccuggccccgugcagccgcuccaccagcgaguccaccgccgcgcucggcugccuggucaaggacuacuuccccgagcccgugaccgugagcuggaacuccggcgcccugacgagcgggguccacaccuuccccgccgugcuccagagcuccggccuguacagccuguccagcguggucaccgugccguccagcucccucgggaccaagacguacacgugcaacguggaccacaagcccagcaacaccaaggucgacaagcggguggaguccaaguacggcccgcccugcccgcccugccccgcccccgaguuccugggcgggccgagcguguuccuguucccgcccaagcccaaggacacccucaugaucucccgcacccccgaggugaccugcgucgucguggacgugagccaggaggaccccgagguccaguucaacugguacguggacggcguggagguccacaacgccaagaccaagccccgggaggagcaguucaacuccaccuaccgcguggugagcguccugacggugcugcaccaggacuggcucaacgggaaggaguacaagugcaagguguccaacaagggccugcccagcuccaucgagaagaccaucagcaaggcgaaggggcagccgcgggagccccaggucuacacccugccgcccucccaggaggagaugaccaagaaccaggugagccucacgugccuggugaagggcuucuaccccagcgacaucgccgucgagugggaguccaacggccagcccgagaacaacuacaagaccaccccgcccgugcuggacagcgacggguccuucuuccucuacagccgccugaccguggacaagucccgguggcaggagggcaacgucuucagcugcuccgugaugcacgaggcccugcacaaccacuacacgcagaagucccucagccugagccuggggaag

SEQ ID NO: 8218 - RNA, 642 nt, Artificial Sequence
  derived and/or modified sequence opt1 from Monalizumab_LightChain1
gacauccagaugacccagagccccuccagccuguccgccagcgugggcgaccgcgucaccaucacgugccgggccuccgagaacaucuacagcuaccucgcgugguaccagcagaagccggggaaggcccccaagcugcugaucuacaacgccaagacccucgccgagggcgugcccucccgcuucagcggguccggcagcgggaccgacuucacccugacgaucuccagccugcagcccgaggacuucgccaccuacuacugccagcaccacuacggcaccccgcggaccuucggcgggggcacgaagguggagaucaagcgcaccgucgcggcccccuccguguucaucuucccgcccagcgacgagcagcucaaguccgggaccgccagcguggucugccugcugaacaacuucuacccccgggaggccaaggugcaguggaagguggacaacgcgcuccaguccggcaacagccaggaguccgucaccgagcaggacagcaaggacagcacguacucccugagcuccacccugacccucagcaaggccgacuacgagaagcacaagguguacgccugcgaggugacccaccaggggcuguccagccccgucacgaaguccuucaaccgcggcgagugc

SEQ ID NO: 8219 - RNA, 1350 nt, Artificial Sequence
  derived and/or modified sequence opt1 from Motavizumab_HeavyChain
caggugacccugcgcgagagcggccccgcccucgucaagccgacccagacgcugacccugaccugcaccuucuccggguucagccucuccacggccggcaugagcgugggguggauccggcagccgcccggcaaggcgcuggaguggcuggccgacaucuggugggacgacaagaagcacuacaaccccucccucaaggaccgccugaccaucagcaaggacaccuccaagaaccaggugguccugaaggugaccaacauggaccccgccgacacggccaccuacuacugcgcccgggacaugaucuucaacuucuacuucgacgugugggggcagggcaccaccgucacggugagcuccgcgagcaccaagggccccuccguguucccccucgcccccagcuccaagagcaccuccgggggcaccgccgcccuggggugccuggucaaggacuacuucccggagcccgugacggugagcuggaacuccggcgcgcucaccagcgggguccacaccuuccccgccgugcugcaguccagcggccuguacagccucuccagcguggucaccgugcccuccagcucccugggcacgcagaccuacaucugcaacgugaaccacaagccgagcaacaccaaggucgacaagcgcguggagcccaaguccugcgacaagacccacacgugcccgcccugccccgcccccgagcugcucgggggccccagcguguuccuguucccgcccaagcccaaggacacccugaugaucucccggacccccgaggugaccugcgucguggucgacgugagccacgaggaccccgaggucaaguucaacugguacguggacgggguggagguccacaacgccaagacgaagccgcgcgaggagcaguacaacuccaccuaccggguggugagcguccucaccgugcugcaccaggacuggcugaacggcaaggaguacaagugcaagguguccaacaaggcccuccccgcgcccaucgagaagaccaucagcaaggccaagggccagccccgcgagccgcaggucuacacgcugccgcccucccgggaggagaugaccaagaaccaggugagccugaccugccucgugaagggguucuaccccuccgacaucgccgucgagugggagagcaacggccagcccgagaacaacuacaagaccacgccgcccgugcuggacuccgacgggagcuucuuccuguacagcaagcucaccguggacaagucccgcuggcagcagggcaacgucuucagcugcuccgugaugcacgaggcccugcacaaccacuacacccagaagucccugagccucagccccgggaag

SEQ ID NO: 8220 - RNA, 1350 nt, Artificial Sequence; identical to SEQ ID NO: 8219
  derived and/or modified sequence opt1 from Motavizumab_HeavyChain_variant

SEQ ID NO: 8221 - RNA, 639 nt, Artificial Sequence
  derived and/or modified sequence opt1 from Motavizumab_LightChain
gacauccagaugacccagagccccuccacccugagcgccuccgugggcgaccgggucacgaucacgugcagcgccuccagccgggugggguacaugcacugguaccagcagaagccgggcaaggcgcccaagcuccugaucuacgacaccuccaagcuggccagcggggugcccucccgcuucagcggcuccgggagcggcaccgaguucacgcucaccaucuccagccugcagcccgacgacuucgccaccuacuacugcuuccagggcuccggguacccguucaccuucggcgggggcacgaaggucgagaucaagcggaccguggccgcccccagcguguucaucuucccgcccuccgacgagcagcucaagagcgggaccgcguccgucgugugccugcugaacaacuucuacccccgcgaggccaaggugcaguggaaggucgacaacgcccugcagagcggcaacagccaggaguccgugaccgagcaggacagcaaggacuccacguacagccucuccagcacccugacccuguccaaggccgacuacgagaagcacaagguguacgcgugcgaggucacccaccagggccucagcucccccgugaccaagagcuucaaccgcggggagugc

SEQ ID NO: 8222 - RNA, 639 nt, Artificial Sequence; identical to SEQ ID NO: 8221
  derived and/or modified sequence opt1 from Motavizumab_LightChain_variant

SEQ ID NO: 8223 - RNA, 1428 nt, Artificial Sequence
  derived and/or modified sequence opt1 from Moxetumomab_pasudotox_HeavyChain1
auggaggugcagcuggucgagagcggcgggggccucgugaagcccgggggcucccugaagcugagcugcgccgccuccggguucgcguucagcaucuacgacauguccugggugcgccagacccccgagaagugccucgagugggucgccuacaucagcuccggcggcgggaccacguacuaccccgacaccgugaagggccgguucaccaucagccgcgacaacgccaagaacacccuguaccugcagauguccagccucaaguccgaggacacggccauguacuacugcgcccggcacagcggguacggcacccacuggggcgugcuguucgcguacugggggcagggcacccuggucaccguguccgccaaggccagcgggggccccgagggcgggucccucgccgcgcugacggcccaccaggccugccaccucccccuggagaccuucacccgccaccggcagccgcgcggcugggagcagcuggagcagugcggguaccccgugcagcggcuggucgcccucuaccuggccgcgcgccugagcuggaaccagguggaccaggugauccggaacgcccucgccucccccggcagcgggggcgaccugggggaggccauccgcgagcagcccgagcaggcccggcuggcgcucacccuggccgccgccgaguccgagcgcuucguccggcagggcacgggcaacgacgaggccggggcggccaacggcccggccgacagcggggacgcccugcucgagcgcaacuaccccaccggcgccgaguuccugggggacggcggcgacgugagcuucuccacccgggggacccagaacuggacgguggagcgccugcuccaggcgcaccggcagcuggaggagcgcggcuacgucuucgugggguaccacggcaccuuccuggaggccgcccagagcaucguguucgggggcguccgggcccgcucccaggaccucgacgcgaucuggcggggcuucuacaucgccggggaccccgcccuggccuacggcuacgcccaggaccaggagcccgacgcgcgcgggcgcauccggaacggcgcccugcuccgcguguacgugccgcggagcucccugcccggcuucuaccgcaccagccugacccucgccgcccccgaggccgcgggggaggucgagcggcugaucggccacccccugccgcuccgccuggacgccaucacggggcccgaggaggagggcgggcggcuggagaccauccucggcuggccccuggccgagcgcaccguggugauccccuccgccaucccgaccgacccccggaacgucggcggggaccuggaccccagcuccauccccgacaaggagcaggccaucagcgcgcucccggacuacgccucccagcccggcaagccgccccgcgaggaccugaag

SEQ ID NO: 8224 - RNA, 324 nt, Artificial Sequence
  derived and/or modified sequence opt1 from Moxetumomab_pasudotox_LightChain1
auggacauccagaugacccagaccacgagcucccugagcgccucccucggcgaccgcgugaccaucagcugccgggccucccaggacaucagcaacuaccugaacugguaccagcagaagcccgacgggaccgucaagcugcucaucuacuacaccuccauccugcacagcggcgugccgucccgcuucagcggguccggcagcgggacggacuacucccugaccaucagcaaccucgagcaggaggacuucgcgaccuacuucugccagcagggcaacacccugcccuggacguucggcugcgggaccaagcuggagaucaag

SEQ ID NO: 8225 - RNA, 1350 nt, Artificial Sequence
  derived and/or modified sequence opt1 from Muromonab-CD3_HeavyChain
caggugcagcugcagcagagcggcgccgagcucgcccgccccggggcguccgucaagaugagcugcaaggccuccggcuacaccuucacccgguacacgaugcacugggugaagcagcgcccggggcagggccuggaguggaucggguacaucaaccccagccggggcuacaccaacuacaaccagaaguucaaggacaaggccacccugaccacggacaaguccagcuccaccgccuacaugcagcucagcucccugaccagcgaggacuccgccguguacuacugcgcgcgcuacuacgacgaccacuacugccuggacuacuggggccaggggaccacgcucaccgucagcuccgccaagaccaccgcccccagcguguacccccuggccccggugugcggcgggacgaccggcuccagcgucacccuggggugccucgugaagggcuacuuccccgagcccgugacccugacguggaacuccggcagccuguccagcgggguccacaccuuccccgcggugcuccagagcgaccuguacacccuguccagcuccgugaccgucacgagcuccaccuggccgagccaguccaucacgugcaacguggcccaccccgccagcuccaccaagguggacaagaagaucgagccccggcccaagagcugcgacaagacccacacgugcccgcccugccccgcccccgagcuccugggcgggccguccgucuuccuguucccgcccaagcccaaggacacccucaugaucagccgcacccccgaggugaccugcguggucguggacgugucccacgaggaccccgaggucaaguucaacugguacguggacggcguggagguccacaacgccaagaccaagccccgggaggagcaguacaacagcaccuaccgcguggucuccgugcugaccgugcugcaccaggacuggcucaacggcaaggaguacaagugcaaggucagcaacaaggcgcugcccgccccgaucgagaagacgaucuccaaggccaaggggcagccccgggagccccagguguacacccugcccccgagccgcgacgagcucaccaagaaccaggugucccugaccugccuggucaagggcuucuaccccagcgacaucgccguggagugggagagcaacgggcagcccgagaacaacuacaagacgaccccgcccgugcucgacuccgacggcagcuucuuccuguacuccaagcugaccgucgacaagagccgguggcagcaggggaacguguucuccugcagcgugaugcacgaggcccuccacaaccacuacacccagaagucccugagccugucccccggcaag

SEQ ID NO: 8226 - RNA, 639 nt, Artificial Sequence
  derived and/or modified sequence opt1 from Muromonab-CD3_LightChain
cagaucgugcugacccagagccccgccaucauguccgccagcccgggcgagaaggugaccaugacgugcuccgcgagcuccagcguguccuacaugaacugguaccagcagaaguccgggaccagccccaagcgcuggaucuacgacaccagcaagcucgccuccggcgugcccgcccacuuccgggggagcggcuccgggaccagcuacucccugacgaucagcggcauggaggccgaggacgccgcgaccuacuacugccagcagugguccagcaaccccuucaccuucggcuccgggaccaagcuggagaucaaccgcgccgacacggccccgaccgucagcaucuucccgcccagcuccgagcagcucaccagcggcggggccuccguggugugcuuccugaacaacuucuaccccaaggacaucaacgucaaguggaagaucgacggcagcgagcggcagaacggggugcugaacuccuggaccgaccaggacagcaaggacuccacguacagcauguccagcacccucacccugaccaaggacgaguacgagcgccacaacuccuacacgugcgaggcgacccacaagaccagcaccucccccaucgucaagagcuucaaccggaacgagugc

SEQ ID NO: 8227 - RNA, 1347 nt, Artificial Sequence
  derived and/or modified sequence opt1 from Namilumab_HeavyChain1
caggugcagcugguccagagcggcgccgaggugaagaagcccggggccuccgugaaggucagcugcaaggcguucggcuacccguucaccgacuaccuccugcacugggugcgccaggcccccgggcagggccuggagugggugggguggcucaaccccuacuccggcgacaccaacuacgcccagaaguuccagggccgggucacgaugacccgcgacaccagcaucuccaccgccuacauggagcugagccggcugcgcuccgacgacacggccguguacuacugcacccggaccacccucaucagcguguacuucgacuacugggggcagggcacgauggucaccguguccagcgcguccaccaaggggcccagcguguucccgcuggcccccuccagcaaguccaccagcggcgggacggccgcccugggcugccucgucaaggacuacuuccccgagcccgugaccguguccuggaacagcggcgcgcugaccuccgggguccacaccuucccggccgugcugcagagcagcggccucuacucccugagcuccguggucacggugcccagcuccagccuggggacccagaccuacaucugcaacgugaaccacaagcccuccaacaccaaggucgacaagaagguggagcccaagagcugcgacaagacgcacacgugcccgcccugccccgcccccgagcuccugggcggcccguccguguuccuguucccgcccaagcccaaggacacccucaugaucagccgcacccccgaggugaccugcgucgucguggacgugucccacgaggaccccgaggucaaguucaacugguacguggacgggguggagguccacaacgccaagaccaagccccgggaggagcaguacaacagcaccuaccgcgugguguccguccugaccgugcugcaccaggacuggcucaacggcaaggaguacaagugcaaggugagcaacaaggcccugcccgcgccgaucgagaagacgaucuccaaggccaaggggcagccccgggagccccaggucuacacccugcccccgagccgcgacgagcucaccaagaaccaggugucccugaccugccuggugaagggcuucuaccccagcgacaucgccgucgagugggaguccaacgggcagcccgagaacaacuacaagacgaccccgcccgugcucgacagcgacggcagcuucuuccuguacuccaagcugaccguggacaagagccgguggcagcagggcaacgucuucuccugcagcgugaugcacgaggcccuccacaaccacuacacccagaagucccugagccugucccccgggaag

SEQ ID NO: 8228 - RNA, 642 nt, Artificial Sequence
  derived and/or modified sequence opt1 from Namilumab_LightChain1
gacauccagaugacccagagccccuccagcguguccgccagcgucggcgaccgcgugaccaucgccugccgggcgucccagaacauccgcaacauccugaacugguaccagcagcggccggggaaggcgccccagcuccugaucuacgccgccagcaaccugcaguccggcgugcccagccgcuucuccgggagcggcuccgggacggacuucacccucaccaucaacagccugcagcccgaggacuucgccaccuacuacugccagcaguccuacagcaugccgcggacguucggcggcgggaccaagcuggagaucaagcgcaccgucgccgcccccuccguguucaucuucccgcccagcgacgagcagcucaaguccggcaccgccagcguggucugccugcugaacaacuucuacccccgggaggccaaggugcaguggaagguggacaacgcgcuccaguccgggaacagccaggagagcgucacggagcaggacuccaaggacagcaccuacucccugagcuccacccugacccucagcaaggccgacuacgagaagcacaagguguacgccugcgaggugacgcaccagggccuguccagccccgucaccaaguccuucaaccgcggggagugc

SEQ ID NO: 8229 - RNA, 1374 nt, Artificial Sequence
  derived and/or modified sequence opt1 from Naptumomab_estafenatox_HeavyChain
gaggugcagcugcagcagagcggccccgaccucgucaagccgggggccuccgugaagaucagcugcaaggccuccggcuacagcuucaccggguacuacaugcacugggugaagcagucccccggcaaggggcuggaguggaucggccgcaucaaccccaacaacggcgucacccuguacaaccagaaguucaaggacaaggcgacgcucaccguggacaagagcuccaccaccgccuacauggagcugcggagccugacguccgaggacagcgccguguacuacugcgcccgcuccaccaugaucaccaacuacgucauggacuacugggggcagggcaccagcgugacgguguccagcgccaagaccacgcccccguccgucuacccccucgcgcccgggagcgccgcccagaccaacuccauggugacccugggcugccuggugaagggguacuuccccgagccggucaccgugaccuggaacagcggcucccucagcagcggcgugcacaccuuccccgccguccugcaguccgaccuguacacgcucagcuccagcgugaccgugcccuccagcaccuggcccuccgagaccgucacgugcaacguggcgcacccggccagcuccaccaagguggacaagaagaucgucccccgggacagcgggggccccuccgagaaguccgaggagaucaacgagaaggaccugcgcaagaaguccgagcugcaggggaccgcccucggcaaccugaagcagaucuacuacuacaacagcaaggccaucaccagcagcgagaaguccgccgaccaguuccugacgaacacccuccuguucaagggcuucuucaccgggcaccccugguacaacgaccugcucguggaccugggcagcaccgcggccacguccgaguacgaggggagcagcguggaccuguacggcgccuacuacggguaccagugcgccggcggcaccccgaacaagaccgccugcauguacgggggcgucacccuccacgacaacaaccggcugacggaggagaagaaggugcccaucaaccuguggaucgacgggaagcagaccaccguccccaucgacaaggugaagaccuccaagaaggaggugacgguccaggagcucgaccugcaggcgcgccacuaccugcacggcaaguucgggcucuacaacagcgacuccuucggcggcaaggugcagcgggggcugaucguguuccacagcuccgagggcagcaccgucuccuacgaccuguucgacgcccaggggcaguaccccgacacccuccugcgcaucuaccgggacaacaccaccaucagcuccacgagccuguccaucagccucuaccuguacaccacc

SEQ ID NO: 8230 - RNA, 642 nt, Artificial Sequence
  derived and/or modified sequence opt1 from Naptumomab_estafenatox_LightChain
agcaucgugaugacccagacccccacgucccugcucgucagcgccggcgaccgcgugaccaucacgugcaaggccucccagagcguguccaacgacgucgcgugguaccagcagaagccggggcagagccccaagcugcugaucuccuacaccagcucccgguacgccggcgugcccgaccgcuucagcggguccggcuacgggaccgacuucacccucaccaucagcuccgugcaggccgaggacgccgccgucuacuucugccagcaggacuacaacagcccgcccaccuucggcggcgggacgaagcuggagaucaagcgggcggacgccgcccccaccguguccaucuucccgcccagcuccgagcagcugaccagcggcggggccuccguggucugcuuccucaacaacuucuaccccaaggacaucaacgugaaguggaagaucgacggcagcgagcgccagaacggggugcugaacagcuggaccgaccaggacuccaaggacagcacguacuccaugagcuccacccugacccucaccaaggacgaguacgagcggcacaacagcuacacgugcgaggcgacccacaagaccuccaccagccccaucgucaaguccuucaaccgcaacgagagc

SEQ ID NO: 8231 - RNA, 1356 nt, Artificial Sequence
  derived and/or modified sequence opt1 from Narnatumab_HeavyChain1
gaggugcagcuggucgagagcggcgggggccucgugcagcccgggggcucccugcgccugagcugcgccgccuccggguucaccuucagcuccuaccucaugaccugggugcggcaggcgccgggcaagggccuggagugggucgccaacaucaagcaggacgggagcgagaaguacuacguggacuccgugaagggccgcuucacgaucagccgggacaacgccaagaacucccugaaccuccagaugaacagccugcgcgccgaggacaccgccgucuacuacugcacccgggacggguacuccagcggccgccacuacgggauggacguguggggccagggcaccacggugaucgucuccagcgcguccaccaaggggcccagcguguucccccuggcccccuccagcaaguccaccagcggcgggaccgccgcccucggcugccuggugaaggacuacuucccggagcccgucacggugagcuggaacuccggcgcgcugaccagcggggugcacaccuuccccgccguccuccaguccagcggccuguacucccugagcuccguggugaccguccccagcuccagccucgggacgcagaccuacaucugcaacgugaaccacaagccguccaacaccaagguggacaagcgggucgagcccaagagcugcgacaagacccacacgugcccgcccugcccggcccccgagcugcugggcgggcccuccguguuccucuucccgcccaagcccaaggacacccugaugaucagccgcacccccgaggugaccugcgucguggucgacgugucccacgaggaccccgaggugaaguucaacugguacgucgacggcguggaggugcacaacgccaagacgaagccgcgggaggagcaguacaacagcaccuaccgcgucguguccgugcugaccguccuccaccaggacuggcugaacggcaaggaguacaagugcaaggugagcaacaaggcccugcccgcgcccaucgagaagaccaucuccaaggccaaggggcagccccgggagccccagguguacacgcucccgcccagccgcgaggagaugaccaagaaccaggucagccugaccugccuggugaagggcuucuaccccuccgacaucgccguggagugggagagcaacgggcagcccgagaacaacuacaagaccacgccgcccguccucgacuccgacggcagcuucuuccuguacuccaagcugaccguggacaagagccgguggcagcaggggaacguguucuccugcagcgucaugcacgaggcccuccacaaccacuacacccagaagucccugagccugucccccggcaag

SEQ ID NO: 8232 - RNA, 642 nt, Artificial Sequence
  derived and/or modified sequence opt1 from Narnatumab_LightChain1
gagaucgugcugacccagagccccgccacccucucccugagcccgggcgagcgcgccacgcuguccugccgggcgagccaguccgucagccgcuaccucgccugguaccagcagaagcccgggcaggcgccccggcugcugaucuacgacgccuccaaccgcgccaccggcauccccgcccgguucagcggguccggcagcgggaccgacuucacccucacgaucuccagccuggagccggaggacuucgccguguacuacugccagcagcgcuccaacuggccccggaccuucggccagggcaccaagguggagaucaagcgcaccgucgccgcccccagcguguucaucuucccgcccuccgacgagcagcucaagagcgggacggcguccguggucugccugcugaacaacuucuacccccgggaggccaaggugcaguggaagguggacaacgcccugcagagcggcaacucccaggagagcgucaccgagcaggacagcaaggacuccaccuacagccucuccagcacccugacgcuguccaaggccgacuacgagaagcacaagguguacgccugcgaggugacccaccaggggcucagcucccccgucaccaagagcuucaaccgcggcgagugc

SEQ ID NO: 8233 - RNA, 1350 nt, Artificial Sequence
  derived and/or modified sequence opt1 from Natalizumab_HeavyChain1
caggugcagcugguccagagcggcgccgaggugaagaagcccggggccuccgugaaggucagcugcaaggcguccggcuucaacaucaaggacaccuacauccacugggugcgccaggccccggggcagcggcucgaguggaugggccgcaucgaccccgccaacggguacaccaaguacgaccccaaguuccagggccgggugaccaucaccgccgacaccagcgccuccaccgcguacauggagcugagcucccugcgcagcgaggacacggccgucuacuacugcgcccgggagggcuacuacgggaacuacggcguguacgccauggacuacugggggcagggcacccucgugaccgucuccagcgcguccaccaaggggcccagcguguucccgcuggcccccugcucccgcagcacguccgagagcaccgccgcccugggcugccucgugaaggacuacuuccccgagcccgucaccguguccuggaacagcggcgcccugaccuccggggugcacacguucccggcgguccugcagagcagcggccucuacucccugagcuccguggugaccguccccagcuccagccuggggaccaagaccuacacgugcaacguggaccacaagcccuccaacaccaagguggacaagcgggucgagagcaaguacgggcccccgugccccuccugccccgcccccgaguuccucggcggcccgagcguguuccuguucccgcccaagcccaaggacacccugaugaucucccgcacccccgaggugacgugcgucguggucgacgugagccaggaggaccccgaggugcaguucaacugguacgucgacggcguggaggugcacaacgccaagaccaagccccgggaggagcaguucaacuccaccuaccgcgucgugagcgugcucaccguccugcaccaggacuggcugaacgggaaggaguacaagugcaagguguccaacaagggccuccccagcuccaucgagaagacgaucagcaaggccaaggggcagccgcgggagccccagguguacacccugccgcccucccaggaggagaugaccaagaaccaggucagccugaccugccucgugaagggcuucuaccccagcgacaucgccguggagugggaguccaacggccagcccgagaacaacuacaagacgacgcccccgguccuggacagcgacggguccuucuuccuguacagccgccucaccguggacaagucccgguggcaggagggcaacguguucagcugcuccgucaugcacgaggcgcugcacaaccacuacacccagaagucccugagccucagccuggggaag

SEQ ID NO: 8234 - RNA, 639 nt, Artificial Sequence
  derived and/or modified sequence opt1 from Natalizumab_LightChain1
gacauccagaugacccagagccccuccagccuguccgccagcgugggcgaccgcgucaccaucacgugcaagaccucccaggacaucaacaaguacauggccugguaccagcagaccccggggaaggcgccccggcuccugauccacuacaccagcgcccugcagcccggcauccccucccgcuucagcggguccggcagcgggcgggacuacacguucaccaucuccagccuccagccggaggacaucgccaccuacuacugccugcaguacgacaaccuguggaccuucggccagggcacgaagguggagaucaagcgcaccguggccgcccccuccgucuucaucuucccgcccagcgacgagcagcucaaguccgggaccgcgagcguggugugccugcugaacaacuucuacccccgggaggccaagguccaguggaagguggacaacgcccuccaguccggcaacagccaggaguccgugaccgagcaggacagcaaggacagcacguacucccugagcuccacccugacccucagcaaggccgacuacgagaagcacaaggucuacgcgugcgaggugacccaccaggggcuguccagccccgugacgaaguccuucaaccgcggcgagugc

SEQ ID NO: 8235 - RNA, 1335 nt, Artificial Sequence
  derived and/or modified sequence opt1 from Navicixizumab_HeavyChain1
caggugcagcugguccagagcggcgccgaggugaagaagcccggggccuccgugaagaucagcugcaaggcguccggcuacagcuucaccgccuacuacauccacugggucaagcaggccccggggcagggccucgaguggaucggguacaucuccaacuacaaccgcgccaccaacuacaaccagaaguucaagggccgggugacguucaccaccgacaccagcacguccaccgccuacauggagcugcgcagccugcgguccgacgacaccgcgguguacuacugcgcccgcgacuacgacuacgacgucggcauggacuacugggggcagggcacccucgugacggugagcuccgccagcaccaaggggcccuccgucuucccccuggcccccugcagccgguccaccagcgaguccaccgcggcccugggcugccucgugaaggacuacuucccggagcccgugacggucagcuggaacuccggggcccugaccagcggcgugcacaccuuccccgccgugcugcagagcuccggccucuacagccuguccagcgucgugaccgugcccuccagcaacuucgggacgcagaccuacacgugcaacgucgaccacaagccguccaacaccaagguggacaagaccguggagcgcaagugcugcgucgagugcccgcccugccccgccccgcccguggcgggccccagcguguuccuguucccgcccaagcccaaggacacccucaugaucucccggacccccgaggugaccugcgucgucguggacgugagccacgaggaccccgagguccaguucaacugguacguggacgggguggagguccacaacgccaagacgaagccgcgcgaggagcaguucaacuccaccuuccggguggugagcguccugaccguggugcaccaggacuggcugaacggcaaggaguacaagugcaaggucuccaacaagggccuccccgcccccaucgagaagaccaucagcaagacgaaggggcagccccgcgagccccagguguacacccugccgcccucccgggaggagaugaccaagaaccaggugagccugaccugccucgucgagggcuucuaccccuccgacaucgccguggagugggagagcaacgggcagcccgagaacaacuacaagacgaccccgcccaugcuggacuccgacggcagcuucuuccuguacagcgagcucaccguggacaagucccgcuggcagcaggggaacgucuucagcugcuccgugaugcacgaggcccugcacaaccacuacacccagaagucccugagccucagccccggcaag

SEQ ID NO: 8236 - RNA, 1341 nt, Artificial Sequence
  derived and/or modified sequence opt1 from Navicixizumab_HeavyChain2
caggugcagcugguccagagcggcgccgaggugaagaagcccggggccuccgugaaggucagcugcaaggcguccggcuacaccuucaccaacuacuggaugcacugggugcgccaggccccggggcagggccucgaguggaugggggacaucaaccccagcaacggccggacguccuacaaggagaaguucaagcgccgggugacccugagcgucgacaaguccagcuccaccgccuacauggagcugagcucccuccgcagcgaggacaccgccguguacuucugcacgauccacuacgacgacaaguacuacccccugauggacuacuggggccaggggacccuggugaccgucuccagcgccuccaccaagggccccagcguguucccgcucgcgcccugcucccggagcacguccgagagcaccgccgcccuggggugccuggugaaggacuacuuccccgagcccgucaccgugagcuggaacuccggcgcccucaccagcggggugcacacguucccggcgguccugcaguccagcggccuguacucccucagcuccguggugaccguccccagcuccaacuucggcacccagaccuacacgugcaacguggaccacaagcccagcaacaccaagguggacaagaccgucgagcgcaagugcugcguggagugcccgcccugccccgccccgcccguggccgggcccuccgucuuccuguucccgcccaagcccaaggacacccugaugaucagccggacgcccgaggugaccugcgucgugguggacgucucccacgaggaccccgaggugcaguucaacugguacguggacggcgucgaggugcacaacgccaagaccaagccccgcgaggagcaguucaacagcaccuuccggguggucuccgugcucacggugguccaccaggacuggcugaacgggaaggaguacaagugcaaggugagcaacaagggccugcccgccccgaucgagaagaccaucuccaagaccaagggccagccccgcgagccccagguguacacccucccgcccagccgggagaagaugacgaagaaccaggucucccugaccugccuggugaagggguucuaccccagcgacaucgcgguggagugggagagcaacggccagcccgagaacaacuacaagaccaccccgcccaugcucaaguccgacgggagcuucuuccuguacuccaagcugacggucgacaagagccgcuggcagcagggcaacguguucuccugcagcgugaugcacgaggcccuccacaaccacuacacccagaagucccugagccugucccccgggaag

SEQ ID NO: 8237 - RNA, 654 nt, Artificial Sequence; identical to SEQ ID NO: 7841
  derived and/or modified sequence opt1 from Navicixizumab_LightChain1

SEQ ID NO: 8238 - RNA, 1368 nt, Artificial Sequence
  derived and/or modified sequence opt1 from Navivumab_HeavyChain1
caggugcagcugguccagagcggcgccgaggugaagaagcccggggccuccgugaaggucagcugcaagaccuccggcuacagcuucuccaccuacggggugagcugggugcgccaggcgccgggccaggggcccgagugggucggcuggaucuccgccuacacgggcaucaccgacuacgcccagaaguuccaggggcgggugacccucaccacggacgccaccaccgccaccgcguuccuggaccugcgcagccuccggcccgacgacacggccaccuacuucugcgcccgcgacaaggugcagggccgggucgaggugggguccggcgggcgccacgacuacuggggccagggcacccuggugaucgucagcuccgccagcaccaaggggcccuccguguucccgcuggcgcccagcuccaagagcacguccggcgggaccgccgcccucggcugccuggugaaggacuacuuccccgagcccgucaccgugagcuggaacuccggcgcccugaccagcggggugcacacguucccggccguccuccagagcuccggccuguacagccuguccagcguggugaccguccccuccagcucccucgggacccagaccuacaucugcaacgugaaccacaagcccagcaacacgaagguggacaagaaggucgagcccaaguccugcgacaagacccacacgugcccgcccugccccgcgcccgagcugcugggcgggccgagcguguuccucuucccgcccaagcccaaggacacccugaugaucucccggacccccgaggugaccugcgucguggucgacgugagccacgaggaccccgaggugaaguucaacugguacgucgacggcguggaggugcacaacgccaagaccaagccccgcgaggagcaguacaacuccaccuaccgggucgugagcgugcugacgguccuccaccaggacuggcugaacggcaaggaguacaagugcaagguguccaacaaggcccugcccgccccgaucgagaagaccaucagcaaggccaaggggcagccccgcgagccccagguguacacccugcccccgucccgggacgagcucaccaagaaccaggucagccugacgugccucgugaagggcuucuaccccuccgacaucgcgguggagugggagagcaacgggcagcccgagaacaacuacaagaccaccccgcccguccuggacagcgacggcuccuucuuccuguacagcaagcucaccguggacaagucccgcuggcagcaggggaacguguucagcugcuccgucaugcacgagggccugcacaaccacuacacgcagaagucccugagccucagccccggcaag

SEQ ID NO: 8239 - RNA, 645 nt, Artificial Sequence
  derived and/or modified sequence opt1 from Navivumab_LightChain1
gaggugguccugacccagagccccggcacccucgcccugccgcccggggagcgcgccacgcuguccugccgggcgagccaccgcgugggcuccaccuacaucgccugguaccagcagaaguccgggcaggcgccccggcgccucaucuacggcgccagcaaccgggccaccgacauccccgaccgcuucagcggguccggcagcggcaccgacuucacgcugaccauccggcgccuggagccggaggacuccgccguguacuacugccagcaguucagcgucucccccuggaccuucgggcagggcacccggguggagaucaagcgcacgguggccgcccccagcgucuucaucuucccgcccuccgacgagcagcucaagagcgggaccgccuccguggugugccugcugaacaacuucuacccccgggaggcgaagguccaguggaagguggacaacgcccuccagagcggcaacucccaggagagcgugaccgagcaggacuccaaggacagcaccuacagccuguccagcacgcugacccucuccaaggccgacuacgagaagcacaaggucuacgccugcgaggugacccaccaggggcugagcucccccgugaccaagagcuucaaccgcggcgagugc

SEQ ID NO: 8240 - RNA, 2172 nt, Artificial Sequence
  derived and/or modified sequence opt1 from Ndimab-varB_HeavyChain
caggugcagcuggucgagagcggcgggggcguggugcagcccgggcgcucccuccggcugagcugcgccgccuccggcuucaucuucagcuccuacgcgaugcacuggguccgccaggccccggggaacggccuggaguggguggccuucaugagcuacgacggcuccaacaagaaguacgccgacagcgugaaggggcgguucaccaucucccgcgacaacagcaagaacacccucuaccugcagaugaacucccugcgggccgaggacacggcggucuacuacugcgcccgcgaccggggcaucagcgccgggggcaacuacuacuacuacgggauggacguguggggccagggcaccaccgugaccgucuccagcgccuccacgaaggggcccagcguguucccccucgcgcccuccagcaaguccaccagcggcgggaccgccgcccugggcugccuggugaaggacuacuucccggagcccgucaccgugagcuggaacuccggcgcccucacgagcggggugcacaccuuccccgccguccugcaguccagcggccuguacucccucagcuccguggugaccguccccagcuccagccuggggacccagacguacaucugcaacgugaaccacaagccguccaacaccaagguggacaagcgcgucgagcccaagagcugcgacaagacccacacgugcccgcccugcccggcgcccgagcugcucggcgggcccuccguguuccuguucccgcccaagcccaaggacacccugaugaucagccggacccccgaggugaccugcgucguggucgacgugucccacgaggaccccgaggugaaguucaacugguacgucgacggcguggaggugcacaacgccaagaccaagccgcgcgaggagcaguacaacagcacguaccgggucguguccgugcucaccguccugcaccaggacuggcugaacggcaaggaguacaagugcaaggugagcaacaaggcccuccccgcccccaucgagaagaccaucuccaaggccaaggggcagccccgcgagccccagguguacacccugccgcccagccgggaggagaugacgaagaaccaggucagccugaccugccucgugaagggcuucuaccccuccgacaucgcgguggagugggagagcaacgggcagcccgagaacaacuacaagaccaccccgcccguccuggacuccgacggcagcuucuuccuguacuccaagcucacgguggacaagagccgcuggcagcaggggaacguguucuccugcagcgucaugcacgaggcccugcacaaccacuacacccagaagucccugagccucucccccggcaagggcgggggcgggagcggcgggggcggcucccaggugcagcuggugcagagcggggccgaggucaagaagcccggcuccagcgugaagguguccugcaaggccagcgggggcaccuucagcaccuacggcaucuccuggguccggcaggcccccgggcagugccuggaguggaugggcgggaucauccccaucuucgacacgggcaacagcgcgcaguccuuccaggggcgcgugaccaucaccgccgacgagagcaccuccacggccuacauggagcucagcucccugcggagcgaggacaccgccguguacuacugcgcccgcuccagccggaucuacgaccugaacccgucccucaccgcguacuacgacauggacgucuggggccagggcaccauggugaccgugagcuccgggggcgggggcagcgggggcggcggguccggcgggggcgggagcggcggcgggggcucccagagcguccugacgcagccgcccuccgugagcgccgcccccgggcagaaggugaccaucagcugcuccggcagcuccagcaacaucgggaacaacuacgucuccugguaccagcagcugcccggcaccgcccccaagcuccugaucuacgacaacaacaagcgccccagcggcauccccgaccgguucuccgggagcaaguccggcaccagcgcgacgcuggggaucaccggccuccagaccggcgacgaggccgacuacuacugcgggaccugggacuccagccuguccgccuggguguucggcugcgggacgaagcugaccgugcuc

SEQ ID NO: 8241 - RNA, 645 nt, Artificial Sequence
  derived and/or modified sequence opt1 from Ndimab-varB_LightChain
gagaucgugcugacccagagccccgccacccucucccugagcccgggcgagcgcgccacgcuguccugccgggcgagccaguccgucuacagcuaccucgccugguaccagcagaagcccgggcaggcgccccgccugcugaucuacgacgccuccaaccgggccaucggcauccccgcccgcuucagcggguccggcagcgggaccgacuucacccucaccaucuccagccuggagccggaggacuucgccguguacuacugccagcagcgguccaacuggccgcccuucacguucggccccggcaccaagguggacaucaagcgcaccgucgccgcccccagcguguucaucuucccgcccuccgacgagcagcucaagagcgggaccgcguccguggucugccugcugaacaacuucuacccccgggaggccaaggugcaguggaagguggacaacgcccugcagagcggcaacucccaggagagcgucacggagcaggacagcaaggacuccaccuacagccucuccagcacccugacccuguccaaggccgacuacgagaagcacaagguguacgccugcgaggugacgcaccaggggcucagcucccccgucaccaagagcuucaaccgcggcgagugc

SEQ ID NO: 8242 - RNA, 1353 nt, Artificial Sequence
  derived and/or modified sequence opt1 from Necitumumab_HeavyChain1
caggugcagcugcaggagagcggccccgggcucgucaagcccucccagacccugagccugaccugcacgguguccggcgggagcaucuccagcggcgacuacuacugguccuggauccgccagccgcccgggaagggccucgaguggaucggcuacaucuacuacagcggguccaccgacuacaaccccagccugaagucccgggugaccaugagcgucgacaccuccaagaaccaguucagccugaaggugaacuccgugacggccgccgacaccgcggucuacuacugcgcccgcgugagcaucuucggcguggggaccuucgacuacuggggccaggggacccucgucacgguguccagcgccuccaccaagggcccgagcgugcugccccuggcccccagcuccaagagcaccuccggcgggaccgccgcgcucggcugccuggucaaggacuacuuccccgagccggugacggugagcuggaacuccggggcccugaccagcggcguccacaccuuccccgccgugcuccaguccagcggccuguacucccugagcuccguggucaccgugcccagcuccagccucgggacgcagaccuacaucugcaacgugaaccacaagcccuccaacaccaaggucgacaagcggguggagcccaagagcugcgacaagacccacacgugcccgcccugccccgcccccgagcugcugggcgggcccuccguguuccucuucccgcccaagcccaaggacacccugaugaucagccgcacccccgaggugaccugcgucgucguggacgugucccacgaggaccccgaggucaaguucaacugguacguggacggcguggagguccacaacgcgaagacgaagccccgggaggagcaguacaacagcaccuaccgcguggugagcguccugaccgugcuccaccaggacuggcugaacgggaaggaguacaagugcaagguguccaacaaggcccugccggcccccaucgagaagaccaucagcaaggccaagggccagccccgggagccccaggucuacacgcucccgcccucccgcgaggagaugaccaagaaccaggugagccugaccugccuggugaagggcuucuaccccuccgacaucgccgucgagugggagagcaacgggcagccggagaacaacuacaagaccacgccgcccgugcucgacuccgacggcagcuucuuccuguacuccaagcugaccguggacaagagccgguggcagcaggggaacgucuucuccugcagcgugaugcacgaggcgcuccacaaccacuacacccagaagucccugagccugucccccggcaag

SEQ ID NO: 8243 - RNA, 642 nt, Artificial Sequence
  derived and/or modified sequence opt1 from Necitumumab_LightChain1
gagaucgugaugacccagagccccgccacccugucccucagcccgggcgagcgcgccacgcuguccugccgggcgagccaguccgucagcuccuaccuggccugguaccagcagaagcccgggcaggcgccccgccuccugaucuacgacgccagcaaccgggccaccggcauccccgcccgcuucuccgggagcggcuccgggaccgacuucacccugacgaucagcucccucgagccggaggacuucgccguguacuacugccaccaguacggcagcacgccccugaccuucggcgggggcaccaaggccgagaucaagcggaccguggccgcgcccuccgucuucaucuucccgcccagcgacgagcagcugaaguccgggaccgccagcguggugugccuccugaacaacuucuacccccgcgaggccaagguccaguggaagguggacaacgcccugcaguccggcaacagccaggagagcgugaccgagcaggacuccaaggacagcaccuacucccucagcuccacgcugacccugagcaaggccgacuacgagaagcacaaggucuacgcgugcgaggugacccaccaggggcucuccagccccgugaccaaguccuucaaccggggcgagugc

SEQ ID NO: 8244 - RNA, 396 nt, Artificial Sequence
  derived and/or modified sequence opt1 from Neliximab_HeavyChain_VH-Region
gaggugcagcugcagcagagcggccccgagcucgucaagccgggggccuccgugaagaugagcugcaaggccuccggcuacaccuucaccaccuacgugaugcacugggucaagcagaagcccgggcagggccuggaguggaucggguacaucaaccccuacaacgacggcaccaacuacaacgagaaguucaagggcaaggcgacccugaccagcgacaaguccagcuccacggccuacauggagcucagcacccugaccuccgaggacagcgccguguacuacugcgccgaguucaucaccaagacggucgggggcuccaacugguaccuggacguguggggcgccgggaccaccgugaccgugagcuccgcgaagacgacgcccccgaagcuc

SEQ ID NO: 8245 - RNA, 372 nt, Artificial Sequence
  derived and/or modified sequence opt1 from Neliximab_HeavyChain_VH-Region_variant1
caggugcagcugaagcagagcggccccgagcucgucaagccgggggccuccgugaagaugagcugcaaggccuccggcuacaccuucaccacguacgugaugcacugggucaagcagaagcccgggcagggccuggaguggaucggguacaucaaccccuacaacgacggcaccaacuacaacgagaaguucaagggcaaggcgacccugaccagcgacaaguccagcuccacggccuacauggagcucagcacccugaccuccgaggacagcgccguguacuacugcgccgaguucaucaccaagacggucgggggcuccaacugguaccuggacguguggggcgccgggaccaccgugaccgugagcucc

SEQ ID NO: 8246 - RNA, 318 nt, Artificial Sequence
  derived and/or modified sequence opt1 from Neliximab_LightChain_VL-Region
gacaucgugcugacccagagccccgccaucauguccgccagcccgggcgagaaggucaccaugacgugcuccgcgagcuccagcaucuccuacauccacugguuccagcagaagcccgggaccagccccaagcgcuggaucuacgacaccuccaagcuccccagcggcgugccggcccgguucuccgggagcggcuccgggaccagcuacucccugacgaucagcuccauggaggccgaggacgccgccaccuacuacugccaccagcgcagcuccuacaccuggaccuucggcggcgggacgaagcuggagaucaag

SEQ ID NO: 8247 - RNA, 354 nt, Artificial Sequence
  derived and/or modified sequence opt1 from Neliximab_LightChain_VL-Region_variant1
cagaucgugcugacccagagccccgccaucauguccgccagcccgggcgagaaggucaccaugacgugcuccgcgagcuccagcaucuccuacauccacugguuccagcagaagcccgggaccagccccaagcgcuggaucuacgacaccuccaagcuccccagcggcgugccggcccgguucuccgggagcggcuccgggaccagcuacucccugacgaucagcuccauggaggccgaggacgccgccaccuacuacugccaccagcgcagcuccuacaccuggaccuucggcggcgggacgaagcuggagaucaagcgggcggacgccgcccccaccgugagcgccgcggcc

SEQ ID NO: 8248 - RNA, 1335 nt, Artificial Sequence
  derived and/or modified sequence opt1 from Nemolizumab_HeavyChain1
caggugcagcugguccagagcggcgccgaggugaagaagcccggggccuccgugaaggucagcugcaaggcguccggcuacaccuucaccggguacaucaugaacugggugcgccaggcccccggccaggggcucgaguggaugggccugaucaaccccuacaacggcgggacggacuacaacccccaguuccaggaccgggugaccaucaccgccgacaagagcaccuccacggccuacauggagcugagcucccuccgcagcgaggacaccgccgucuacuacugcgcgcgggacggcuacgacgacgggcccuacacccuggagaccuggggccaggggacgcuggugaccguguccagcgccuccaccaagggcccgagcgucuucccccucgcccccuccagcaaguccaccagcggcgggacggccgcgcugggcugccuggugaaggacuacuuccccgagccggugaccgucuccuggaacagcggggcccucaccuccggcgugcacaccuuccccgccgugcugcagagcagcggccuguacucccucagcuccgucgugacggugcccagcuccaacuucgggacccagaccuacacgugcaacgucgaccacaagcccagcaacaccaagguggacaagaccguggagcgcaaguccugcgucgagugcccgcccugccccgcgcccccgguggccggccccagcguguuccuguucccgcccaagcccaaggacacccugaugaucucccggacccccgaggucacgugcguggucguggacgugagccaggaggaccccgagguccaguucaacugguacguggacgggguggagguccacaacgccaagaccaagccccgcgaggagcaguucaacuccaccuuccggguggugagcguccucaccguggugcaccaggacuggcugaacggcaaggaguacaagugcaaggucuccaacaaggggcugccggcccccaucgagaagacgaucagcaagaccaagggccagccccgcgagccccagguguacacccucccgcccucccaggaggagaugaccaagaaccaggugagccugacgugccuggucaagggcuucuaccccuccgacaucgccguggagugggagagcaacgggcagccggagaacaacuacaagaccaccccgcccaugcucgacuccgacggcagcuucuuccuguacagcaagcugaccguggacaagucccgguggcaggaggggaacgucuucagcugcuccgugaugcacgaggcccuccacaaccacuacacgcagaagucccugagccugagcccc

SEQ ID NO: 8249 - RNA, 642 nt, Artificial Sequence
  derived and/or modified sequence opt1 from Nemolizumab_LightChain1
gacauccagaugacccagagccccuccagccuguccgccagcgugggcgaccgcgucaccaucacgugccaggccuccgaggacaucuacagcuucguggcgugguaccagcagaagccggggaaggcccccaagcuccugaucuacaacgcccagaccgaggcccagggcgugcccucccgguucagcggguccggcagcgggaccgacuucacccugacgaucuccagccuccagcccgaggacuucgccaccuacuacugccagcaccacuacgacuccccgcugaccuucggcggcgggaccaaggucgagaucaagcgcacgguggcggcccccagcguguucaucuucccgcccuccgacgagcagcucaagagcggcaccgccuccgucgugugccugcugaacaacuucuacccccgggaggccaaggugcaguggaaggucgacaacgcgcugcagagcgggaacucccaggagagcgugaccgagcaggacagcaaggacuccaccuacagccucuccagcacgcugacccuguccaaggccgacuacgagaagcacaagguguacgccugcgaggucacccaccagggccucagcucccccgugaccaagagcuucaaccgcggggagugc

SEQ ID NO: 8250 - RNA, 1356 nt, Artificial Sequence
  derived and/or modified sequence opt1 from Nesvacumab_HeavyChain1
gaggugcagcuggucgagagcggcgggggccucgugcagcccgggggcucccugcgccugagcugcgccgccuccggguucaccuucagcuccuacgacauccacugggugcggcaggcgaccggcaagggccucgagugggucagcgccaucgggccggccggcgacacguacuaccccggguccgugaagggccgcuucaccaucagccgggagaacgccaagaacucccuguaccugcagaugaacagccuccgcgccggggacaccgcgguguacuacugcgcccggggccugaucaccuucggcgggcugaucgcccccuucgacuacuggggccaggggacgcucgucaccguguccagcgccuccaccaagggccccagcguguucccgcuggcgcccuccagcaaguccaccagcggcgggacggccgcccugggcugccucgucaaggacuacuuccccgagcccgugaccguguccuggaacagcggggcccugaccagcggcguccacaccuucccggccgugcugcaguccagcgggcucuacucccugagcuccguggucacggugcccagcuccagccugggcacccagaccuacaucugcaacgugaaccacaagcccuccaacaccaaggucgacaagaagguggagcccaagagcugcgacaagacgcacacgugcccgcccugccccgcgcccgagcuccugggcgggccguccguguuccuguucccgcccaagcccaaggacacccucaugaucagccgcacccccgaggugaccugcgucguggucgacgugucccacgaggaccccgaggucaaguucaacugguacguggacggcguggagguccacaacgccaagaccaagccccgggaggagcaguacaacagcaccuaccgcgugguguccguccugaccgugcugcaccaggacuggcucaacgggaaggaguacaagugcaaggugagcaacaaggcccugcccgccccgaucgagaagacgaucuccaaggccaagggccagccccgggagccccaggucuacacccugcccccgagccgcgacgagcucaccaagaaccaggugucccugaccugccuggugaagggguucuaccccagcgacaucgcggucgagugggagagcaacggccagcccgagaacaacuacaagacgaccccgcccgugcucgacuccgacggcagcuucuuccuguacuccaagcugaccguggacaagagccgguggcagcaggggaacgucuucuccugcagcgugaugcacgaggcccuccacaaccacuacacccagaagucccugagccugucccccggcaag

SEQ ID NO: 8251 - RNA, 642 nt, Artificial Sequence
  derived and/or modified sequence opt1 from Nesvacumab_LightChain1
gagaucgugcugacccagagccccggcacccucucccugagcccgggggagcgcgccacgcuguccugccgggccagccaguccgucagcuccaccuaccucgcgugguaccagcagaagcccggccaggcgccccgccugcugaucuacggggccagcucccgggccaccggcauccccgaccgcuucagcggguccggcagcggcaccgacuucacgcucaccaucucccggcuggagccggaggacuucgccguguacuacugccagcacuacgacaacagccagaccuucgggcagggcaccaagguggagaucaagcgcacggucgccgcccccuccguguucaucuucccgcccagcgacgagcagcugaaguccgggaccgccagcguggucugccuccugaacaacuucuacccccgggaggccaaggugcaguggaagguggacaacgcgcugcaguccggcaacagccaggagagcgucaccgagcaggacuccaaggacagcaccuacucccucagcuccacgcugacccugagcaaggccgacuacgagaagcacaagguguacgccugcgaggugacccaccaggggcucuccagccccgucaccaaguccuucaaccgcggcgagugc

SEQ ID NO: 8252 - RNA, 1362 nt, Artificial Sequence
  derived and/or modified sequence opt1 from Neuradiab_HeavyChain1
gaggugcagcugcagcagagcggccccgagcucgucaagccgggggccuccgugaagaugagcugcaaggccuccggcuacaccuucaccagcuacgugguccacugggugaagcagaaccccgggcagggccuggaguggaucggguacaucaaccccuucaacgacggcacgaaguacaacgagaacuucaagugcaaggcgacccugaccuccgaccgcagcuccagcaccgccuacauggagcucuccagccugacguccgaggagagcgccguguacuucugcgcccgggacaugggccgcgagggguucgccuacuggggccaggggacccuggucaccguguccgcggccaagaccacgcccccgagcguguacccccucgcccccggcugcggggacaccaccggcuccagcgucacccugggcugccuggugaagggguacuuccccgaguccgugacggucaccuggaacagcggcucccucagcagcuccgugcacaccuucccggcccugcugcagagcgggcucuacaccauguccagcuccgugacgguccccagcuccaccuggcccagccagaucgugaucugcuccguggcgcaccccgccagcuccaccaccgucgacaagaagcuggagccgagcggccccaucuccacgaucaaccccugcccgcccugcaaggagugccacaagugccccgcccccaaccuggagggcgggcccagcguguucaucuucccgcccaacaucaaggacgugcucaugaucucccugacccccaaggugaccugcgucguggucgacgugagcgaggacgaccccgacguccagaucuccugguucgugaacaacguggagguccacaccgcccagacgcagacccaccgggaggacuacaacagcaccauccgcgugguguccacccugccgauccagcaccaggacuggaugagcggcaaggaguucaagugcaaggucaacaacaaggaccuccccagccccaucgagcggacgaucuccaagaucaaggggcuggugcgcgcgccccagguguacauccugccgccgcccgccgagcagcucagccggaaggacgucucccugaccugccugguggugggcuucaaccccggggacaucagcgucgaguggaccuccaacggccacaccgaggagaacuacaaggacacggcccccgugcucgacagcgacggcuccuacuucaucuacagcaagcugaacaugaagaccuccaagugggagaagaccgacagcuucuccugcaacgugcgccacgaggggcugaagaacuacuaccucaagaagaccaucagccggucccccggcaag

SEQ ID NO: 8253 - RNA, 657 nt, Artificial Sequence
  derived and/or modified sequence opt1 from Neuradiab_LightChain1
gacaucgugaugacccaggccgccuucagcaaccccgugacccugggcacguccgcgagcaucuccugccgcagcuccaagagccuccugcacuccaacgggaucaccuaccuguacugguaccuccagaagccgggccagagcccccagcugcugaucuaccagauguccaaccucgccagcggggugcccgaccgguucuccagcuccggcagcgggaccgacuucacccugcgcaucucccggguggaggccgaggacgucggcguguacuacugcgcccagaaccuggagcucccccgcacguucggcgggggcaccaagcuggagaucaagcgggccgacgcggccccgaccgugagcaucuucccgcccuccagcgagcagcugaccuccgggggcgccagcgucgugugcuuccucaacaacuucuaccccaaggacaucaacgugaaguggaagaucgacgggagcgagcgccagaacggcguccugaacuccuggacggaccaggacagcaaggacuccaccuacagcauguccagcacccugacccucacgaaggacgaguacgagcggcacaacuccuacacgugcgaggccacccacaagaccagcaccucccccaucgucaagagcuucaaccgcaacgagugc

SEQ ID NO: 8254 - RNA, 369 nt, Artificial Sequence
  derived and/or modified sequence opt1 from Nimotuzumab_HeavyChain1
caggugcagcugcagcagagcggcgccgaggucaagaagcccggguccagcgugaagguguccugcaaggccagcggcuacaccuucaccaacuacuacaucuacuggguccgccaggcgccggggcagggccucgaguggaucgggggcaucaaccccacguccggcgggagcaacuucaacgagaaguucaagacccgggugaccaucaccguggacgaguccacgaacaccgccuacauggagcugagcucccugcgcagcgaggacaccgccuucuacuucugcgcccggcagggccucugguucgacuccgacgggcgcggcuucgacuucugggggcagggcagcaccgucacgguguccagc

SEQ ID NO: 8255 - RNA, 342 nt, Artificial Sequence
  derived and/or modified sequence opt1 from Nimotuzumab_LightChain1
gacauccagaugacccagagccccuccagccuguccgccagcgugggcgaccgcgucaccaucacgugccgguccagccagaacaucgugcacuccaacgggaacaccuaccucgacugguaccagcagaccccgggcaaggcccccaagcugcugaucuacaaggugagcaaccgcuucuccgggguccccagccgguucuccggcagcggguccggcaccgacuucacguucaccaucagcucccuccagcccgaggacaucgcgaccuacuacugcuuccaguacagccacgugccguggaccuucggccaggggacgaagcugcagaucacccgcgag

SEQ ID NO: 8256 - RNA, 1320 nt, Artificial Sequence
  derived and/or modified sequence opt1 from Nivolumab_HeavyChain1
caggugcagcuggucgagagcggcgggggcguggugcagcccgggcgcucccuccggcuggacugcaaggccagcggcaucaccuucuccaacagcgggaugcacuggguccgccaggcccccggcaagggccuggaguggguggcggugaucugguacgacggguccaagcgguacuacgccgacagcgucaagggccgcuucaccaucucccgggacaacagcaagaacacccucuuccugcagaugaacucccugcgcgccgaggacaccgccguguacuacugcgccaccaacgacgacuacugggggcagggcacccucgugacggucagcuccgcgagcaccaaggggcccuccguguucccccuggcccccugcagccgguccaccagcgaguccaccgccgcccugggcugccucgugaaggacuacuucccggagcccgucacggugagcuggaacuccggcgcgcugaccagcggggugcacaccuuccccgccguccugcagagcuccggccucuacagccuguccagcguggugaccguccccuccagcucccuggggacgaagaccuacacgugcaacguggaccacaagccgagcaacaccaagguggacaagcgcgucgaguccaaguacggcccgcccugcccgcccugccccgcccccgaguuccucggcgggcccagcguguuccuguucccgcccaagcccaaggacacgcugaugaucucccggacccccgaggugaccugcgucguggucgacgugagccaggaggacccggaggugcaguucaacugguacgucgacggcguggaggugcacaacgccaagaccaagccccgcgaggagcaguucaacuccacguaccgggucgugagcgugcucaccguccugcaccaggacuggcugaacgggaaggaguacaagugcaagguguccaacaagggccuccccagcuccaucgagaagaccaucagcaaggccaaggggcagccccgcgagccccagguguacacccugccgcccucccaggaggagaugacgaagaaccaggucagccugaccugccucgugaagggcuucuaccccagcgacaucgcgguggagugggaguccaacggccagcccgagaacaacuacaagaccaccccgcccguccuggacagcgacggguccuucuuccuguacagccggcucacgguggacaagucccgcuggcaggagggcaacguguucagcugcuccgucaugcacgaggcccugcacaaccacuacacccagaagucccugagccucagccuggggaag

SEQ ID NO: 8257 - RNA, 642 nt, Artificial Sequence
  derived and/or modified sequence opt1 from Nivolumab_LightChain1
gagaucgugcugacccagagccccgccacccucucccugagcccgggcgagcgcgccacgcuguccugccgggcgagccaguccgucagcuccuaccucgccugguaccagcagaagcccgggcaggcgccccgccugcugaucuacgacgccagcaaccgggccaccggcauccccgcccgcuucuccgggagcggcuccgggaccgacuucacccucacgaucagcucccuggagccggaggacuucgccguguacuacugccagcagagcuccaacuggccccggaccuucggccagggcaccaagguggagaucaagcgcaccgucgccgcccccagcguguucaucuucccgcccuccgacgagcagcucaagagcgggacggcguccguggucugccugcugaacaacuucuacccccgggaggccaaggugcaguggaagguggacaacgcccugcagagcggcaacagccaggaguccgucaccgagcaggacagcaaggacuccaccuacagccucuccagcacccugacgcuguccaaggccgacuacgagaagcacaagguguacgccugcgaggugacccaccaggggcucagcucccccgucaccaagagcuucaaccgcggcgagugc

SEQ ID NO: 8258 - RNA, 1347 nt, Artificial Sequence
  derived and/or modified sequence opt1 from Obiltoxaximab_HeavyChain1
caggugcagcugcagcagagcggccccgagcucaagaagccgggggccuccgucaaggugagcugcaaggacuccggcuacgccuucagcuccagcuggaugaacugggugcgccaggcgcccgggcagggccuggaguggaucgggcggaucuaccccggcgacggcgacaccaacuacaacgggaaguuccagggccgcgucaccaucacggccgacaaguccagcuccaccgccuacauggagcugagcucccuccggagcgaggacaccgccguguacuucugcgcccgcuccgggcugcugcgguacgcgauggacuacuggggccaggggacccucgugacggucagcuccgccagcaccaagggccccuccguguucccgcuggcccccagcuccaagagcaccagcggcgggaccgccgcgcugggcugccucgugaaggacuacuuccccgagcccgucacgguguccuggaacagcggggcccugaccuccggcgugcacaccuucccggccguccugcagagcuccggccucuacagccuguccagcguggugaccguccccuccagcucccuggggacgcagaccuacaucugcaacgugaaccacaagcccagcaacaccaagguggacaagaaggucgagcccaaguccugcgacaagacccacacgugcccgcccugccccgcccccgagcuccugggcgggccgagcguguuccuguucccgcccaagcccaaggacacccucaugaucucccgcacccccgaggugaccugcgucgugguggacgucagccacgaggaccccgaggugaaguucaacugguacgucgacggcguggaggugcacaacgccaagacgaagccccgggaggagcaguacaacuccaccuaccgcgucgugagcgugcugaccguccugcaccaggacuggcucaacgggaaggaguacaagugcaagguguccaacaaggcgcugcccgccccgaucgagaagaccaucagcaaggccaagggccagccccgggagccccagguguacacgcugcccccgagccgcgacgagcucaccaagaaccaggucucccugaccugccuggugaagggcuucuaccccagcgacaucgccguggagugggaguccaacgggcagcccgagaacaacuacaagaccacgccgcccguccucgacagcgacggcuccuucuuccuguacagcaagcugaccguggacaagucccgguggcagcaggggaacguguucagcugcuccgucaugcacgaggcccuccacaaccacuacacccagaagucccugagccugagccccggcaag

SEQ ID NO: 8259 - RNA, 642 nt, Artificial Sequence
  derived and/or modified sequence opt1 from Obiltoxaximab_LightChain1
gacauccagaugacccagagccccuccagccuguccgccagcgugggcgaccgcgucaccaucacgugccgggccucccaggacauccgcaacuaccucaacugguaccagcagaagccggggaaggcggugaagcugcugaucuacuacaccagccggcuccugcccggcgugcccucccgcuucagcggguccggcagcgggaccgacuacucccugaccaucagcucccaggagcaggaggacaucggcacguacuucugccagcagggcaacacccuccccuggaccuucgggcagggcaccaaggucgagauccggcgcacgguggccgccccgagcguguucaucuucccgcccuccgacgagcagcucaagagcgggaccgccuccgucgugugccugcugaacaacuucuacccccgggaggccaaggugcaguggaaggucgacaacgcgcugcagagcggcaacucccaggagagcgugaccgagcaggacagcaaggacuccaccuacagccuguccagcacgcucacccuguccaaggccgacuacgagaagcacaagguguacgccugcgaggucacccaccaggggcugagcucccccgugaccaagagcuucaaccgcggcgagugc

SEQ ID NO: 8260 - RNA, 1347 nt, Artificial Sequence; identical to SEQ ID NO: 7664
  derived and/or modified sequence opt1 from Obinutuzumab_HeavyChain1

SEQ ID NO: 8261 - RNA, 657 nt, Artificial Sequence; identical to SEQ ID NO: 7665
  derived and/or modified sequence opt1 from Obinutuzumab_LightChain1

SEQ ID NO: 8262 - RNA, 1350 nt, Artificial Sequence
  derived and/or modified sequence opt1 from Ocaratuzumab_HeavyChain1
gaggugcagcugguccagagcggcgccgaggugaagaagcccggggagucccucaagaucagcugcaagggcuccgggcgcaccuucaccagcuacaacaugcacugggugcggcagaugccgggcaaggggcuggaguggaugggcgccaucuacccccugacgggcgacaccuccuacaaccagaaguccaagcuccaggucaccaucagcgcggacaagagcaucuccaccgccuaccugcaguggagcucccugaaggccagcgacacggccauguacuacugcgcccgcuccaccuacgucgggggcgacuggcaguucgacgugugggggaagggcaccaccgucacggugagcuccgcgagcaccaaggggcccuccguguucccccucgccccgagcuccaagagcaccagcggcggcaccgccgcccuggggugccuggucaaggacuacuuccccgagcccgugacgguguccuggaacagcggcgcgcucaccuccgggguccacaccuuccccgccgugcugcagagcuccggccuguacagccucuccagcguggucaccgugccguccagcucccugggcacgcagaccuacaucugcaacgugaaccacaagcccagcaacaccaaggucgacaagaagguggagcccaaguccugcgacaagacccacacgugcccgcccugccccgcccccgagcugcucgggggccccagcguguuccuguucccgcccaagaucaaggacacccugaugaucucccggacccccgaggugaccugcgugguggucgacgugagccacgaggaccccgaggucaaguucaacugguacguggacgggguggagguccacaacgccaagacgaagccgcgcgaggagcaguacaacuccaccuaccggguggugagcguccucaccgugcugcaccaggacuggcugaacggcaaggaguacaagugcaagguguccaacaaggcccuccccgcgcccaucgagaagaccaucagcaagcagaaggggcagccccgcgagccgcaggucuacacgcugccgcccagccgggacgagcugaccaagaaccaggugucccugaccugccucgugaagggcuucuaccccagcgacaucgccgucgagugggaguccaacggccagcccgagaacaacuacaagaccacgccgcccgugcuggacagcgacggguccuucuuccucuacagcaagcugaccguggacaagucccgcuggcagcagggcaacgucuucagcugcuccgugaugcacgaggcccugcacaaccacuacacccagaagucccucagccugagccccggg

SEQ ID NO: 8263 - RNA, 639 nt, Artificial Sequence
  derived and/or modified sequence opt1 from Ocaratuzumab_LightChain1
gagaucgugcugacccagagccccggcacccucucccugagcccgggggagcgggccacgcuguccugccgggccagcuccagcguccccuacauccacugguaccagcagaagcccggccaggcgccccgccuccugaucuacgccaccuccgcccuggccagcgggaucccggaccgguucuccggcagcggguccggcaccgacuucacccucacgaucagccgccuggagcccgaggacuucgccguguacuacugccagcaguggcuguccaacccgcccaccuucggccaggggaccaagcucgagaucaagcggaccguggcggcccccagcgucuucaucuucccgcccuccgacgagcagcucaagagcggcacggccuccguggugugccugcugaacaacuucuacccccgcgaggccaagguccaguggaagguggacaacgcgcugcagagcgggaacucccaggagagcgugaccgagcaggacagcaaggacuccaccuacagccuguccagcacccucacgcuguccaaggccgacuacgagaagcacaaggucuacgccugcgaggugacccaccagggccugagcucccccgugaccaagagcuucaaccgcggggagugc

SEQ ID NO: 8264 - RNA, 1356 nt, Artificial Sequence
  derived and/or modified sequence opt1 from Ocrelizumab_HeavyChain1
gaggugcagcuggucgagagcggcgggggccucgugcagcccgggggcucccugcgccugagcugcgccgccuccggguacaccuucaccagcuacaacaugcacugggugcggcaggcgccgggcaagggccucgagugggucggggccaucuaccccggcaacggggacaccuccuacaaccagaaguucaagggccgcuucaccaucagcguggacaaguccaagaacacccuguaccugcagaugaacagccuccgggccgaggacaccgccguguacuacugcgcccgcgucguguacuacuccaacagcuacugguacuucgacgugugggggcagggcacgcuggucaccguguccagcgcguccaccaagggccccagcguguucccccuggccccguccagcaaguccaccagcgggggcacggccgcccucgggugccuggucaaggacuacuuccccgagcccgugaccguguccuggaacagcggcgcgcugaccagcggcguccacaccuuccccgccgugcuccaguccagcgggcuguacucccugagcuccguggucacggugccgagcuccagccucggcacccagaccuacaucugcaacgugaaccacaagcccuccaacaccaaggucgacaagaagguggagcccaagagcugcgacaagacgcacacgugcccgcccugccccgcccccgagcugcucgggggccccuccguguuccuguucccgcccaagcccaaggacacccugaugaucagccggacccccgaggugaccugcgucgucguggacgugucccacgaggacccggaggucaaguucaacugguacguggacgggguggagguccacaacgccaagaccaagccccgcgaggagcaguacaacagcaccuaccgggugguguccguccugaccgugcuccaccaggacuggcugaacggcaaggaguacaagugcaaggugagcaacaaggcccugcccgcgcccaucgagaagacgaucuccaaggccaagggccagccgcgcgagccccaggucuacacccucccgcccagccgggaggagaugaccaagaaccaggugucccugaccugccuggugaagggguucuaccccagcgacaucgccgucgagugggagagcaacggccagcccgagaacaacuacaagacgacgcccccggugcucgacuccgacgggagcuucuuccuguacuccaagcugaccguggacaagagccgcuggcagcagggcaacgucuucuccugcagcgugaugcacgaggcccuccacaaccacuacacccagaagucccugagccugucccccgggaag

SEQ ID NO: 8265 - RNA, 639 nt, Artificial Sequence
  derived and/or modified sequence opt1 from Ocrelizumab_LightChain1
gacauccagaugacccagagccccuccagccuguccgccagcgugggcgaccgcgucaccaucacgugccgggccuccagcuccgugagcuacaugcacugguaccagcagaagccggggaaggcgcccaagccccucaucuacgcccccuccaaccuggccagcggcgugccgucccgcuucagcggguccggcagcgggaccgacuucacccugaccaucuccagccuccagcccgaggacuucgccacguacuacugccagcagugguccuucaacccgcccaccuucggccagggcaccaaggucgagaucaagcggaccguggccgcgcccagcguguucaucuucccgcccuccgacgagcagcucaagagcgggacggccagcgucgugugccugcugaacaacuucuacccccgcgaggccaaggugcaguggaaggucgacaacgcccugcaguccggcaacagccaggaguccgugaccgagcaggacagcaaggacuccaccuacagccuguccagcacccucacgcuguccaaggcggacuacgagaagcacaagguguacgccugcgaggucacccaccaggggcugagcucccccgugaccaagagcuucaaccggggcgagugc

SEQ ID NO: 8266 - RNA, 1356 nt, Artificial Sequence
  derived and/or modified sequence opt1 from Ofatumumab_HeavyChain1
gaggugcagcuggucgagagcggcgggggccucgugcagcccgggcgcucccugcggcugagcugcgccgccuccggcuucaccuucaacgacuacgcgaugcacugggugcgccaggccccggggaagggccucgagugggucagcaccaucuccuggaacagcggcuccaucggguacgccgacagcgugaagggccgguucacgaucucccgcgacaacgccaagaagucccuguaccugcagaugaacagccuccgggccgaggacaccgcgcuguacuacugcgccaaggacauccaguacgggaacuacuacuacggcauggacgugugggggcagggcaccaccgucacggugagcuccgccagcaccaagggccccuccguguucccccuggcccccagcuccaagagcaccuccgggggcaccgcggcccucgggugccuggucaaggacuacuucccggagcccgugacggugagcuggaacagcggcgcccugaccuccggcguccacaccuuccccgccgugcuccagagcuccgggcuguacagccuguccagcguggucaccgugcccuccagcucccucggcacgcagaccuacaucugcaacgugaaccacaagccgagcaacaccaaggucgacaagcgcguggagcccaaguccugcgacaagacccacacgugcccgcccugccccgcccccgagcugcucgggggccccagcguguuccuguucccgcccaagcccaaggacacccugaugaucucccggacccccgaggugaccugcgucguggucgacgugagccacgaggaccccgaggucaaguucaacugguacguggacgggguggagguccacaacgcgaagacgaagccgcgcgaggagcaguacaacuccaccuaccggguggugagcguccugaccgugcuccaccaggacuggcugaacggcaaggaguacaagugcaagguguccaacaaggcccugcccgcccccaucgagaagaccaucagcaaggccaagggccagccccgcgagccgcaggucuacacgcucccgcccucccgggaggagaugaccaagaaccaggugagccugaccugccuggugaagggguucuaccccagcgacaucgccgucgagugggaguccaacggccagcccgagaacaacuacaagaccacgccgcccgugcucgacagcgacggguccuucuuccuguacagcaagcugaccguggacaagucccgcuggcagcagggcaacgucuucagcugcuccgugaugcacgaggcgcuccacaaccacuacacccagaagucccugagccugagccccgggaag

SEQ ID NO: 8267 - RNA, 642 nt, Artificial Sequence
  derived and/or modified sequence opt1 from Ofatumumab_LightChain1
gagaucgugcugacccagagccccgccacccucucccugagcccgggcgagcgcgccacgcuguccugccgggcgagccaguccgucagcuccuaccucgccugguaccagcagaagcccgggcaggcgccccgccugcugaucuacgacgccagcaaccgggccaccggcauccccgcccgcuucuccgggagcggcuccgggaccgacuucacccucacgaucagcucccuggagccggaggacuucgccguguacuacugccagcagcggagcaacuggcccaucaccuucggccagggcacccgccuggagaucaagcggaccguggccgcccccuccgucuucaucuucccgcccagcgacgagcagcucaaguccgggacggcgagcguggugugccugcugaacaacuucuacccccgcgaggccaagguccaguggaagguggacaacgcccuccaguccggcaacagccaggagagcgugaccgagcaggacuccaaggacagcaccuacucccugagcuccacccugacgcucagcaaggccgacuacgagaagcacaaggucuacgccugcgaggugacccaccaggggcuguccagccccgugaccaaguccuucaaccggggcgagugc

SEQ ID NO: 8268 - RNA, 1371 nt, Artificial Sequence
  derived and/or modified sequence opt1 from Olaratumab_HeavyChain1
cagcugcagcuccaggagagcggccccgggcuggugaagccguccgagacccugagccugaccugcacggucuccggcgggagcaucaacuccagcuccuacuacuggggcuggcuccgccagagccccgggaagggccuggaguggaucggcuccuucuucuacaccgggagcaccuacuacaaccccucccuccggagccgccugaccaucuccguggacacgagcaagaaccaguucucccugaugcucagcuccgugaccgccgccgacaccgcggucuacuacugcgcccggcagagcaccuacuacuacggcuccgggaacuacuacggcugguucgaccgcugggaccaggggacgcuggugaccgugagcagcgccuccaccaagggccccagcgucuucccgcuggcccccuccagcaaguccaccagcggcgggacggccgcgcucggcugccuggugaaggacuacuuccccgagcccgugaccgucuccuggaacagcggggcccugaccuccggcgugcacaccuucccggccgugcuccagagcuccggccuguacagccuguccagcgucgugacggugcccuccagcucccucgggacccagaccuacaucugcaacgucaaccacaagcccagcaacaccaagguggacaagcggguggagcccaaguccugcgacaagacgcacacgugcccgcccugccccgcccccgagcugcugggcgggccgagcgucuuccucuucccgcccaagcccaaggacacccugaugaucagccgcacccccgaggugaccugcguggucguggacgugucccacgaggaccccgaggucaaguucaacugguacguggacggcgucgaggugcacaacgcgaagaccaagccccgggaggagcaguacaacagcaccuaccgcguggucuccgugcugaccgugcuccaccaggacuggcugaacgggaaggaguacaagugcaaggucagcaacaaggcccugcccgccccgaucgagaagacgaucuccaaggccaagggccagccccgggagccccagguguacacccucccgcccagccgcgaggagaugaccaagaaccaggugucccugaccugccuggucaagggcuucuaccccagcgacaucgccguggagugggaguccaacgggcagcccgagaacaacuacaagacgaccccgcccgugcucgacagcgacggcuccuucuuccuguacagcaagcugaccgucgacaagucccgguggcagcaggggaacguguucagcugcuccgugaugcacgaggcgcuccacaaccacuacacccagaagucccugagccugagccccggcaag

SEQ ID NO: 8269 - RNA, 642 nt, Artificial Sequence
  derived and/or modified sequence opt1 from Olaratumab_LightChain1
gagaucgugcugacccagagccccgccacccucucccugagccccggcgagcgcgccacgcuguccugccgggcgagccaguccgucagcuccuaccucgccugguaccagcagaagcccgggcaggcgccccgccugcugaucuacgacgccagcaaccgggccaccggcauccccgcccgcuucuccgggagcggcuccgggaccgacuucacccucacgaucagcucccuggagccggaggacuucgccguguacuacugccagcagcggagcaacuggccgcccgccuucggccagggcaccaagguggagaucaagcgcaccgucgccgcgcccuccguguucaucuucccgcccagcgacgagcagcugaaguccgggaccgccagcguggucugccuccugaacaacuucuacccccgggaggccaaggugcaguggaagguggacaacgcccugcaguccggcaacagccaggagagcgucacggagcaggacuccaaggacagcaccuacucccucagcuccacccugacccugagcaaggccgacuacgagaagcacaagguguacgcgugcgaggugacgcaccaggggcucuccagccccgucaccaaguccuucaaccgcggcgagugc

SEQ ID NO: 8270 - RNA, 1341 nt, Artificial Sequence
  derived and/or modified sequence opt1 from Olizuab_HeavyChain1
gaggugcagcuggucgagagcggcgggggccucgugcagcccgggggcucccugcgccugagcugcgccguguccggguacagcaucaccuccggcuacagcuggaacuggauccggcaggccccgggcaaggggcucgagugggucgcguccaucaccuacgacggcagcaccaacuacaaccccuccgugaaggggcgcaucaccaucagccgggacgacuccaagaacaccuucuaccugcagaacagccugcgcgccgaggacaccgccguguacuacugcgcccggggcucccacuacuucgggcacuggcacuucgccgucuggggccagggcacgcucgugaccgugagcuccgcgagcaccaaggggcccuccgucuucccccuggccccgagcuccaagagcaccagcggcgggacggccgcccugggcugccucgugaaggacuacuuccccgagcccgugaccgucuccuggaacagcggcgcgcugaccuccggggugcacaccuuccccgccgugcugcagagcuccggccucuacagccuguccagcgucgugacggugccguccagcucccuggggacccagaccuacaucugcaacgucaaccacaagcccagcaacaccaagguggacaagaagguggagcccaaguccugcgacaagacgcacacgugcccgcccugccccgcccccgagcuccugggcgggcccagcgucuuccuguucccgcccaagcccaaggacacccucaucucccgcacccccgaggugaccugcguggucguggacgucagccacgaggacccggaggugaaguucaacugguacguggacggcgucgaggugcacaacgccaagaccaagccccgggaggagcaguacaacuccaccuaccgcguggucagcgugcugaccgugcugcaccaggacuggcucaacggcaaggaguacaagugcaaggucuccaacaaggcccugcccgcgcccaucgagaagacgaucagcaaggccaaggggcagccgcgggagccccagguguacacccugccgcccagccgcgaggagaccaagaaccaggugucccugaccugccucgucaagggcuucuaccccagcgacaucgccguggagugggaguccaacgggcagcccgagaacaacuacaagacgacgcccccggugcuggacagcgacggcuccuucuuccucuacagcaagcugaccgucgacaagucccgguggcagcaggggaacguguucagcugcuccgugcacgaggcccugcacaaccacuacacccagaagucccucagccugagccccggcaag

SEQ ID NO: 8271 - RNA, 651 nt, Artificial Sequence
  derived and/or modified sequence opt1 from Olizuab_LightChain1
gacauccagcugacccagagccccuccagccucuccgccagcgugggcgaccgggucaccaucacgugccgggccucccagagcguggacuacgacggggacuccuacaacugguaccagcagaagccgggcaaggcgcccaagcugcugaucuacgccgccagcuaccucgaguccggggugcccagccgcuucuccggcagcggguccggcaccgacuucacccugaccaucagcucccugcagcccgaggacuucgccacguacuacugccagcagagccacgaggacccguacaccuucggccaggggaccaaggucgagaucaagcggaccguggccgcgcccuccguguucaucuucccgcccagcgacgagcagcucaaguccggcacggccagcgucgugugccugcugaacaacuucuacccccgcgaggccaaggugcaguggaaggucgacaacgcccuccagagcgggaacucccaggagagcgugaccgagcaggacuccaaggacagcaccuacucccugagcuccacccugacgcucagcaaggcggacuacgagaagcacaagguguacgccugcgaggucacccaccagggccuguccagccccgugaccaaguccuucaaccgcggggagugc

SEQ ID NO: 8272 - RNA, 1341 nt, Artificial Sequence
  derived and/or modified sequence opt1 from Olokizumab_HeavyChain1
gaggugcagcuggucgagagcggcgggggccucgugcagcccgggggcucccugcgccugagcugcgccgccuccggguucaacuucaacgacuacuucaugaacugggugcggcaggcgcccggcaagggccucgagugggucgcccagaugcgcaacaagaacuaccaguacgggaccuacuacgccgagagccuggagggccgguucaccaucucccgcgacgacagcaagaacucccuguaccuccagaugaacagccugaagacggaggacaccgccguguacuacugcgcccgggaguccuacuacggguucaccagcuacuggggccaggggacccuggugacggucuccagcgcguccaccaagggccccagcguguucccccucgcccccugcucccgcagcaccuccgagagcaccgccgcccugggcugccuggugaaggacuacuucccggagcccgucacgguguccuggaacagcggggcgcucaccagcggcgugcacaccuuccccgccguccugcaguccagcgggcuguacucccucagcuccguggugaccguccccagcuccagccugggcacgaagaccuacacgugcaacguggaccacaagccguccaacaccaagguggacaagcgggucgagagcaaguacggcccgcccugcccgcccugccccgcccccgaguuccucgggggccccuccguguuccuguucccgcccaagcccaaggacacccugaugaucagccgcacccccgaggugaccugcgucgugguggacgucucccaggaggacccggaggugcaguucaacugguacgucgacgggguggaggugcacaacgccaagaccaagccccgggaggagcaguucaacagcacguaccgcgucguguccgugcugaccguccuccaccaggacuggcugaacggcaaggaguacaagugcaaggugagcaacaaggggcugcccuccagcaucgagaagaccaucuccaaggccaagggccagccccgggagccccagguguacacccucccgcccagccaggaggagaugacgaagaaccaggucagccugaccugccuggugaagggcuucuaccccuccgacaucgcgguggagugggagagcaacgggcagcccgagaacaacuacaagaccaccccgcccguccucgacuccgacggcagcuucuuccuguacucccgccugacgguggacaagagccgguggcaggaggggaacguguucuccugcagcgucaugcacgaggcccuccacaaccacuacacccagaagucccugagccugucccucggcaag

SEQ ID NO: 8273 - RNA, 642 nt, Artificial Sequence
  derived and/or modified sequence opt1 from Olokizumab_LightChain1
gacauccagaugacccagagccccuccagccuguccgccagcgugggcgaccgcgucaccaucacgugccaggccucccaggacaucgggaucagccucuccugguaccagcagaagccgggcaaggcgcccaagcugcugaucuacaacgccaacaaccucgccgacggggugcccagccgguucuccggcagcggguccggcaccgacuucacccugaccaucagcucccugcagcccgaggacuucgccacguacuacugccuccagcacaacagcgccccguacaccuucggccaggggaccaagcuggagaucaagcgcaccguggcggcccccuccgucuucaucuucccgcccagcgacgagcagcugaaguccggcacggccagcguggugugccuccugaacaacuucuacccccgggaggccaagguccaguggaagguggacaacgcgcugcaguccgggaacagccaggagagcgugaccgagcaggacuccaaggacagcaccuacucccucagcuccacccugacgcugagcaaggccgacuacgagaagcacaaggucuacgccugcgaggugacccaccagggccucuccagccccgugaccaaguccuucaaccgcggggagugc

SEQ ID NO: 8274 - RNA, 1341 nt, Artificial Sequence
  derived and/or modified sequence opt1 from Omalizumab_HeavyChain
gaggugcagcuggucgagagcggcgggggccucgugcagcccgggggcucccugcgccugagcugcgccguguccggguacagcaucaccuccggcuacagcuggaacuggauccggcaggccccgggcaaggggcucgagugggucgcguccaucaccuacgacggcagcacgaacuacgccgacuccgugaaggggcgcuucaccaucagccgggacgacuccaagaacaccuucuaccugcagaugaacagccugcgcgccgaggacaccgccguguacuacugcgcccggggcucccacuacuucgggcacuggcacuucgcggucuggggccagggcacgcucgugaccgugagcuccgggcccagcgucuucccccuggcccccuccagcaaguccaccagcggcgggaccgccgcccugggcugccucgugaaggacuacuucccggagcccgugacggucagcuggaacuccggcgcgcugaccagcggggugcacaccuuccccgccgugcugcaguccagcggccucuacucccugagcuccgucgugaccgugcccagcuccagccuggggacgcagaccuacaucugcaacgucaaccacaagccguccaacaccaagguggacaagaaggccgagcccaagagcugcgacaagacccacacgugcccgcccugccccgcccccgagcuccugggcgggcccuccguguuccuguucccgcccaagcccaaggacacccucaugaucagccgcacccccgaggugaccugcgucguggucgacgugucccacgaggaccccgaggucaaguucaacugguacguggacggcguggagguccacaacgccaagacgaagccgcgggaggagcaguacaacagcaccuaccgcgugguguccguccugaccgugcugcaccaggacuggcucaacggcaaggaguacaagugcaaggugagcaacaaggcgcugcccgcccccaucgagaagaccaucuccaaggccaaggggcagccccgggagccgcaggucuacacgcugccgcccagccgcgacgagcucaccaagaaccaggugagccugaccugccuggugaagggcuucuaccccuccgacaucgccgucgagugggagagcaacgggcagcccgagaacaacuacaagaccacgccgcccgugcucgacuccgacggcagcuucuuccuguacuccaagcugaccguggacaagagccgguggcagcaggggaacgucuucuccugcagcgugaugcacgaggcccuccacaaccacuacacccagaagucccugagccugucccccggcaag

SEQ ID NO: 8275 - RNA, 645 nt, Artificial Sequence
  derived and/or modified sequence opt1 from Omalizumab_LightChain
gacauccagcugacccagagccccuccagccucuccgccagcgugggcgaccgcgucaccaucacgugccgggccucccagagcguggacuacgacggggacuccuacaugaacugguaccagcagaagccgggcaaggcgcccaagcugcugaucuacgccgccagcuaccucgaguccggggugcccagccgcuucuccggcagcggguccggcaccgacuucacccugaccaucagcucccugcagcccgaggacuucgccacguacuacugccagcagagccacgaggacccguacaccuucggccaggggaccaaggucgagaucaagcggaccguggccgcgcccuccguguucaucuucccgcccagcgacgagcagcucaaguccggcacggccagcgucgugugccugcugaacaacuucuacccccgcgaggccaaggugcaguggaaggucgacaacgcccuccagagcgggaacucccaggagagcgugaccgagcaggacuccaaggacagcaccuacucccugagcuccacccugacgcucagcaaggcggacuacgagaagcacaagguguacgccugcgaggucacccaccagggccuguccagccccgugaccaaguccuucaaccgg

SEQ ID NO: 8276 - RNA, 1347 nt, Artificial Sequence
  derived and/or modified sequence opt1 from Onartuzumab_HeavyChain1
gaggugcagcuggucgagagcggcgggggccucgugcagcccgggggcucccugcgccugagcugcgccgccuccggguacaccuucaccagcuacuggcuccacugggugcggcaggcgcccggcaagggccuggagugggucgggaugaucgaccccuccaacagcgacacgcgcuucaaccccaacuucaaggaccgguucaccaucuccgccgacaccagcaagaacaccgccuaccugcagaugaacucccuccgcgccgaggacacggccguguacuacugcgcgaccuaccggagcuacgugacgccccuggacuacuggggccaggggacccuggucaccguguccagcgccuccaccaagggcccgagcguguucccccucgcccccuccagcaaguccaccagcgggggcaccgccgcgcugggcugccuggucaaggacuacuuccccgagccggugacgguguccuggaacagcggggcccucaccagcggcguccacaccuuccccgccgugcugcaguccagcgggcuguacucccucagcuccguggucaccgugcccagcuccagccugggcacgcagaccuacaucugcaacgugaaccacaagcccuccaacaccaaggucgacaagaagguggagcccaagagcugcgacaagacccacacgugcccgcccugccccgccccggagcugcucggcgggcccuccguguuccuguucccgcccaagcccaaggacacccugaugaucagccgcacccccgaggugaccugcgucguggucgacgugucccacgaggaccccgaggucaaguucaacugguacguggacggcguggagguccacaacgccaagacgaagccccgggaggagcaguacaacagcaccuaccgcgugguguccguccucaccgugcugcaccaggacuggcugaacgggaaggaguacaagugcaaggugagcaacaaggcgcucccggcccccaucgagaagaccaucuccaaggccaagggccagccccgggagccccaggucuacacgcugccgcccagccgcgaggagaugaccaagaaccaggugucccugagcugcgccgugaagggguucuaccccagcgacaucgccgucgagugggaguccaacggccagccggagaacaacuacaagaccaccccgcccgugcucgacagcgacggcuccuucuuccuggugagcaagcugacggucgacaagucccgguggcagcaggggaacguguucagcugcuccgugaugcacgaggcgcuccacaaccacuacacccagaagucccugagccugagccccggcaag

SEQ ID NO: 8277 - RNA, 681 nt, Artificial Sequence
  derived and/or modified sequence opt1 from Onartuzumab_HeavyChain2
gacaagacccacacgugcccgcccugccccgcccccgagcugcucggcgggcccagcguguuccuguucccgcccaagcccaaggacacccugaugaucucccgcacccccgaggugaccugcgucguggucgacgugagccacgaggacccggaggugaaguucaacugguacgucgacggcguggaggugcacaacgccaagaccaagccccgggaggagcaguacaacuccacguaccgcgucgugagcgugcucaccguccugcaccaggacuggcugaacgggaaggaguacaagugcaagguguccaacaaggcgcuccccgcccccaucgagaagaccaucagcaaggccaagggccagccgcgggagccccagguguacacccugccgcccucccgcgaggagaugacgaagaaccaggucagccuguggugccucgugaagggguucuaccccuccgacaucgccguggagugggagagcaacggccagcccgagaacaacuacaagaccaccccgcccguccuggacuccgacggcagcuucuuccuguacuccaagcucaccguggacaagagccgguggcagcaggggaacguguucuccugcagcgucaugcacgaggcccugcacaaccacuacacgcagaagucccugagccucucccccggcaag

SEQ ID NO: 8278 - RNA, 660 nt, Artificial Sequence
  derived and/or modified sequence opt1 from Onartuzumab_LightChain1
gacauccagaugacgcagagccccuccagccuguccgccagcgugggcgaccgcgucaccaucacgugcaaguccagccagucccuccuguacaccagcucccagaagaacuaccuggccugguaccagcagaagccggggaaggcgcccaagcuccugaucuacugggccagcacccgggaguccggcgugcccagccgcuucuccgggagcggcuccgggaccgacuucacgcugaccaucagcucccuccagcccgaggacuucgccaccuacuacugccagcaguacuacgccuacccguggaccuucggccagggcacgaagguggagaucaagcggaccgucgccgcgcccagcguguucaucuucccgcccuccgacgagcagcucaagagcgggaccgccagcguggucugccugcugaacaacuucuacccccgcgaggccaaggugcaguggaagguggacaacgcccugcaguccggcaacagccaggaguccgucaccgagcaggacagcaaggacuccacguacagccuguccagcacccucacccuguccaaggcggacuacgagaagcacaagguguacgccugcgaggugacccaccaggggcugagcucccccgucaccaagagcuucaaccggggcgagugc

SEQ ID NO: 8279 - RNA, 1362 nt, Artificial Sequence
  derived and/or modified sequence opt1 from Ontuxizumab_HeavyChain1
caggugcagcugcaggagagcggccccgggcucguccgcccgucccagacccugagccugaccugcacggccuccggcuacaccuucaccgacuacgugauccacugggugaagcagccgcccgggcggggccucgaguggaucggguacaucaaccccuacgacgacgacaccacguacaaccagaaguucaagggccgcgucaccaugcugguggacaccagcuccaacaccgccuaccugcggcucagcuccgugacggcggaggacaccgccgucuacuacugcgcccgccggggcaacagcuacgacggguacuucgacuacuccauggacuacuggggcagcgggaccccggugaccguguccagcgccuccacgaagggccccagcgucuucccccuggcccccuccagcaaguccaccagcgggggcaccgcggcccugggcugccucgugaaggacuacuucccggagcccgugaccgucuccuggaacagcggggcccugacgagcggcgugcacaccuuccccgccgugcugcaguccagcgggcucuacucccugagcuccgucgugaccgugcccagcuccagccugggcacccagacguacaucugcaacgucaaccacaagccguccaacaccaagguggacaagaagguggagcccaagagcugcgacaagacccacacgugcccgcccugccccgcgcccgagcuccugggcgggcccuccgucuuccuguucccgcccaagcccaaggacacccucaugaucagccgcacccccgaggugaccugcguggucguggacgucucccacgaggaccccgaggugaaguucaacugguacguggacggcgucgaggugcacaacgccaagaccaagccgcgggaggagcaguacaacagcacguaccgcguggucuccgugcugaccgugcugcaccaggacuggcucaacgggaaggaguacaagugcaaggucagcaacaaggcccugcccgcccccaucgagaagaccaucuccaaggccaagggccagccccgggagccccagguguacacccugccgcccagccgcgacgagcucacgaagaaccaggugucccugaccugccuggucaagggguucuaccccagcgacaucgcgguggagugggagagcaacggccagcccgagaacaacuacaagaccaccccgcccgugcucgacuccgacggcuucuucuuccuguacagcaagcugacggucgacaagucccgguggcagcaggggaacguguucagcugcuccgugaugcacgaggcccuccacaaccacuacacccagaagucccugagccugagccccggcaag

SEQ ID NO: 8280 - RNA, 645 nt, Artificial Sequence
  derived and/or modified sequence opt1 from Ontuxizumab_LightChain1
gacauccagaugacccagagccccuccagccuguccgccagcgugggcgaccgcgucaccaucacgugccgggccucccagaacguggggaccgcgguggccuggcuccagcagaccccgggcaaggcccccaagcugcugaucuacagcgccuccaaccgcuacaccgggguccccagccgguucuccggcagcggguccggcacggacuacaccuucaccaucagcucccuccagcccgaggacaucgccaccuacuacugccagcaguacacgaacuacccgauguacaccuucggccaggggaccaaggugcagaucaagcgcaccguggcggcccccagcgucuucaucuucccgcccuccgacgagcagcucaagagcggcacggccuccguggugugccugcugaacaacuucuacccccgggaggccaagguccaguggaagguggacaacgcgcugcagagcgggaacucccaggagagcgugaccgagcaggacagcaaggacuccaccuacagccuguccagcacccucacgcuguccaaggccgacuacgagaagcacaaggucuacgccugcgaggugacccaccagggccugagcucccccgugaccaagagcuucaaccgcggggagugc

SEQ ID NO: 8281 - RNA, 1341 nt, Artificial Sequence
  derived and/or modified sequence opt1 from Opicinumab_HeavyChain1
gaggugcagcugcucgagagcggcgggggccugguccagcccgggggcucccugcgccucagcugcgccgccuccggguucaccuucagcgcguacgagaugaagugggugcggcaggccccgggcaagggccuggaguggguguccgucaucgggcccagcggcggguucaccuucuacgccgacuccgugaagggccgcuucaccaucagccgggacaacuccaagaacacccuguaccuccagaugaacagccugcgcgccgaggacaccgccguguacuacugcgcgaccgagggggacaacgacgccuucgacaucuggggccagggcacgaccgucaccguguccagcgccuccaccaaggggcccagcguguucccccuggccccguccagcaaguccacgagcggcgggaccgcggcccucggcugccuggucaaggacuacuuccccgagcccgugaccguguccuggaacagcggcgcccugaccagcgggguccacacguuccccgccgugcuccaguccagcggccuguacucccugagcuccguggucaccgugccgagcuccagccucgggacccagaccuacaucugcaacgugaaccacaagcccuccaacacgaaggucgacaagaagguggagcccaagagcugcgacaagacccacacgugcccgcccugccccgcccccgagcugcugggcgggcccuccguguuccucuucccgcccaagcccaaggacacccugaugaucagccggacccccgaggugaccugcgucguggucgacgugucccacgaggacccggaggucaaguucaacugguacguggacggcguggagguccacaacgcgaagaccaagccccgcgaggagcaguacaacagcgccuaccgggugguguccguccugaccgugcuccaccaggacuggcugaacggcaaggaguacaagugcaaggugagcaacaaggcccugcccgcccccaucgagaagacgaucuccaaggccaaggggcagccgcgcgagccccaggucuacacccucccgcccagccgggacgagcugaccaagaaccaggugucccugaccugccucgugaagggcuucuaccccagcgacaucgcggucgagugggagagcaacgggcagcccgagaacaacuacaagacgacgcccccggugcuggacuccgacggcagcuucuuccuguacuccaagcucaccguggacaagagccgcuggcagcaggggaacgucuucuccugcagcgugaugcacgaggcccugcacaaccacuacacccagaagucccugagccucucccccggc

SEQ ID NO: 8282 - RNA, 645 nt, Artificial Sequence
  derived and/or modified sequence opt1 from Opicinumab_LightChain1
gacauccagaugacccagagccccgccacccugucccucagcccgggcgagcgcgccacgcuguccugccgggcgagccaguccgugagcuccuaccuggccugguaccagcagaagcccgggcaggcgccccgccuccugaucuacgacgccagcaaccgggccaccggcauccccgcccgcuucuccgggagcggcuccgggaccgacuucacccugacgaucagcucccucgagccggaggacuucgccgucuacuacugccagcagcggagcaacuggcccauguacaccuucggccagggcaccaagcuggagaucaagcgcaccguggccgcccccuccguguucaucuucccgcccagcgacgagcagcugaaguccgggacggcgagcgucgugugccuccugaacaacuucuacccccgggaggccaaggugcaguggaaggucgacaacgcccugcaguccggcaacagccaggagagcgugaccgagcaggacuccaaggacagcaccuacucccucagcuccacccugacgcugagcaaggccgacuacgagaagcacaagguguacgccugcgaggucacccaccaggggcucuccagccccgugaccaaguccuucaaccgcggcgagugc

SEQ ID NO: 8283 - RNA, 1941 nt, Artificial Sequence
  derived and/or modified sequence opt1 from Oportuzumab_monatox_HeavyChain1
caccaccaccaccaccacgacauccagaugacccagagccccuccagccuguccgccagcgugggcgaccgcgugaccaucacgugccgguccaccaagagccuccugcacuccaacgggaucaccuaccuguacugguaccagcagaagcccggcaaggcccccaagcuccugaucuaccagaugagcaaccuggcguccggggugcccagccgcuucuccagcuccggcagcgggaccgacuucacgcucaccaucuccagccugcagcccgaggacuucgccaccuacuacugcgcccagaaccuggagaucccgcggaccuucggccagggcacgaagguggagcucaagcgcgccacccccucccacaacagccaccagguccccuccgccgggggccccaccgcgaacagcgggaccagcggcuccgaggugcagcuggugcagagcgggccgggccugguccagcccggcggguccgugcggaucagcugcgccgccuccggcuacacguucaccaacuacgggaugaacugggugaagcaggcccccggcaagggccucgaguggaugggguggaucaacaccuacaccggcgagagcacguacgcggacuccuucaaggggcgcuucaccuucagccuggacaccuccgccagcgccgccuaccugcagaucaacucccuccgggccgaggacaccgcggucuacuacugcgcccgcuucgccaucaagggcgacuacugggggcagggcacgcugcugaccgugagcuccgaguucggcggggcccccgaguucccgaagcccagcaccccgcccggcuccagcgggcucgagggcgggucccuggccgcgcugaccgcccaccaggccugccaccucccccuggagacguucacccggcaccgccagccccggggcugggagcagcuggagcagugcggcuaccccgugcagcgccucgucgcccuguaccuggccgcgcggcucagcuggaaccagguggaccaggugauccgcaacgcccuggccucccccgggagcggcggggaccugggcgaggccauccgggagcagccggagcaggcccgccucgcgcugacccuggccgccgccgagagcgagcgguucguccgccaggggaccggcaacgacgaggcgggcgccgccuccgccgacguggugagccucacgugccccgucgccgcgggggagugcgccggccccgccgacuccggggacgcccugcuggagcggaacuaccccaccggcgccgaguuccucggcgacgggggcgacgugagcuucuccacccgcgggacccagaacuggacgguggagcggcugcugcaggcgcaccgccagcucgaggagcgcggcuacgucuucgugggguaccacggcaccuuccuggaggccgcccagagcaucguguucggcgggguccgggcccgcucccaggaccuggacgccaucuggcggggcuucuacaucgcgggggacccggcccucgccuacggcuacgcccaggaccaggagcccgacgcgcgcgggcggauccgcaacggcgcccugcugcggguguacgucccccgcagcucccuccccggcuucuaccggaccgggcugacccuggccgccccggaggccgcgggcgagguggagcgccucaucgggcacccccugccccugcggcuggacgccaucacgggcccggaggaggagggcgggcgccucgagaccauccugggcuggccccuggccgagcggaccguggucauccccagcgccauccccaccgacccgcgcaacgucgggggcgaccucgaccccuccagcauccccgacaaggagcaggccaucuccgcgcugcccgacuacgccagccagccggggaagccgccccaccaccaccaccaccacaaggacgagcug

SEQ ID NO: 8284 - RNA, 1941 nt, Artificial Sequence; identical to SEQ ID NO: 8283
  derived and/or modified sequence opt1 from Oportuzumab_monatox_SingleChain_variable_fragment

SEQ ID NO: 8285 - RNA, 762 nt, Artificial Sequence
  derived and/or modified sequence opt1 from Oreptacog_alfa_HeavyChain1
aucgugggcgggaaggucugccccaagggcgagugcccguggcagguccugcuccuggugaacggggcccagcugugcggcgggacccucaucaacaccaucuggguggugagcgccgcgcacugcuucgacaagaucaagaacuggcgcaaccugaucgccgugcugggcgagcacgaccucuccgagcacgacggcgacgagcagagccggcgcgucgcccaggugaucauccccuccacguacgugcccgggaccaccaaccacgacaucgcccugcugcggcuccaccagcccgucaaccugaccgaccacguggugccgcugugccuccccgagcgcacguucagcgagcggacccuggccuucguccgcuucucccuggugagcggcugggggcagcuccuggaccggggcgcgaccgcccuggagcucauggugcugaacgucccccgccugaugacccaggacugccuccagcagucccggaaggugggggacagccccaacaucacggaguacauguucugcgccggcuacuccgacggcagcaaggacuccugcaagggggacagcggcgggccgcacgccacccacuaccgcggcaccugguaccugaccggcaucguguccugggggcagggcugcgcgacggucgggcacuucggcguguacacccgggugagccaguacaucgaguggcugcagaagcucaugcgcuccgagccccggcccgggguccugcugcgcgcccccuucccg

SEQ ID NO: 8286 - RNA, 456 nt, Artificial Sequence
  derived and/or modified sequence opt1 from Oreptacog_alfa_LightChain1
gccaacgccuuccuggaggagcuccgccagggcagccuggagcgggagugcaaggaggagcagugcuccuucgaggaggcgcgcgagaucuucgaggacgaggaggagaccaagcuguucuggaucagcuacuccgacggggaccagugcgccagcucccccugccagaacggcgggagcugcaaggaccagcuccaguccuacaucugcuucugccugccggccuucgagggccggaacugcgagacccacaaggacgaccagcugaucugcgugaacgagaacgggggcugcgagcaguacugcagcgaccacaacggcacgaagcgcuccugccggugccacgagggguacagccuccuggccgacggcgucuccugcacccccaccguggaguaccccugcgggaagauccccauccuggagaagcgcaacgccagcaagccgcagggccgg

SEQ ID NO: 8287 - RNA, 1353 nt, Artificial Sequence
  derived and/or modified sequence opt1 from Orticumab_HeavyChain1
gaggugcagcugcucgagagcggcgggggccugguccagcccgggggcucccugcgccucagcugcgccgccuccggguucaccuucagcaacgcguggauguccugggugcggcaggccccgggcaagggccuggagugggugagcuccaucagcgucgggggccaccgcaccuacuacgccgacuccgugaaggggcggagcacgaucucccgcgacaacagcaagaacacccuguaccuccagaugaacucccugcgggccgaggacaccgccguguacuacugcgcgcgcauccgggucggccccagcgggggcgccuucgacuacuggggccaggggacccuggugacgguguccagcgccuccaccaagggccccagcgucuucccccucgccccguccagcaagagcaccuccgggggcaccgcggcccugggcugccuggugaaggacuacuuccccgagcccgugacggucagcuggaacuccggggcccucaccagcggcgugcacaccuuccccgccgugcugcaguccagcgggcuguacucccucagcuccgucgugaccgugccgagcuccagccugggcacgcagaccuacaucugcaacgucaaccacaagcccuccaacaccaagguggacaagaagguggagcccaagagcugcgacaagacccacacgugcccgcccugccccgcccccgagcugcucgggggccccuccgucuuccuguucccgcccaagcccaaggacacccugaugaucagccgcacccccgaggugaccugcguggucguggacgucucccacgaggacccggaggugaaguucaacugguacguggacggcgucgaggugcacaacgcgaagacgaagccccgggaggagcaguacaacagcaccuaccgcguggucuccgugcucaccgugcugcaccaggacuggcugaacgggaaggaguacaagugcaaggucagcaacaaggcccuccccgcccccaucgagaagaccaucagcaaggccaagggccagccgcgggagccccagguguacacgcugccgcccucccgcgacgagcugaccaagaaccaggugagccugaccugccucgucaagggguucuaccccuccgacaucgccguggagugggagagcaacggccagcccgagaacaacuacaagaccacgcccccggugcuggacuccgacgggagcuucuuccucuacuccaagcugaccgucgacaagagccgguggcagcagggcaacguguucuccugcagcgugaugcacgaggcgcugcacaaccacuacacccagaagucccucagccugucccccggcaag

SEQ ID NO: 8288 - RNA, 648 nt, Artificial Sequence
  derived and/or modified sequence opt1 from Orticumab_LightChain1
cagagcgugcugacccagcccccguccgccagcggcacccccgggcagcgcgucacgaucuccugcagcggcuccaacaccaacaucgggaagaacuacgugagcugguaccagcagcuccccggcaccgcccccaagcugcugaucuacgcgaacuccaaccggccgagcggggugcccgaccgcuucuccggcagcaaguccggcaccagcgccucccucgccaucagcgggcugcgguccgaggacgaggccgacuacuacugcgccagcugggacgcgucccugaacggcugggucuucgggggcgggacgaagcucaccgugcugggccagcccaaggccgcccccagcgugacccuguucccgcccuccagcgaggagcuccaggccaacaaggcgacccuggucugccugaucagcgacuucuaccccggcgccgugacgguggccuggaaggccgacuccagccccgucaaggccgggguggagaccaccaccccguccaagcagagcaacaacaaguacgcggccuccagcuaccucucccugacgcccgagcaguggaagucccaccgcagcuacagcugccaggugacccacgagggcuccaccgucgagaagaccguggcccccacggagugcagc

SEQ ID NO: 8289 - RNA, 1347 nt, Artificial Sequence
  derived and/or modified sequence opt1 from Otelixizumab_HeavyChain1
gaggugcagcugcucgagagcggcgggggccugguccagcccgggggcucccugcgccucagcugcgccgccuccggguucaccuucagcuccuucccgauggcgugggugcggcaggcccccggcaagggccuggagugggugagcaccaucuccacgagcgggggccgcaccuacuaccgggacuccgucaaggggcgcuucaccaucagccgggacaacuccaagaacacccuguaccuccagaugaacagccugcgcgccgaggacacggccguguacuacugcgccaaguuccggcaguacuccggcggguucgacuacuggggccagggcacccuggugaccgucagcuccgcgagcaccaaggggcccuccguguucccccucgccccgagcuccaagagcacgagcggcgggaccgccgcccugggcugccuggugaaggacuacuuccccgagcccgucaccguguccuggaacagcggcgcgcucaccuccggggugcacacguuccccgccguccugcagagcuccggccuguacagccucuccagcguggugaccgucccguccagcucccuggggacccagaccuacaucugcaacgugaaccacaagcccagcaacacgaagguggacaagaaggucgagcccaaguccugcgacaagacccacacgugcccgcccugccccgcccccgagcugcucggcgggcccagcguguuccuguucccgcccaagcccaaggacacccugaugaucucccgcacccccgaggugaccugcgucgugguggacgucagccacgaggacccggaggugaaguucaacugguacgucgacggcguggaggugcacaacgccaagaccaagccccgggaggagcaguacgccuccaccuaccgcgucgugagcgugcucacgguccugcaccaggacuggcugaacggcaaggaguacaagugcaagguguccaacaaggcgcuccccgcccccaucgagaagaccaucagcaaggccaaggggcagccgcgggagccccagguguacacccugccgcccagccgcgacgagcugaccaagaaccaggucucccucacgugccuggugaagggcuucuaccccagcgacaucgccguggagugggaguccaacgggcagcccgagaacaacuacaagaccacgcccccgguccuggacagcgacggcuccuucuuccucuacagcaagcugaccguggacaagucccgguggcagcaggggaacguguucagcugcuccgucaugcacgaggcccugcacaaccacuacacccagaagucccucagccugagccccggcaag

SEQ ID NO: 8290 - RNA, 648 nt, Artificial Sequence
  derived and/or modified sequence opt1 from Otelixizumab_LightChain1
gacauccagcugacccagcccaacagcguguccaccagccucggcuccacggucaagcugagcugcacccuguccagcgggaacaucgagaacaacuacgugcacugguaccagcucuacgagggccgcuccccgaccaccaugaucuacgacgacgacaagcggcccgacggggugcccgaccgcuucagcggcuccaucgaccggagcuccaacagcgccuuccugacgauccacaacgucgccaucgaggacgaggcgaucuacuucugccacuccuacgugagcuccuucaacguguucgggggcggcaccaagcugaccguccuccgccagcccaaggccgccccgagcgugacccuguucccgcccuccagcgaggagcugcaggccaacaaggccacgcucgugugccugaucuccgacuucuaccccggggcggucaccguggccuggaaggccgacagcagccccgugaaggccggcgucgagaccaccacgcccuccaagcagagcaacaacaaguacgcggccuccagcuaccugucccucacccccgagcaguggaagucccaccggagcuacagcugccaggugacccacgagggguccaccguggagaagacggucgcccccaccgagugcagc

SEQ ID NO: 8291 - RNA, 1449 nt, Artificial Sequence
  derived and/or modified sequence opt1 from Otlertuzumab_HeavyChain1
gaggugcagcugguccagagcggcgccgaggugaagaagcccggggagucccucaagaucagcugcaagggcuccggguacagcuucaccggcuacaacaugaacugggugcgccagaugccggggaagggccuggaguggaugggcaacaucgaccccuacuacgggggcaccacguacaaccggaaguucaaggggcaggucaccaucuccgccgacaagagcaucuccaccgcguaccugcaguggagcucccucaaggccagcgacaccgccauguacuacugcgcccgcuccgugggccccuucgacagcugggggcagggcacgcuggugaccgucuccagcggcgggggcggguccggcggcgggggcagcgggggcgggggcuccggcgggggcgggagcggcgggggcggcuccgagaucgugcugacccagagccccgccacccucagccuguccccgggggagcgggcgacgcugagcugccgcgccuccgagaacguguacagcuaccucgccugguaccagcagaagcccggccaggcgccccggcugcugaucuacuucgccaagacccucgccgaggggauccccgcccgcuucuccggcagcggguccggcaccgacuucacccugacgaucagcucccuggagccggaggacuucgccgucuacuacugccagcaccacagcgacaaccccuggaccuucggccaggggaccaagguggagaucaagggcgaccaggagcccaaguccagcgacaagacccacacgagcccgcccugccccgcccccgagcuccucgggggccccagcguguuccuguucccgcccaagcccaaggacacccugaugaucucccggacccccgaggugaccugcgucguggucgacgugagccacgaggacccggaggugaaguucaacugguacgucgacggcguggaggugcacaacgcgaagacgaagccccgcgaggagcaguacaacuccaccuaccgggucgugagcgugcugaccguccugcaccaggacuggcucaacgggaaggaguacaagugcaagguguccaacaaggcccugcccgcccccaucgagaagaccaucagcaaggccaagggccagccgcgcgagccccaggucuacacgcugccgcccagccgggacgagcucaccaagaaccaggugucccugaccugccuggugaagggguucuaccccagcgacaucgccgucgagugggaguccaacggccagcccgagaacaacuacaagaccacgcccccggugcucgacagcgacggguccuucuuccuguacagcaagcugaccguggacaagucccgcuggcagcagggcaacgucuucagcugcuccgugaugcacgaggcgcuccacaaccacuacacccagaagucccugucccugagccccggcaag

SEQ ID NO: 8292 - RNA, 1347 nt, Artificial Sequence
  derived and/or modified sequence opt1 from Oxelumab_HeavyChain1
gaggugcagcugcucgagagcggcgggggccugguccagcccgggggcucccugcgccucagcugcgccgccuccggguucaccuucaacagcuacgcgauguccugggugcggcaggccccgggcaagggccuggagugggugagcaucaucuccgggagcggcggguucaccuacuacgccgacuccgucaagggccgcuucaccaucagccgggacaacucccgcaccacccuguaccuccagaugaacagccugcgggccgaggacaccgccguguacuacugcgcgaaggaccgccugguggcccccgggacguucgacuacuggggccagggcgcccucgucaccguguccagcgccuccaccaaggggcccagcguguucccccuggcgccguccagcaaguccaccagcggcgggacggccgcccugggcugccucgucaaggacuacuuccccgagcccgugaccgugagcuggaacuccggcgcccugaccagcgggguccacaccuuccccgccgugcugcaguccagcggccucuacucccugagcuccguggucacggugccgagcuccagccuggggacccagaccuacaucugcaacgugaaccacaagcccuccaacaccaaggucgacaagaagguggagcccaagagcugcgacaagacgcacacgugcccgcccugccccgcgcccgagcuccugggcgggcccuccguguuccuguucccgcccaagcccaaggacacccucaugaucagccggacccccgaggugaccugcgucguggucgacgugucccacgaggacccggaggucaaguucaacugguacguggacggcguggagguccacaacgccaagaccaagccccgcgaggagcaguacaacagcaccuaccgggugguguccguccugaccgugcugcaccaggacuggcucaacggcaaggaguacaagugcaaggugagcaacaaggcccugcccgcccccaucgagaagacgaucuccaaggccaaggggcagccgcgcgagccccaggucuacacccugccgcccagccgggacgagcucaccaagaaccaggugagccugaccugccuggugaagggcuucuaccccuccgacaucgcggucgagugggagagcaacgggcagcccgagaacaacuacaagacgacgcccccggugcucgacuccgacggcagcuucuuccuguacuccaagcugaccguggacaagagccgcuggcagcaggggaacgucuucuccugcagcgugaugcacgaggcccuccacaaccacuacacccagaagucccugagccugucccccggc

SEQ ID NO: 8293 - RNA, 642 nt, Artificial Sequence
  derived and/or modified sequence opt1 from Oxelumab_LightChain1
gacauccagaugacccagagccccuccagccuguccgccagcgugggcgaccgcgucaccaucacgugccgggccucccaggggaucagcuccuggcucgcgugguaccagcagaagccggagaaggcccccaagagccugaucuacgccgccuccagccugcaguccggcgugcccagccgcuucuccgggagcggcuccgggaccgacuucacccucaccaucagcucccugcagcccgaggacuucgccacguacuacugccagcaguacaacagcuacccguacaccuucggccagggcaccaagcuggagaucaagcggaccguggcggcccccuccgucuucaucuucccgcccagcgacgagcagcucaagagcgggacggccuccguggugugccugcugaacaacuucuacccccgcgaggccaagguccaguggaagguggacaacgcgcuccagagcggcaacucccaggagagcgugaccgagcaggacuccaaggacagcaccuacucccugagcuccacccugacgcucagcaaggccgacuacgagaagcacaaggucuacgccugcgaggugacccaccaggggcuguccagccccgugaccaaguccuucaaccggggcgagugc

SEQ ID NO: 8294 - RNA, 1329 nt, Artificial Sequence
  derived and/or modified sequence opt1 from Ozanezumab_HeavyChain1
caggugcagcugguccagagcggcgccgaggugaagaagcccggggccuccgugaaggucagcugcaaggcguccggcuacaccuucaccagcuacuggaugcacugggugcgccaggccccggggcagggccucgaguggaucgggaacaucaaccccuccaacggcggcacgaacuacaacgagaaguucaagagcaaggccaccaugacccgggacaccuccacgagcaccgccuacauggagcuguccagccugcgcuccgaggacaccgccguguacuacugcgagcucaugcagggguacuggggccaggggacccuggucacggugagcuccgcgagcaccaagggccccuccguguucccccuggccccgagcuccaagagcaccuccgggggcaccgccgcccucggcugccuggucaaggacuacuuccccgagcccgugacggugagcuggaacagcggggcgcugaccuccggcguccacaccuuccccgccgugcuccagagcuccgggcuguacagccuguccagcguggucaccgugccguccagcucccucggcacgcagaccuacaucugcaacgugaaccacaagcccagcaacaccaaggucgacaagaagguggagcccaaguccugcgacaagacccacacgugcccgcccugccccgcccccgagcuggccggcgcccccagcguguuccuguucccgcccaagcccaaggacacccucaugaucucccggacccccgaggugaccugcgucguggucgacgugagccacgaggacccggaggucaaguucaacugguacguggacgggguggagguccacaacgcgaagacgaagccccgcgaggagcaguacaacuccaccuaccggguggugagcguccugaccgugcugcaccaggacuggcucaacggcaaggaguacaagugcaagguguccaacaaggcccugcccgcccccaucgagaagaccaucagcaaggccaaggggcagccgcgcgagccccaggucuacacgcugccgcccucccgggacgagcucaccaagaaccaggugagccugaccugccuggugaagggcuucuaccccagcgacaucgccgucgagugggaguccaacgggcagcccgagaacaacuacaagaccacgcccccggugcucgacagcgacggcuccuucuuccuguacagcaagcugaccguggacaagucccgcuggcagcagggcaacgucuucagcugcuccgugaugcacgaggcgcuccacaaccacuacacccagaagucccugagccugagccccgggaag

SEQ ID NO: 8295 - RNA, 657 nt, Artificial Sequence
  derived and/or modified sequence opt1 from Ozanezumab_LightChain1
gacaucgugaugacccagagcccccuguccaacccggucacccucggccagcccgugagcaucuccugccgcagcuccaagagccugcuguacaaggacgggaagacguaccucaacugguuccugcagcggcccggccagagcccccagcugcucaucuaccugauguccacccgcgccuccggggugccggaccgguucagcggcgggggcuccggcaccgacuucacccugaagaucagccgcgucgaggccgaggacguggggguguacuacugccagcagcucgucgaguacccccugacguucggccaggggaccaagcuggagaucaagcggaccguggcggcccccuccguguucaucuucccgcccagcgacgagcagcucaaguccggcaccgccagcgucgugugccugcugaacaacuucuacccccgcgaggccaaggugcaguggaaggucgacaacgcccuccaguccgggaacagccaggaguccgugacggagcaggacagcaaggacagcaccuacucccugagcuccacccugacccucagcaaggcggacuacgagaagcacaagguguacgccugcgaggucacgcaccagggccuguccagccccgugaccaaguccuucaaccggggcgagugc

SEQ ID NO: 8296 - RNA, 1089 nt, Artificial Sequence
  derived and/or modified sequence opt1 from Ozoralizumab_HeavyChain1
gaggugcagcuggucgagagcggcgggggccucgugcagcccgggggcucccugcgccugagcugcgccgccuccggguucaccuucagcgacuacuggauguacugggugcggcaggcgccgggcaagggccucgagugggucuccgagaucaacaccaacgggcugaucacgaaguaccccgacagcgugaagggccgcuucaccaucucccgggacaacgccaagaacacccuguaccuccagaugaacagccugcgccccgaggacaccgccguguacuacugcgcccggucccccagcggguucaaccgcggccaggggacgcuggucaccguguccagcggcggcgggggcuccgggggcggcagcgaggugcagcucgucgaguccgggggcgggcuggugcagccgggcaacagccugcggcucuccugcgccgcgagcggguucaccuucuccagcuucggcaugagcugggugcgccaggcccccggcaaggggcuggagugggucuccagcaucuccggcagcggguccgacacccuguacgccgacagcgugaagggccgguucacgaucucccgcgacaacgccaagaccacccucuaccugcagaugaacagccugcggcccgaggacaccgcgguguacuacugcacgaucgggggcucccucagccgcuccagccagggcacccuggucaccguguccagcgggggcgggggcuccgggggcggcagcgaggugcagcuggucgaguccgggggcgggcucgugcagcccggcggcagccugcggcuguccugcgccgccagcggguucaccuucagcgacuacuggauguacugggugcgccaggccccgggcaaggggcucgagugggucuccgagaucaacacgaacggccugaucaccaaguaccccgacagcgugaaggggcgguucaccaucucccgcgacaacgccaagaacacccuguaccuccagaugaacagccugcggcccgaggacacggcgguguacuacugcgcccgcucccccagcggcuucaaccggggccaggggacccuggucaccguguccagc

SEQ ID NO: 8297 - RNA, 1350 nt, Artificial Sequence
  derived and/or modified sequence opt1 from Palivizumab_HeavyChain
caggugacccugcgcgagagcggccccgcccucgucaagccgacccagacgcugacccugaccugcaccuucuccggguucagccucuccacgagcggcauguccgugggguggauccggcagccgcccggcaaggcccuggaguggcuggcggacaucuggugggacgacaagaaggacuacaaccccagccucaagucccgccugaccaucagcaaggacaccuccaagaaccaggugguccugaaggugaccaacauggaccccgccgacacggccaccuacuacugcgcccggagcaugaucaccaacugguacuucgacguguggggcgccgggaccacggucaccguguccagcgcguccaccaagggccccagcguguucccccucgcccccuccagcaaguccaccagcgggggcacggccgcccuggggugccuggucaaggacuacuucccggagcccgugaccguguccuggaacagcggcgcgcucaccagcgggguccacaccuuccccgccgugcugcaguccagcggccuguacucccucagcuccguggucacggugcccagcuccagccugggcacccagaccuacaucugcaacgugaaccacaagccguccaacaccaaggucgacaagcgcguggagcccaagagcugcgacaagacgcacacgugcccgcccugccccgcccccgagcugcucgggggccccuccguguuccuguucccgcccaagcccaaggacacccugaugaucagccggacccccgaggugaccugcgucguggucgacgugucccacgaggaccccgaggucaaguucaacugguacguggacgggguggagguccacaacgccaagaccaagccgcgcgaggagcaguacaacagcaccuaccgggugguguccguccucaccgugcugcaccaggacuggcugaacggcaaggaguacaagugcaaggugagcaacaaggcccuccccgcgcccaucgagaagacgaucuccaaggccaagggccagccccgcgagccgcaggucuacacccugccgcccagccgggaggagaugaccaagaaccaggugucccugaccugccucgugaagggguucuaccccagcgacaucgccgucgagugggagagcaacggccagcccgagaacaacuacaagacgaccccgcccgugcuggacuccgacgggagcuucuuccuguacuccaagcucaccguggacaagagccgcuggcagcagggcaacgucuucuccugcagcgugaugcacgaggcccugcacaaccacuacacccagaagucccugagccucucccccgggaag

SEQ ID NO: 8298 - RNA, 639 nt, Artificial Sequence
  derived and/or modified sequence opt1 from Palivizumab_LightChain
gacauccagaugacccagagccccuccacccugagcgccuccgugggcgaccgcgucacgaucacgugcaagugccagcucagcgugggguacaugcacugguaccagcagaagccgggcaaggcccccaagcugcugaucuacgacaccuccaagcucgcgagcggggugcccucccgguucagcggcuccgggagcggcaccgaguucacgcugaccaucuccagccugcagcccgacgacuucgccaccuacuacugcuuccagggcuccggguacccguucaccuucggcgggggcacgaagcucgagaucaagcgcaccgucgccgcccccagcguguucaucuucccgcccuccgacgagcagcucaagagcgggaccgccuccguggucugccugcugaacaacuucuacccccgggaggcgaaggugcaguggaagguggacaacgcccugcagagcggcaacucccaggagagcgucaccgagcaggacagcaaggacuccacguacagccuguccagcacccucacccuguccaaggccgacuacgagaagcacaagguguacgccugcgaggugacccaccagggccugagcucccccgucaccaagagcuucaaccgcggggagugc

SEQ ID NO: 8299 - RNA, 360 nt, Artificial Sequence
  derived and/or modified sequence opt1 from Palivizumab_VH-Region
caggugacccugcgcgagagcggccccgcccucgucaagccgacccagacgcugacccugaccugcaccuucuccggguucagccucuccacgagcggcauguccgugggguggauccggcagccgcccggcaaggcccuggaguggcuggcggacaucuggugggacgacaagaaggacuacaaccccagccucaagucccgccugaccaucagcaaggacaccuccaagaaccaggugguccugaaggugaccaacauggaccccgccgacacggccaccuacuacugcgcccggagcaugaucaccaacugguacuucgacguguggggcgccgggaccacggucaccguguccagc

SEQ ID NO: 8300 - RNA, 1347 nt, Artificial Sequence; identical to SEQ ID NO: 7936
  derived and/or modified sequence opt1 from Pamrevlumab_HeavyChain1

SEQ ID NO: 8301 - RNA, 642 nt, Artificial Sequence; identical to SEQ ID NO: 7937
  derived and/or modified sequence opt1 from Pamrevlumab_LightChain1

SEQ ID NO: 8302 - RNA, 1305 nt, Artificial Sequence
  derived and/or modified sequence opt1 from Panitumumab_HeavyChain1
caggugcagcugcaggagagcggccccgggcucgucaagccguccgagacccugagccugaccugcacgguguccggcgggagcguguccagcggcgacuacuacuggaccuggauccgccagucccccgggaagggccucgaguggaucggccacaucuacuacagcgggaacaccaacuacaaccccucccucaagagccggcugaccaucuccaucgacacgagcaagacccaguucucccugaagcugagcuccgucaccgccgccgacaccgcgaucuacuacugcgugcgcgaccgggugacgggcgccuucgacaucugggggcagggcaccauggucaccgugagcuccgccagcaccaaggggcccuccguguucccgcuggcccccugcagccgcagcacguccgagagcaccgccgcgcucggcugccuggucaaggacuacuuccccgagcccgugaccguguccuggaacagcggcgcccugaccuccgggguccacacguucccggccgugcuccagagcuccggccuguacagccuguccagcguggucaccgugcccuccagcaacuucgggacccagaccuacacgugcaacguggaccacaagcccuccaacaccaaggucgacgagcggaagugcugcguggagugccccgccggcccgagcguguuccucuucccgcccaagcccaaggacacccugaugaucucccgcacccccgaggucacgugcgugguggucgacgugagccacgaggaccccgagguccaguucaacugguacguggacggcguggagguccacaacgcgaagaccaagccccgggaggagcaguucaacuccaccuuccgcguggugagcguccugaccguggugcaccaggacuggcucaacgggaaggaguacaagugcaaggucuccaacaagggccugcccgccccgaucgagaagacgaucagcaagaccaaggggcagccccgggagccccagguguacacccugcccccgagccgcgaggagaugaccaagaaccaggugucccucacgugccuggucaagggcuucuaccccagcgacaucgccguggagugggaguccaacgggcagcccgagaacaacuacaagaccacgcccccgaugcuggacagcgacggcuccuucuuccucuacagcaagcugaccguggacaagucccgguggcagcagggcaacgucuucagcugcuccgugaugcacgaggcccugcacaaccacuacacccagaagucccucagccugagccccgggaag

SEQ ID NO: 8303 - RNA, 642 nt, Artificial Sequence
  derived and/or modified sequence opt1 from Panitumumab_LightChain1
gacauccagaugacccagagccccuccagccuguccgccagcgugggcgaccgcgucaccaucacgugccaggccucccaggacaucagcaacuaccucaacugguaccagcagaagccggggaaggcgcccaagcugcugaucuacgacgccuccaaccucgagaccggcgugcccagccgguucuccgggagcggcuccgggaccgacuucaccuucacgaucagcucccugcagcccgaggacaucgccaccuacuucugccagcacuucgaccaccucccgcuggccuucggcggcgggaccaagguggagaucaagcgcaccgucgccgcgcccagcguguucaucuucccgcccuccgacgagcagcucaagagcggcacggccuccguggucugccugcugaacaacuucuacccccgggaggccaaggugcaguggaagguggacaacgcccugcagagcgggaacucccaggagagcgucaccgagcaggacagcaaggacuccaccuacagccuguccagcacccucacgcuguccaaggcggacuacgagaagcacaagguguacgccugcgaggugacccaccagggccugagcucccccgucaccaagagcuucaaccgcggggagugc

SEQ ID NO: 8304 - RNA, 1326 nt, Artificial Sequence
  derived and/or modified sequence opt1 from Pankoab_HeavyChain1
gaggugcagcuggucgagagcggcgggggccucgugcagcccgggggcucccgccugagcugcguggccuccggguucccguucagcaacuacuggaacuggguccggcaggcccccggcaagggccuggagugggugggggagauccgccucaaguccaacaacuacaccacccacuacgcggagagcgugaagggccgguucaccaucucccgcgacgacagcaagaacucccuguaccugcagaacagccucaagaccgaggacaccgccgucuacuacugcacccggcacuacuacuucgacuacugggggcagggcacgcuggugaccguguccagcgccuccaccaaggggcccagcgucuucccccuggccccguccagcaaguccaccagcggcggcacggccgcgcucgggugccuggugaaggacuacuuccccgagcccgugaccgucuccuggaacagcggcgcccugaccagcggggugcacaccuuccccgccgugcuccaguccagcggccuguacucccugagcuccgucgugacggugccgagcuccagccucggcacccagaccuacaucugcaacgucaaccacaagcccuccaacaccaagguggacaagaagguggagcccaagagcugcgacaagacgcacacgugcccgcccugccccgcccccgagcugcucgggggccccuccgucuuccuguucccgcccaagcccaaggacacccugaucagccgcacccccgaggugaccugcguggucguggacgucucccacgaggacccggaggugaaguucaacugguacguggacggggucgaggugcacaacgcgaagaccaagccccgggaggagcaguacaacagcaccuaccgcguggucuccgugcugaccgugcuccaccaggacuggcugaacggcaaggaguacaagugcaaggucagcaacaaggcccugcccgcccccaucgagaagacgaucuccaaggccaaggggcagccgcgggagccccagguguacacccucccgcccagccgcgacgagcugaccaagaaccaggugucccugaccugccucgucaagggcuucuaccccagcgacaucgccguggagugggagagcaacggccagcccgagaacaacuacaagacgacgcccccggugcuggacuccgacgggagcuucuuccuguacuccaagcucaccgucgacaagagccgguggcagcagggcaacguguucuccugcagcgugcacgaggggcugcacaaccacuacacccagaagucccugagccucucccccggcaag

SEQ ID NO: 8305 - RNA, 651 nt, Artificial Sequence
  derived and/or modified sequence opt1 from Pankoab_LightChain1
gacaucgugacccagagcccccuguccaacccggucacccccggcgagcccgccagcaucuccugccgcagcuccaagagccuccugcacuccaacgggaucacguacuucuucugguaccugcagaagcccggccagagcccgcagcuccugaucuaccaguccaaccuggccagcggggugcccgaccgguucuccggcagcggguccggcaccgacuucacccuccgcaucagccggguggaggcggaggacgucggcguguacuacugcgcccagaaccuggagcugccgcccaccuucgggcagggcacgaagguggagaucaagcgcaccgucgccgcccccuccguguucaucuucccgcccagcgacgagcagcucaaguccgggaccgccagcguggucugccugcugaacaacuucuacccccgggaggcgaaggugcaguggaagguggacaacgcccuccaguccggcaacagccaggagagcgucaccgagcaggacuccaaggacagcacguacucccugagcuccacccugacccucagcaaggccgacuacgagaagcacaagguguacgccugcgaggugacccaccaggggcuguccagccccgucacgaaguccuucaaccgcggcgagugc

SEQ ID NO: 8306 - RNA, 651 nt, Artificial Sequence
  derived and/or modified sequence opt1 from Pankoab_LightChain2
gacaucgugacccagagcccccuguccaacccggucacccccggcgagcccgccagcaucuccugccgcagcuccaagagccuccugcacuccaacgggaucacguacuucuucugguaccugcagaagcccggccagagcccgcagcuccugaucuaccaguccaaccuggccagcggggugcccgaccgguucuccggcagcggguccggcaccgacuucacccuccgcaucagccggguggaggcggaggacgucggcguguacuacugcgccgggaaccuggagcugccgcccaccuucggccaggggacgaagguggagaucaagcgcaccgucgccgcccccuccguguucaucuucccgcccagcgacgagcagcucaaguccggcaccgccagcguggucugccugcugaacaacuucuacccccgggaggcgaaggugcaguggaagguggacaacgcccuccaguccgggaacagccaggagagcgucaccgagcaggacuccaaggacagcacguacucccugagcuccacccugacccucagcaaggccgacuacgagaagcacaagguguacgccugcgaggugacccaccagggccuguccagccccgucacgaaguccuucaaccgcggcgagugc

SEQ ID NO: 8307 - RNA, 351 nt, Artificial Sequence
  derived and/or modified sequence opt1 from PankoMab_HeavyChain_VDJ-Region
gaggugaagcuggucgagagcggcgggggccucgugcagcccgggggcuccaugaagcugagcugcguggccuccggguucaccuucagcaacuacuggaugaacuggguccgccaguccccggagaagggccuggaguggguggccgagauccggcucaagagcaacaacuacaccacgcacuacgcggaguccgugaagggccgcuucaccaucagccgggacgacuccaagagcuccgucagccugcagaugaacaaccugcgcguggaggacaccgggaucuacuacugcacccggcacuacuacuucgacuacuggggccaggggacgacccucaccguguccagc

SEQ ID NO: 8308 - RNA, 339 nt, Artificial Sequence
  derived and/or modified sequence opt1 from PankoMab_LightChain_VJ-Region
gacaucgugaugacccaggccgccuucagcaaccccgucacccugggcacguccgcgagcaucuccugccgcagcuccaagagccuccugcacuccaacgggaucaccuacuucuucugguaccugcagaagccgggccucagcccccagcugcugaucuaccagauguccaaccucgccagcggggugcccgaccgguucuccagcuccggcagcgggaccgacuucacccugcgcaucucccggguggaggccgaggacgucggcguguacuacugcgcccagaaccuggagcugcccccgacguucggcgggggcaccaagcucgagaucaagcgc

SEQ ID NO: 8309 - RNA, 1707 nt, Artificial Sequence
  derived and/or modified sequence opt1 from Panobacumab_HeavyChain1
gaggagcaggucguggagagcggcggcggcuucgugcagcccgggggcucccugcgccucagcugcgccgccuccggguucaccuucagcccguacuggaugcacugggugcggcaggcgcccggcaagggccuggucugggugucccgcaucaacagcgacggguccaccuacuacgccgacagcgugaagggccgguucacgaucucccgcgacaacgcccggaacacccuguaccuccagaugaacagccugcgcgccgaggacaccgccgucuacuacugcgcgcgggaccgcuacuacgggcccgagauguggggccaggggaccauggugacgguguccagcggcuccgccagcgcccccacccuguucccgcucgucuccugcgagaacagccccuccgacaccagcuccguggccgugggcugccuggcgcaggacuuccugcccgacagcaucaccuucagcuggaaguacaagaacaacuccgacaucagcuccacgcggggguuccccagcguccuccgcggcgggaaguacgccgccaccucccaggugcugcugccgagcaaggacgugaugcagggcaccgacgagcacgucgugugcaaggugcagcaccccaacggcaacaaggagaagaacgucccccuccccgugaucgccgagcugccgcccaagguguccgucuucgugccgccccgggacggguucuucggcaacccccgcaagagcaagcugaucugccaggccaccggguucagcccccggcagauccagguguccuggcuccgcgagggcaagcaggucggguccggcgugacgaccgaccagguccaggcggaggccaaggagagcggccccaccaccuacaaggugacguccacccugaccaucaaggagagcgacuggcugucccagagcauguucacgugccggguggaccaccgcgggcucaccuuccagcagaacgccuccagcaugugcguccccgaccaggacaccgccauccggguguucgccaucccgcccuccuucgcgagcaucuuccugaccaagagcaccaagcugacgugccucgugaccgaccugaccaccuacgacuccgucacgaucagcuggacccgccagaacggcgaggccgugaagacccacaccaacaucuccgagagccaccccaacgccacguucuccgccgugggggaggccagcaucugcgaggacgacuggaacuccggcgagcgguucacgugcaccgucacccacaccgaccugcccagcccgcucaagcagaccaucucccgccccaaggggguggcgcugcaccggcccgacguguaccugcugcccccggcccgcgagcagcucaaccugcgcgagagcgccaccaucacgugccucgucaccggcuucucccccgccgacguguucgugcaguggaugcagcggggccagccccugagcccggagaaguacgucaccuccgcccccaugcccgagccccaggcgccggggcgcuacuucgcccacagcauccugaccguguccgaggaggaguggaacaccggcgagaccuacacgugcguggucgcccacgaggcccuccccaaccgggugaccgagcgcaccguggacaagagcaccgggaagcccacgcuguacaacgucucccuggugaugagcgacaccgcggggaccugcuac

SEQ ID NO: 8310 - RNA, 657 nt, Artificial Sequence
  derived and/or modified sequence opt1 from Panobacumab_LightChain1
gacguggucaugacccagagcccccugucccucccggugacccugggccagcccgccagcaucuccugccggagcucccagagccugguguacuccgacgggaacacguaccucaacugguuccagcagcggcccggccagagcccccgccggcugaucuacaaggucuccaaccgcgacagcggggugccggaccgguucuccggcagcggguccggcaccgacuucacccugaagaucagccgcguggaggccgaggacgucggcguguacuacugcaugcaggggacccacuggccccucacguucggcgggggcaccaagguggagaucaagcggaccgucgcggcccccuccguguucaucuucccgcccagcgacgagcagcugaaguccgggaccgccagcguggucugccugcucaacaacuucuacccccgcgaggccaaggugcaguggaagguggacaacgcccugcaguccggcaacagccaggagagcgucacggagcaggacuccaaggacagcaccuacucccugagcuccacccucacccugagcaaggcggacuacgagaagcacaagguguacgccugcgaggugacgcaccagggccuguccagccccgucaccaaguccuucaaccgcggggagugc

SEQ ID NO: 8311 - RNA, 414 nt, Artificial Sequence
  derived and/or modified sequence opt1 from Panobacumab_LightChain2
ggcgacgacgaggccaccauccuggccgacaacaagugcaugugcacccgcgugacgagccggaucauccccuccaccgaggacccgaacgaggacaucgucgagcgcaacauccggaucguggugccccucaacaaccgcgagaacaucagcgaccccaccagcccccugcggcgcaacuucgucuaccaccuguccgacgugugcaagaagugcgacccgguggaggucgagcucgaggaccagguggugaccgcgacgcaguccaacaucugcaacgaggacgacgggguccccgagaccugcuacauguacgaccggaacaagugcuacaccaccauggugccccugcgcuaccacggcgagacgaagauggugcaggccgcccugacccccgacagcugcuacccggac

SEQ ID NO: 8312 - RNA, 1359 nt, Artificial Sequence
  derived and/or modified sequence opt1 from Parsatuzumab_HeavyChain1
gaggugcagcuggucgagagcggcgggggccucgugcagcccgggggcucccugcgccugagcugcgccgccuccggguacaccuucaucgacuacuacaugaacugggugcggcaggcgccgggcaagggccucgagugggucggggacaucaaccuggacaacagcggcacccacuacaaccagaaguucaaggggcgcuucacgaucucccgggacaagagcaagaacaccgccuaccugcagaugaacucccuccgcgccgaggacaccgccguguacuacugcgcccgggagggcguguaccacgacuacgacgacuacgcgauggacuacugggggcagggcacccuggucacggugagcuccgccagcaccaagggccccuccguguucccccuggcccccagcuccaagagcaccuccgggggcaccgccgcgcucgggugccuggucaaggacuacuucccggagcccgugacggugagcuggaacuccggcgcccugaccagcggcguccacaccuuccccgccgugcuccaguccagcgggcuguacagccuguccagcguggucaccgugcccuccagcucccucggcacgcagaccuacaucugcaacgugaaccacaagccgagcaacaccaaggucgacaagaagguggagcccaaguccugcgacaagacccacacgugcccgcccugccccgcccccgagcugcucgggggccccagcguguuccuguucccgcccaagcccaaggacacccugaugaucucccgcacccccgaggugaccugcgucguggucgacgugagccacgaggaccccgaggucaaguucaacugguacguggacgggguggagguccacaacgccaagacgaagccgcgggaggagcaguacaacuccaccuaccgcguggugagcguccugaccgugcuccaccaggacuggcugaacggcaaggaguacaagugcaagguguccaacaaggcgcugcccgcccccaucgagaagaccaucagcaaggccaagggccagccccgggagccgcaggucuacacgcucccgcccucccgcgaggagaugaccaagaaccaggugagccugaccugccuggugaagggguucuaccccuccgacaucgccgucgagugggagagcaacggccagcccgagaacaacuacaagaccacgccgcccgugcucgacuccgacgggagcuucuuccuguacagcaagcugaccguggacaagucccgguggcagcagggcaacgucuucagcugcuccgugaugcacgaggcccuccacaaccacuacacccagaagucccugagccugagccccgggaag

SEQ ID NO: 8313 - RNA, 657 nt, Artificial Sequence
  derived and/or modified sequence opt1 from Parsatuzumab_LightChain1
gacauccagaugacccagagccccuccagccuguccgccagcgugggcgaccgggucaccaucacgugccggaccucccagagccucgugcacaucaacgccaucaccuaccugcacugguaccagcagaagccggggaaggcgcccaagcugcucaucuaccgcguguccaaccgguucagcggcguccccucccgcuucagcggguccggcagcgggaccgacuucacgcugaccaucuccagccugcagcccgaggacuucgccaccuacuacugcggccaguccacccacgugccgcucacguucggccaggggaccaagguggagaucaagcggaccgucgccgcccccagcguguucaucuucccgcccuccgacgagcagcucaagagcggcaccgccuccguggucugccugcugaacaacuucuacccccgcgaggcgaaggugcaguggaagguggacaacgcccugcagagcgggaacagccaggaguccgucacggagcaggacagcaaggacuccaccuacagccuguccagcacccucacccuguccaaggccgacuacgagaagcacaagguguacgccugcgaggugacgcaccagggccugagcucccccgucaccaagagcuucaaccgcggggagugc

SEQ ID NO: 8314 - RNA, 1353 nt, Artificial Sequence
  derived and/or modified sequence opt1 from Pascolizumab_HeavyChain1
caggugacccugcgcgagagcggccccgcccucgucaagccgacccagacccugacccugaccugcaccuucuccggguucagccucuccacgagcggcauggggguguccuggauccggcagccgcccggcaaggggcuggaguggcuggcccacaucuacugggacgacgacaagcgcuacaaccccagccucaagucccggcugaccaucagcaaggacaccucccgcaaccaggugguccugaccaugacgaacauggaccccguggacaccgcgaccuacuacugcgcccggcgcgagaccguguucuacugguacuucgacgucuggggccggggcacgcccgugaccgugagcuccgccagcaccaaggggcccuccgucuucccccucgccccgagcuccaagagcaccuccggcgggacggccgcgcugggcugccuggugaaggacuacuuccccgagcccgugaccgucagcuggaacuccggggcccucaccagcggcgugcacaccuuccccgccgugcugcagagcuccggccuguacagccucuccagcgucgugacggugccguccagcucccuggggacccagaccuacaucugcaacgucaaccacaagcccagcaacaccaagguggacaagcgcguggagcccaaguccugcgacaagacgcacacgugcccgcccugccccgcccccgagcugcucggcgggcccagcgucuuccuguucccgcccaagcccaaggacacccugaugaucucccggacccccgaggugaccugcguggucguggacgucagccacgaggacccggaggugaaguucaacugguacguggacggcgucgaggugcacaacgcgaagaccaagccccgcgaggagcaguacaacuccaccuaccggguggucagcgugcucaccgugcugcaccaggacuggcugaacggcaaggaguacaagugcaaggucuccaacaaggcccuccccgcccccaucgagaagacgaucagcaaggccaaggggcagccgcgcgagccccagguguacacccugcccccgucccgggaggagaugaccaagaaccaggugagccugaccugccucgucaagggcuucuaccccuccgacaucgccguggagugggagagcaacgggcagcccgagaacaacuacaagacgacgcccccggugcuggacagcgacggcuccuucuuccuguacagcaagcucaccgucgacaagucccgcuggcagcaggggaacguguucagcugcuccgugaugcacgaggcgcugcacaaccacuacacccagaagucccugagccucagccccggcaag

SEQ ID NO: 8315 - RNA, 654 nt, Artificial Sequence
  derived and/or modified sequence opt1 from Pascolizumab_LightChain1
gacaucgugcugacccagagccccuccagccucuccgccagcgucggcgaccgcgugaccaucacgugcaaggccucccagagcguggacuacgacggggacuccuacaugaacugguaccagcagaagccgggcaaggcgcccaagcugcugaucuacgccgccagcaaccucgaguccgggauccccagccgguucuccggcagcggguccggcaccgacuucaccuucaccaucagcucccugcagcccgaggacaucgccacguacuacugccagcagagcaacgaggacccgcccaccuucggccaggggaccaaggucgagaucaagcgcaccguggccgcgcccuccguguucaucuucccgcccagcgacgagcagcugaaguccggcacggccagcgucgugugccuccugaacaacuucuacccccgggaggccaaggugcaguggaaggucgacaacgcccugcagagcgggaacucccaggagagcgugaccgagcaggacuccaaggacagcaccuacucccucagcuccacccugacgcugagcaaggcggacuacgagaagcacaagguguacgccugcgaggucacccaccagggccucuccagccccgugaccaaguccuucaaccgcggggagugc

SEQ ID NO: 8316 - RNA, 1512 nt, Artificial Sequence
  derived and/or modified sequence opt1 from Pasotuxizumab_HeavyChain1
caggugcagcuggucgagagcggcgggggccucgugaagcccggggagucccugcgccugagcugcgccgccuccggcuucaccuucagcgacuacuacauguacugggugcggcaggcgccggggaagggccucgagugggucgccaucaucuccgacggcggguacuacaccuacuacagcgacaucaucaagggccgcuucacgaucucccgggacaacgccaagaacagccuguaccugcagaugaacucccucaaggccgaggacaccgccguguacuacugcgcgcgcggguucccccugcugcggcacggcgccauggacuacugggggcagggcacccucgugaccgucagcuccggcgggggcgggagcggcggcgggggcuccgggggcgggggcagcgacauccagaugacgcagucccccagcucccugagcgccuccgugggcgaccgcgugaccaucacgugcaaggccagccagaacgucgacaccaacguggcgugguaccagcagaagcccgggcaggcccccaagagccugaucuacuccgccagcuaccgguacuccgacgugcccagccgcuucuccggcagcgccuccgggaccgacuucacccucaccaucagcuccguccagagcgaggacuucgccaccuacuacugccagcaguacgacuccuaccccuacacguucggcgggggcaccaagcuggagaucaagagcggcgggggcggguccgaggugcagcugguggagagcggcgggggccucguccagcccggcgggucccugaagcugagcugcgcggccuccggcuucaccuucaacaaguacgccaugaacugggugcggcaggccccggggaagggccucgaguggguggcccgcauccggagcaaguacaacaacuacgcgaccuacuacgccgacuccgucaaggaccgcuucacgaucagccgggacgacagcaagaacaccgccuaccugcagaugaacaaccugaagaccgaggacaccgccguguacuacugcgugcgccacggcaacuucgggaacuccuacaucagcuacugggccuacuggggccaggggacgcucgucaccguguccagcggcgggggcggcuccgggggcgggggcagcgggggcggcgggucccagaccguggucacccaggagcccagccugacggugucccccggcgggaccgucacccugaccugcggcagcuccacgggggcggugaccagcggcaacuaccccaacugggugcagcagaagccgggccaggccccgcgggggcucaucggcgggaccaaguuccuggcccccggcacccccgcccgcuucuccgggagccugcucggcggcaaggccgcgcugacgcuguccgggguccagccggaggacgaggccgaguacuacugcgugcucugguacagcaaccgguggguguucggcgggggcaccaagcugaccguccugcaccaccaccaccaccac

SEQ ID NO: 8317 - RNA, 1512 nt, Artificial Sequence
  derived and/or modified sequence opt1 from Pasotuxizumab_SingleChain
caggugcagcugguccagagcggcgggggccucgugaagcccggggagucccugcgccugagcugcgccgccuccggcuucaccuucagcgacuacuacauguacugggugcggcaggcgccggggaagggccucgagugggucgccaucaucuccgacggcggguacuacaccuacuacagcgacaucaucaagggccgcuucacgaucucccgggacaacgccaagaacagccuguaccugcagaugaacucccucaaggccgaggacaccgccguguacuacugcgcgcgcggguucccccugcugcggcacggcgccauggacuacugggggcagggcacccucgugaccgucagcuccggcgggggcgggagcggcggcgggggcuccgggggcgggggcagcgacauccagaugacgcagucccccagcucccugagcgccuccgugggcgaccgcgugaccaucacgugcaaggccagccagaacgucgacaccaacguggcgugguaccagcagaagcccgggcaggcccccaagagccugaucuacuccgccagcuaccgguacuccgacgugcccagccgcuucuccggcagcgccuccgggaccgacuucacccucaccaucagcuccguccagagcgaggacuucgccaccuacuacugccagcaguacgacuccuaccccuacacguucggcgggggcaccaagcuggagaucaagagcggcgggggcggguccgaggugcagcugguggagagcggcgggggccucguccagcccggcgggucccugaagcugagcugcgcggccuccggcuucaccuucaacaaguacgccaugaacugggugcggcaggccccggggaagggccucgaguggguggcccgcauccggagcaaguacaacaacuacgcgaccuacuacgccgacuccgucaaggaccgcuucacgaucagccgggacgacagcaagaacaccgccuaccugcagaugaacaaccugaagaccgaggacaccgccguguacuacugcgugcgccacggcaacuucgggaacuccuacaucagcuacugggccuacuggggccaggggacgcucgucaccguguccagcggcgggggcggcuccgggggcgggggcagcgggggcggcgggucccagaccguggucacccaggagcccagccugacggugucccccggcgggaccgucacccugaccugcggcagcuccacgggggcggugaccagcggcaacuaccccaacugggugcagcagaagccgggccaggccccgcgggggcucaucggcgggaccaaguuccuggcccccggcacccccgcccgcuucuccgggagccugcucggcggcaaggccgcgcugacgcuguccgggguccagccggaggacgaggccgaguacuacugcgugcucugguacagcaaccgguggguguucggcgggggcaccaagcugaccguccugcaccaccaccaccaccac

SEQ ID NO: 8318 - RNA, 1341 nt, Artificial Sequence
  derived and/or modified sequence opt1 from Pateclizumab_HeavyChain1
gaggugcagcuggucgagagcggcgggggccucgugcagcccgggggcucccugcgccugagcugcgccgccuccggguacaccuucaccagcuacgugauccacuggguccggcaggcgcccggcaagggccucgagugggugggguacaacaaccccuacaacgccggcacgaacuacaacgagaaguucaaggggcgcuucaccaucuccagcgacaaguccaagaacaccgccuaccugcagaugaacagccugcgggccgaggacaccgccguguacuacugcucccgccccacgaugcuccccugguucgcguacuggggccaggggacccuggucaccgugagcuccgccagcaccaagggcccguccguguucccccuggcccccagcuccaagagcacguccggcgggaccgccgcgcucggcugccuggucaaggacuacuuccccgagccggugaccgugagcuggaacuccggggcccugaccagcggcguccacacguuccccgccgugcuccagagcuccggccuguacagccuguccagcguggucaccgugcccuccagcucccucgggacccagaccuacaucugcaacgugaaccacaagcccagcaacacgaaggucgacaagaagguggagccgaaguccugcgacaagacccacacgugcccgcccugccccgcccccgagcugcugggcgggcccagcguguuccucuucccgcccaagcccaaggacacccugaugaucucccggacccccgaggugaccugcgucguggucgacgugagccacgaggaccccgaggucaaguucaacugguacguggacggcguggagguccacaacgccaagaccaagccccgcgaggagcaguacaacuccaccuaccggguggugagcguccugacggugcuccaccaggacuggcugaacgggaaggaguacaagugcaagguguccaacaaggcgcugccggcccccaucgagaagaccaucagcaaggccaagggccagccccgcgagccccaggucuacacccucccgcccucccgggaggagaugaccaagaaccaggugagccugacgugccuggugaagggcuucuaccccuccgacaucgccgucgagugggagagcaacgggcagccggagaacaacuacaagaccaccccgcccgugcucgacagcgacggcuccuucuuccuguacagcaagcugaccguggacaagucccgcuggcagcaggggaacgucuucagcugcuccgugaugcacgaggcccuccacaaccacuacacgcagaagucccugagccugagccccggc

SEQ ID NO: 8319 - RNA, 642 nt, Artificial Sequence
  derived and/or modified sequence opt1 from Pateclizumab_LightChain1
gacauccagaugacgcagagccccuccagccuguccgccagcgugggcgaccgcgucaccaucacgugccgggccucccaggcggugagcuccgccguggccugguaccagcagaagccggggaaggcccccaagcuccugaucuacagcgccucccaccgcuacaccggcguccccagccgguucuccgggagcggcuccgggaccgacuucacccugacgaucagcucccuccagcccgaggacuucgcgaccuacuacugccaggagagcuacuccaccccguggaccuucggccagggcacgaagguggagaucaagcgcaccguggccgcccccagcgucuucaucuucccgcccuccgacgagcagcucaagagcgggaccgccagcguggugugccugcugaacaacuucuacccccgggaggcgaagguccaguggaagguggacaacgcccugcaguccggcaacagccaggaguccgugaccgagcaggacagcaaggacuccacguacagccuguccagcacccucacccuguccaaggccgacuacgagaagcacaaggucuacgccugcgaggugacccaccaggggcugagcucccccgugaccaagagcuucaaccgcggcgagugc

SEQ ID NO: 8320 - RNA, 1341 nt, Artificial Sequence
  derived and/or modified sequence opt1 from Patritumab_HeavyChain1
caggugcagcugcagcaguggggcgccgggcuccugaagcccagcgagacccugucccugaccugcgccgucuacggcgggagcuucuccggcuacuacuggagcuggauccgccagccgcccgggaagggccuggaguggaucggcgagaucaaccacuccgggagcacgaacuacaaccccucccucaagagccgggugaccaucuccguggagaccagcaagaaccaguucucccucaagcugagcuccgucaccgcggccgacacggccguguacuacugcgcccgcgacaaguggaccugguacuucgaccuguggggccgggggacccucgugaccgucagcuccgccagcacgaagggccccuccguguucccgcuggcgcccagcuccaagagcaccagcgggggcaccgccgcccugggcugccucgugaaggacuacuuccccgagcccgucaccguguccuggaacagcggggcccugacguccggcgugcacaccuucccggcgguccugcagagcuccgggcucuacagccuguccagcguggugaccguccccuccagcucccugggcacccagacguacaucugcaacgugaaccacaagcccagcaacaccaagguggacaagcgcgucgagcccaaguccugcgacaagacccacacgugcccgcccugccccgcccccgagcuccugggcgggccgagcguguuccuguucccgcccaagcccaaggacacccucaugaucucccggacccccgaggugaccugcgucgugguggacgucagccacgaggaccccgaggugaaguucaacugguacgucgacggcguggaggugcacaacgccaagaccaagccccgcgaggagcaguacaacuccacguaccgggucgugagcgugcugaccguccugcaccaggacuggcucaacgggaaggaguacaagugcaagguguccaacaaggcccugcccgccccgaucgagaagaccaucagcaaggcgaagggccagccccgcgagccccagguguacacccugcccccgagccgggaggagaugacgaagaaccaggucucccugaccugccucgugaagggguucuaccccagcgacaucgccguggagugggaguccaacggccagcccgagaacaacuacaagaccaccccgcccguccuggacagcgacggcuccuucuuccucuacagcaagcugacgguggacaagucccgcuggcagcaggggaacguguucagcugcuccgucaugcacgaggcccugcacaaccacuacacccagaagucccucagccugagccccggcaag

SEQ ID NO: 8321 - RNA, 681 nt, Artificial Sequence; identical to SEQ ID NO: 8277
  derived and/or modified sequence opt1 from Patritumab_hinge-CH2-CH3

SEQ ID NO: 8322 - RNA, 660 nt, Artificial Sequence
  derived and/or modified sequence opt1 from Patritumab_LightChain1
gacaucgagaugacccagagccccgacucccuggccgugagccucggcgagcgcgccaccaucaacugccgguccagccaguccguccuguacagcuccagcaaccgcaacuaccuggcgugguaccagcagaacccggggcagccgcccaagcuccugaucuacugggccuccacgcgggagagcggcgugcccgaccgcuucuccgggagcggcuccgggaccgacuucacccugaccaucagcucccuccaggccgaggacguggccgucuacuacugccagcaguacuacagcacgccccggaccuucggccagggcaccaagguggagaucaagcgcaccguggccgcgcccuccgucuucaucuucccgcccagcgacgagcagcugaaguccgggacggccagcguggugugccugcucaacaacuucuacccccgggaggccaagguccaguggaagguggacaacgcccugcagagcggcaacucccaggagagcgugaccgagcaggacuccaaggacagcaccuacucccugagcuccacccucacgcugagcaaggcggacuacgagaagcacaaggucuacgccugcgaggugacccaccaggggcuguccagccccgugaccaaguccuucaaccgcggcgagugc

SEQ ID NO: 8323 - RNA, 1341 nt, Artificial Sequence; identical to SEQ ID NO: 8138
  derived and/or modified sequence opt1 from Pembrolizumab_HeavyChain1

SEQ ID NO: 8324 - RNA, 654 nt, Artificial Sequence; identical to SEQ ID NO: 8139
  derived and/or modified sequence opt1 from Pembrolizumab_LightChain1

SEQ ID NO: 8325 - RNA, 1356 nt, Artificial Sequence
  derived and/or modified sequence opt1 from Perakizumab_HeavyChain1
gaggugcagcuggucgagagcggcgggggccucgugcagcccgggggcucccugcgccugagcugcgccgccuccggguucaccuucagcgacuacaccaugcucugggugcggcaggcgccgggcaagggccuggagugggucgccaucaucaaguccgggggcagcuacuccuacuaccccgacagcgugaaggggcgcuucacgaucucccgggacaacgccaagaacagccuguaccuccagaugaacucccugcgcgccgaggacaccgccguguacuacugcgcgcgggacggcgacuacgggagcuccuacggcgccauggacuacuggggccaggggacccuggucaccgugagcuccgccagcacgaagggccccuccguguucccccucgccccgagcuccaagagcaccagcgggggcaccgcggcccugggcugccuggucaaggacuacuuccccgagcccgugaccguguccuggaacagcggggcccucacguccggcguccacaccuuccccgccgugcugcagagcuccgggcuguacagccucuccagcguggucaccgugccguccagcucccugggcacccagacguacaucugcaacgugaaccacaagcccagcaacaccaaggucgacaagaagguggagcccaaguccugcgacaagacccacacgugcccgcccugccccgcccccgaggcggccgggggccccagcguguuccuguucccgcccaagcccaaggacacccucaugaucucccgcacccccgaggugaccugcgucguggucgacgugagccacgaggacccggaggucaaguucaacugguacguggacggcguggagguccacaacgccaagaccaagccccgggaggagcaguacaacuccacguaccgcguggugagcguccugaccgugcugcaccaggacuggcucaacgggaaggaguacaagugcaagguguccaacaaggcccugcccgcccccaucgagaagaccaucagcaaggcgaagggccagccgcgggagccccaggucuacacccugccgcccagccgcgacgagcucacgaagaaccaggugucccugaccugccuggugaagggguucuaccccagcgacaucgccgucgagugggaguccaacggccagcccgagaacaacuacaagaccacgcccccggugcucgacagcgacggguccuucuuccuguacagcaagcugaccguggacaagucccgguggcagcagggcaacgucuucagcugcuccgugaugcacgaggcccuccacaaccacuacacccagaagucccugagccugagccccggcaag

SEQ ID NO: 8326 - RNA, 645 nt, Artificial Sequence
  derived and/or modified sequence opt1 from Perakizumab_LightChain1
gacauccagaugacgcagagccccuccagccuguccgccagcgugggcgaccgcgucaccaucacgugccgggccucccaggacaucaacagcuaccucuccugguuccagcagaagccggggaaggcgcccaagagccugaucgugcgcgccaaccggcugguggacggcguccccucccgcuucagcggguccggcagcgggcaggacuacucccucaccaucagcucccugcagcccgaggacuucgccaccuacuacugccugcaguacgacgccuucccgcccuacaccuucggccagggcacgaagcucgagaucaagcggaccguggccgcgcccagcguguucaucuucccgcccuccgacgagcagcucaagagcgggaccgccuccgucgugugccugcugaacaacuucuacccccgcgaggccaaggugcaguggaaggucgacaacgcccugcagagcggcaacagccaggaguccgugaccgagcaggacagcaaggacuccacguacagccuguccagcacccucacccuguccaaggcggacuacgagaagcacaagguguacgccugcgaggucacccaccaggggcugagcucccccgugaccaagagcuucaaccggggcgagugc

SEQ ID NO: 8327 - RNA, 1332 nt, Artificial Sequence
  derived and/or modified sequence opt1 from Pertuzuab_HeavyChain1
gaggugcagcuggucgagagcggcgggggccucgugcagcccgggggcucccugcgccugagcugcgccgccuccggguucaccuucaccgacuacacggacugggugcggcaggcgccgggcaagggccucgagugggucgccgacgugaaccccaacagcgggggcuccaucuacaaccagcgcuucaaggggcgguucacccugagcguggaccgcuccaagaacacccuguaccuccagaacagccugcgggccgaggacaccgccgucuacuacugcgcccgcaaccugggccccuccuucuacuucgacuacugggggcagggcacgcucgugaccgugagcuccgcgagcaccaagggccccuccgucuucccgcuggcccccagcuccaagagcaccuccgggggcacggccgcccuggggugccucgugaaggacuacuuccccgagcccgugaccgucagcuggaacuccggcgcgcugaccagcggcgugcacaccuucccggccgugcugcagagcuccgggcucuacagccuguccagcgucgugacggugcccuccagcucccugggcacccagaccuacaucugcaacgucaaccacaagcccagcaacaccaagguggacaagaagguggagcccaaguccugcgacaagacgcacacgugcccgcccugccccgcccccgagcuccucgggggcccgagcgucuuccuguucccgcccaagcccaaggacacccucaucucccggacccccgaggugaccugcguggucguggacgucagccacgaggaccccgaggugaaguucaacugguacguggacggggucgaggugcacaacgccaagaccaagccccgcgaggagcaguacaacuccaccuaccggguggucagcgugcugaccgugcugcaccaggacuggcucaacggcaaggaguacaagugcaaggucuccaacaaggcccugcccgcgccgaucgagaagacgaucagcaaggccaagggccagccccgcgagccccagguguacacccugcccccgucccgggaggagaccaagaaccaggugagccugaccugccuggucaagggguucuaccccuccgacaucgccguggagugggagagcaacggccagcccgagaacaacuacaagacgaccccgcccgugcuggacagcgacggguccuucuuccucuacagcaagcugaccgucgacaagucccgcuggcagcagggcaacguguucagcugcuccgugcacgaggcccugcacaaccacuacacccagaagucccucagccugagccccgggaag

SEQ ID NO: 8328 - RNA, 639 nt, Artificial Sequence
  derived and/or modified sequence opt1 from Pertuzuab_LightChain1
gacauccagacccagagccccuccagccuguccgccagcgugggcgaccgggucaccaucacgugcaaggccucccaggacgugagcaucgggguggcgugguaccagcagaagccgggcaaggcccccaagcuccugaucuacuccgccagcuaccgguacaccgggguccccucccgcuucagcggcuccgggagcggcaccgacuucacccugacgaucuccagccuccagcccgaggacuucgccaccuacuacugccagcaguacuacaucuacccguacaccuucggccaggggaccaagguggagaucaagcggacgguggccgcgcccuccgucuucaucuucccgcccagcgacgagcagcugaaguccggcaccgccagcguggugugccugcucaacaacuucuacccccgcgaggccaagguccaguggaagguggacaacgcccugcaguccgggaacagccaggagagcgugaccgagcaggacuccaaggacagcaccuacucccugagcuccacgcucacccugagcaaggcggacuacgagaagcacaaggucuacgccugcgaggugacccaccagggccuguccagccccgugaccaaguccuucaaccgcggggagugc

SEQ ID NO: 8329 - RNA, 642 nt, Artificial Sequence
  derived and/or modified sequence opt1 from Pertuzumab_HeavyChain
gacauccagaugacccagagccccuccagccuguccgccagcgugggcgaccgggucaccaucacgugcaaggccucccaggacgugagcaucgggguggcgugguaccagcagaagccgggcaaggcccccaagcuccugaucuacuccgccagcuaccgguacaccgggguccccucccgcuucagcggcuccgggagcggcaccgacuucacccugacgaucuccagccuccagcccgaggacuucgccaccuacuacugccagcaguacuacaucuacccguacaccuucggccaggggaccaagguggagaucaagcggacgguggccgcgcccuccgucuucaucuucccgcccagcgacgagcagcugaaguccggcaccgccagcguggugugccugcucaacaacuucuacccccgcgaggccaagguccaguggaagguggacaacgcccugcaguccgggaacagccaggagagcgugaccgagcaggacuccaaggacagcaccuacucccugagcuccacgcucacccugagcaaggcggacuacgagaagcacaaggucuacgccugcgaggugacccaccagggccuguccagccccgugaccaaguccuucaaccgcggggagugc

SEQ ID NO: 8330 - RNA, 1344 nt, Artificial Sequence
  derived and/or modified sequence opt1 from Pertuzumab_LightChain
gaggugcagcuggucgagagcggcgggggccucgugcagcccgggggcucccugcgccugagcugcgccgccuccggguucaccuucaccgacuacacgauggacugggugcggcaggcgccgggcaagggccucgagugggucgccgacgugaaccccaacagcgggggcuccaucuacaaccagcgcuucaaggggcgguucacccugagcguggaccgcuccaagaacacccuguaccuccagaugaacagccugcgggccgaggacaccgccgucuacuacugcgcccgcaaccugggccccuccuucuacuucgacuacugggggcagggcacgcucgugaccgugagcuccgcgagcaccaagggccccuccgucuucccgcuggcccccagcuccaagagcaccuccgggggcacggccgcccuggggugccucgugaaggacuacuuccccgagcccgugaccgucagcuggaacuccggcgcgcugaccagcggcgugcacaccuucccggccgugcugcagagcuccgggcucuacagccuguccagcgucgugacggugcccuccagcucccugggcacccagaccuacaucugcaacgucaaccacaagcccagcaacaccaagguggacaagaagguggagcccaaguccugcgacaagacgcacacgugcccgcccugccccgcccccgagcuccucgggggcccgagcgucuuccuguucccgcccaagcccaaggacacccucaugaucucccggacccccgaggugaccugcguggucguggacgucagccacgaggaccccgaggugaaguucaacugguacguggacggggucgaggugcacaacgccaagaccaagccccgcgaggagcaguacaacuccaccuaccggguggucagcgugcugaccgugcugcaccaggacuggcucaacggcaaggaguacaagugcaaggucuccaacaaggcccugcccgcgccgaucgagaagacgaucagcaaggccaagggccagccccgcgagccccagguguacacccugcccccgucccgggaggagaugaccaagaaccaggugagccugaccugccuggucaagggguucuaccccuccgacaucgccguggagugggagagcaacggccagcccgagaacaacuacaagacgaccccgcccgugcuggacagcgacggguccuucuuccucuacagcaagcugaccgucgacaagucccgcuggcagcagggcaacguguucagcugcuccgugaugcacgaggcccugcacaaccacuacacccagaagucccucagccugagccccggg

SEQ ID NO: 8331 - RNA, 750 nt, Artificial Sequence
  derived and/or modified sequence opt1 from Pexelizumab_h5g1.1-scFv
auggccgacauccagaugacccagagccccuccagccuguccgccagcgugggcgaccgcgucaccaucacgugcggggcguccgagaacaucuacggcgcccucaacugguaccagcggaagccggggaaggcccccaagcugcugaucuacggcgccaccaaccucgccgacggggugcccagccgcuucuccggcagcggcuccgggaccgacuacacccugacgaucagcucccugcagcccgaggacuucgcgaccuacuacugccagaacgugcucaacaccccgcugaccuucggccaggggacgaaggucgagaucaagcggaccggcgggggcggcagcgggggcgggggcuccggcgggggcgggagccaggugcagcuggugcaguccggcgccgaggucgagaagcccggggccagcgugaagaagguguccugcaaggccagcggcuacaucuucuccaacuacuggauccaguggguccgccaggcgcccggccaggggcucgaguggaugggcgagauccugcccgggagcggcagcaccgaguacgcccagaaguuccaggggcgggugaccaugacggccgacaccuccaccagcaccgccuacauggagcuguccagccuccgcuccgaggacacggccguguacuacugcgcgcgguacuucuucggcagcuccccgaacuacugguacuucgacgucuggggccaggggacccuggugaccgugagcucc

SEQ ID NO: 8332 - RNA, 345 nt, Artificial Sequence
  derived and/or modified sequence opt1 from Pexelizumab_h5g1.1VHC_+_F_Heavy_Chain_V-Region
caggugcagcugguccagagcggcgccgaggugaagaagcccggggccuccgugaaggucagcugcaaggcguccggcuacaucuucagcaacuacuggauccagugggugcgccaggccccggggcagggccucgaguggaugggggagauccugcccggcuccggcagcaccgaguacgcccagaaguuccaggggcgggugaccaugacggccgacaccuccaccagcaccgccuacauggagcuguccagccuccgcuccgaggacacggcggucuacuacugcgcccgguacuucuucggcagcucccccaacugguacuucgugugggggcagggcacc

SEQ ID NO: 8333 - RNA, 318 nt, Artificial Sequence
  derived and/or modified sequence opt1 from Pexelizumab_h5g1.1VHC_+_F_Light_Chain_V-Region
gacauccagaugacccagagccccucccugagcgccuccgugggcgaccgcgucaccaucacgugcggggccagcgagaacaucuacggcgcgcucaacugguaccagcggaagccggggaaggcccccaagcugcugaucuacggcgccaccaaccucgccgacggggugcccucccgcuucagcggcuccggcagcgggaccgacuacacccugacgaucuccagccugcagcccgaggacuucgccaccuacuacugccagaacgugcucaacaccccgcugaccuucggccaggggacgaaggucgagaucaag

SEQ ID NO: 8334 - RNA, 1326 nt, Artificial Sequence
  derived and/or modified sequence opt1 from PF-05082566_HeavyChain1
gaggugcagcugguccagagcggcgccgaggugaagaagcccggggagucccuccgcaucagcugcaagggcuccggguacagcuucuccaccuacuggaucagcugggugcggcagaugccgggcaaggggcuggaguggaugggcaagaucuaccccggcgacuccuacaccaacuacagccccuccuuccaggggcaggucacgaucagcgccgacaaguccaucagcaccgcguaccugcagugguccagccucaaggccuccgacaccgccauguacuacugcgcccgcggcuacgggaucuucgacuacuggggccaggggacccuggugacggugagcuccgccagcaccaagggccccuccgucuucccgcuggcgcccugcagccggagcaccuccgagagcaccgccgcccucggcugccuggugaaggacuacuuccccgagcccgugacggucuccuggaacagcggggcccugaccuccggcgugcacaccuucccggcggugcuccagagcuccgggcuguacagccuguccagcgucgugaccgugcccuccagcaacuucggcacgcagaccuacacgugcaacgucgaccacaagcccuccaacaccaagguggacaagaccguggagcgcaagugcugcgucgagugcccgcccugccccgccccgcccguggccggccccagcguguuccucuucccgcccaagcccaaggacacccugaugaucucccggacccccgaggugaccugcgucguggucgacgugagccacgaggaccccgagguccaguucaacugguacguggacgggguggagguccacaacgccaagacgaagccccgcgaggagcaguucaacuccaccuuccggguggugagcguccugaccguggugcaccaggacuggcucaacggcaaggaguacaagugcaaggucuccaacaaggggcugcccgccccgaucgagaagaccaucagcaagacgaagggccagccccgcgagccccagguguacacccugcccccgagccgggaggagaugaccaagaaccaggugucccugaccugccucgucaagggguucuaccccagcgacaucgcgguggagugggaguccaacggccagcccgagaacaacuacaagacgaccccgcccaugcuggacagcgacggcuccuucuuccucuacagcaagcugaccguggacaagucccgcuggcagcaggggaacgucuucagcugcuccgugaugcacgaggcccugcacaaccacuacacccagaagucccucagccugagccccggcaag

SEQ ID NO: 8335 - RNA, 642 nt, Artificial Sequence
  derived and/or modified sequence opt1 from PF-05082568_LightChain1
agcuacgagcugacccagcccccguccgugagcgucucccccggccagaccgccagcaucacgugcuccggggacaacaucggcgaccaguacgcccacugguaccagcagaagcccgggcagagccccgugcucgugaucuaccaggacaagaaccgcccguccggcauccccgagcgguucagcggguccaacagcggcaacaccgcgacccugaccaucuccggcacgcaggccauggacgaggccgacuacuacugcgccaccuacaccggguucggcagccuggccgucuucgggggcgggaccaagcucacggugcugggccagcccaaggcggcccccuccgugacccuguucccgcccagcuccgaggagcuccaggccaacaaggccacccuggucugccugaucagcgacuucuaccccggcgcggugaccguggccuggaaggccgacuccagccccgucaaggccgggguggagacgaccaccccguccaagcagagcaacaacaaguacgccgcgagcuccuaccucagccugacccccgagcaguggaagucccaccgcagcuacuccugccaggugacgcacgagggcagcaccgucgagaagaccguggcccccaccgagugcucc

SEQ ID NO: 8336 - RNA, 1341 nt, Artificial Sequence
  derived and/or modified sequence opt1 from Pidilizumab_HeavyChain1
caggugcagcugguccagagcggcuccgagcucaagaagcccggggccagcgugaagaucuccugcaaggccagcggcuacaccuucaccaacuacgggaugaacugggugcgccaggcgccgggccaggggcugcaguggaugggcuggaucaacacggacuccggcgagagcaccuacgccgaggaguucaaggggcgguucgucuucucccuggacaccagcgugaacaccgccuaccuccagaucacgucccugaccgccgaggacaccggcauguacuucugcgugcgcgucggguacgacgcccuggacuacuggggccaggggacccucgugacggugagcuccgcgagcaccaagggccccuccgucuucccccuggcccccagcuccaagagcaccuccggcgggaccgccgcccugggcugccucgugaaggacuacuucccggagcccgugacggucagcuggaacuccggggcgcugaccagcggcgugcacaccuuccccgccgugcugcagagcuccggccucuacagccuguccagcgucgugaccgugcccuccagcucccuggggacgcagaccuacaucugcaacgucaaccacaagccgagcaacaccaagguggacaagcggguggagcccaaguccugcgacaagacccacacgugcccgcccugcccggcccccgagcuccugggcgggcccagcgucuuccuguucccgcccaagcccaaggacacccucaugaucucccgcacccccgaggugaccugcguggucguggacgucagccacgaggaccccgaggugaaguucaacugguacguggacggcgucgaggugcacaacgccaagacgaagccgcgggaggagcaguacaacuccaccuaccgcguggucagcgugcugaccgugcugcaccaggacuggcucaacgggaaggaguacaagugcaaggucuccaacaaggcccugcccgcgcccaucgagaagaccaucagcaaggccaagggccagccccgggagccccagguguacacgcugccgcccucccgcgaggagaugaccaagaaccaggugagccugaccugccucgucaagggcuucuaccccuccgacaucgccguggagugggagagcaacgggcagcccgagaacaacuacaagaccacgccgcccgugcuggacagcgacggcuccuucuuccucuacagcaagcugaccgucgacaagucccgguggcagcaggggaacguguucagcugcuccgugaugcacgaggcccugcacaaccacuacacccagaagucccucagccugagccccggcaag

SEQ ID NO: 8337 - RNA, 639 nt, Artificial Sequence
  derived and/or modified sequence opt1 from Pidilizumab_LightChain1
gagaucgugcugacccagagccccuccagccucuccgccagcgucggcgaccgggugaccaucacgugcuccgcccggagcuccgugagcuacaugcacugguuccagcagaagccggggaaggcgcccaagcuguggaucuaccgcaccuccaaccuggccagcggcguccccucccgguucagcggguccggcagcgggaccuccuacugccucaccaucaacagccugcagcccgaggacuucgccacguacuacugccagcagcgcuccagcuucccgcugaccuucggcggcgggaccaagcucgagaucaagcggaccguggccgcccccuccguguucaucuucccgcccagcgacgagcagcucaagagcggcacggcguccgucgugugccugcugaacaacuucuacccccgcgaggccaaggugcaguggaaggucgacaacgcccugcagagcgggaacucccaggagagcgugaccgagcaggacuccaaggacagcaccuacucccugagcuccacccucacgcugagcaaggccgacuacgagaagcacaagguguacgcgugcgaggucacccaccagggccuguccagccccgugaccaaguccuucaaccgcggggagugc

SEQ ID NO: 8338 - RNA, 1350 nt, Artificial Sequence
  derived and/or modified sequence opt1 from Pinatuzumab_vedotin_HeavyChain1
gaggugcagcuggucgagagcggcgggggccucgugcagcccgggggcucccugcgccugagcugcgccgccuccggguacgaguucagccgguccuggaugaacugggugcgccaggcgccgggcaagggccucgagugggucgggcggaucuaccccggcgacggggacaccaacuacagcggcaaguucaaggggcgcuucaccaucuccgccgacacgagcaagaacaccgccuaccugcagaugaacucccugcgggccgaggacaccgccguguacuacugcgcgcgcgacggcagcuccugggacugguacuucgacguguggggccaggggacccucgucacggugagcuccgccagcaccaagggccccuccguguucccccuggccccgagcuccaagagcaccuccgggggcaccgccgcgcugggcugccucgucaaggacuacuuccccgagcccgugacggugagcuggaacagcggggcccugaccuccggcguccacaccuuccccgccgugcugcagagcuccgggcucuacagccuguccagcguggucaccgugccguccagcucccugggcacgcagaccuacaucugcaacgugaaccacaagcccagcaacaccaaggucgacaagaagguggagcccaaguccugcgacaagacccacacgugcccgcccugccccgcccccgagcuccucgggggccccagcguguuccuguucccgcccaagcccaaggacacccucaugaucucccggacccccgaggugaccugcgucguggucgacgugagccacgaggacccggaggucaaguucaacugguacguggacggcguggagguccacaacgccaagacgaagccccgcgaggagcaguacaacuccaccuaccggguggugagcguccugaccgugcugcaccaggacuggcucaacgggaaggaguacaagugcaagguguccaacaaggcgcugcccgcccccaucgagaagaccaucagcaaggccaagggccagccgcgcgagccccaggucuacacgcugccgcccucccgggaggagaugaccaagaaccaggugagccugaccugccuggugaagggguucuaccccagcgacaucgccgucgagugggaguccaacggccagcccgagaacaacuacaagaccacgcccccggugcuggacagcgacggguccuucuuccucuacagcaagcugaccguggacaagucccgcuggcagcagggcaacgucuucagcugcuccgugaugcacgaggcccugcacaaccacuacacccagaagucccucagccugagccccggcaag

SEQ ID NO: 8339 - RNA, 657 nt, Artificial Sequence
  derived and/or modified sequence opt1 from Pinatuzumab_vedotin_LightChain1
gacauccagaugacccagagccccuccagccuguccgccagcgugggcgaccgcgucaccaucacgugccgguccagccaguccaucgugcacagcguggggaacaccuuccucgagugguaccagcagaagccgggcaaggcccccaagcugcugaucuacaaggucuccaaccgcuucagcggggugcccucccgguucagcggcuccgggagcggcaccgacuucacccucacgaucuccagccugcagcccgaggacuucgcgaccuacuacugcuuccagggcucccaguucccguacaccuucgggcagggcaccaagguggagaucaagcgcacggucgccgcccccagcguguucaucuucccgcccuccgacgagcagcucaagagcgggaccgccagcguggucugccugcugaacaacuucuacccccgggaggccaaggugcaguggaagguggacaacgcgcugcaguccggcaacagccaggaguccgucaccgagcaggacagcaaggacuccaccuacagccucuccagcacgcugacccuguccaaggccgacuacgagaagcacaagguguacgccugcgaggugacccaccaggggcucagcucccccgucaccaagagcuucaaccgcggcgagugc

SEQ ID NO: 8340 - RNA, 1023 nt, Artificial Sequence
  derived and/or modified sequence opt1 from Placulumab_chain1
gacauccagaugacccagagccccuccagccuguccgccagcgugggcgaccgcgucaccaucacgugccgggccucccaggcgaucgacagcuaccuccacugguaccagcagaagcccgggaaggcccccaagcugcugaucuacuccgccagcaaccucgagaccggcgugcccucccgcuucagcggguccggcagcgggaccgacuucacccugacgaucuccagccugcuccccgaggacuucgccaccuacuacugccagcaggucguguggcggccguucaccuucggccagggcaccaagguggagaucaagcgcguggagcccaaguccagcgacaagacgcacacgugcccgcccugccccgcccccgagcugcucgggggccccuccgucuuccuguucccgcccaagcccaaggacacccugaugaucagccggacccccgaggugaccugcguggucguggacgugucccacgaggaccccgaggucaaguucaacugguacguggacgggguggagguccacaacgcgaagaccaagccgcgcgaggagcaguacaacagcaccuaccggguggugagcguccugaccgugcuccaccaggacuggcugaacggcaaggaguacaagugcaagguguccaacaaggcccugcccgcccccaucgagaagacgaucagcaaggccaaggggcagccccgcgagccgcaggucuacacccucccgcccucccgggacgagcugaccaagaaccaggugagccugaccugccucgugaagggcuucuaccccuccgacaucgcggucgagugggagagcaacggccagcccgagaacaacuacaagacgaccccgcccgugcuggacuccgacgggagcuucuuccuguacuccaagcucaccgucgacaagagccgcuggcagcagggcaacguguucuccugcagcgugaugcacgaggcccugcacaaccacuacacccagaagucccugagccucucccccgggaag

SEQ ID NO: 8341 - RNA, 1023 nt, Artificial Sequence; identical to SEQ ID NO: 8340
  derived and/or modified sequence opt1 from Placulumab_HeavyChain1

SEQ ID NO: 8342 - RNA, 1341 nt, Artificial Sequence
  derived and/or modified sequence opt1 from Plozalizumab_HeavyChain1
gaggugcagcuggucgagagcggcgggggccucgugaagcccgggggcucccugcgccugagcugcgccgccuccggguucaccuucagcgcguacgccaugaacugggugcggcaggccccgggcaagggccucgagugggucgggcgcauccggaccaagaacaacaacuacgccacguacuacgccgacuccgugaaggaccgcuucaccaucagccgggacgacuccaagaacacccuguaccugcagaugaacagccucaagaccgaggacacggcgguguacuacugcaccaccuucuacggcaacggggucuggggccaggggacccuggugacgguguccagcgccuccaccaagggccccagcgucuucccccuggcccccuccagcaaguccaccagcggcgggaccgccgcgcucggcugccuggugaaggacuacuucccggagcccgugacggucuccuggaacagcggggcccugaccuccggcgugcacaccuuccccgccgugcuccagagcagcggccuguacucccugagcuccgucgugaccgugcccagcuccagccucgggacgcagaccuacaucugcaacgucaaccacaagccguccaacaccaagguggacaagaagguggagcccaagagcugcgacaagacccacacgugcccgcccugcccggcccccgagcuggccggcgcgcccuccgucuuccuguucccgcccaagcccaaggacacccucaugaucagccgcacccccgaggugaccugcguggucguggacgucucccacgaggaccccgaggugaaguucaacugguacguggacggggucgaggugcacaacgccaagacgaagccgcgggaggagcaguacaacagcaccuaccgcguggucuccgugcugaccgugcugcaccaggacuggcucaacggcaaggaguacaagugcaaggucagcaacaaggcccugcccgcccccaucgagaagaccaucuccaaggccaaggggcagccccgggagccccagguguacacgcugccgcccagccgcgacgagcucaccaagaaccaggugucccugaccugccuggucaagggcuucuaccccagcgacaucgcgguggagugggaguccaacggccagcccgagaacaacuacaagaccacgccgcccgugcucgacagcgacgggagcuucuuccuguacuccaagcugaccgucgacaagagccgguggcagcagggcaacguguucuccugcagcgugaugcacgaggcccuccacaaccacuacacccagaagucccugagccugucccccgggaag

SEQ ID NO: 8343 - RNA, 657 nt, Artificial Sequence
  derived and/or modified sequence opt1 from Plozalizumab_LightChain1
gacguggucaugacccagagcccccugucccucccggugacccugggccagcccgccagcaucuccugcaagagcucccagagccugcucgacuccgacgggaagacguuccugaacugguuccagcagcgccccggccagagcccccggcgccugaucuaccucguguccaagcuggacagcggggucccggaccgguucuccggcagcggguccggcaccgacuucacccugaagaucagccgcguggaggccgaggacgugggcgucuacuacugcuggcaggggacccacuuccccuacacguucggccaggggacccggcucgagaucaagcgcaccguggcggcccccuccguguucaucuucccgcccagcgacgagcagcugaaguccggcaccgccagcgucgugugccugcucaacaacuucuacccccgggaggccaaggugcaguggaaggucgacaacgcccugcaguccgggaacagccaggagagcgugacggagcaggacuccaaggacagcaccuacucccugagcuccacccucacccugagcaaggcggacuacgagaagcacaagguguacgccugcgaggucacgcaccagggccuguccagccccgugaccaaguccuucaaccgcggcgagugc

SEQ ID NO: 8344 - RNA, 1341 nt, Artificial Sequence
  derived and/or modified sequence opt1 from Pogalizumab_HeavyChain1
gaggugcagcugguccagagcggcgccgaggugaagaagcccggggccuccgugaaggucagcugcaaggcguccggcuacaccuucaccgacagcuacauguccugggugcgccaggccccggggcagggccucgaguggaucggggacauguaccccgacaacggcgacagcuccuacaaccagaaguuccgggagcgcgugacgaucacccgggacaccagcaccuccacggccuaccuggagcugagcucccuccgcagcgaggacaccgccgucuacuacugcgugcuggcgccccggugguacuucuccguguggggccaggggacccuggucaccgugagcuccgccagcacgaagggccccuccguguucccgcucgcccccagcuccaagagcaccagcgggggcaccgccgcccuggggugccuggucaaggacuacuuccccgagcccgugaccguguccuggaacagcggcgcgcucacguccggcguccacaccuucccggccgugcugcagagcuccgggcuguacagccucuccagcguggucaccgugcccuccagcucccugggcacccagacguacaucugcaacgugaaccacaagcccagcaacaccaaggucgacaagaagguggagcccaaguccugcgacaagacccacacgugcccgcccugccccgcccccgagcugcucgggggcccgagcguguuccuguucccgcccaagcccaaggacacccugaugaucucccgcacccccgaggugaccugcgucgucguggacgugagccacgaggaccccgaggucaaguucaacugguacguggacggcguggagguccacaacgccaagaccaagccccgggaggagcaguacaacuccacguaccgcguggugagcguccucaccgugcugcaccaggacuggcugaacgggaaggaguacaagugcaagguguccaacaaggcccuccccgcgccgaucgagaagaccaucagcaaggccaagggccagccccgggagccccaggucuacacccugcccccgagccgcgaggagaugacgaagaaccaggugucccugaccugccucgugaagggguucuaccccagcgacaucgccgucgagugggaguccaacggccagcccgagaacaacuacaagaccaccccgcccgugcuggacagcgacggguccuucuuccuguacagcaagcucacgguggacaagucccgguggcagcagggcaacgucuucagcugcuccgugaugcacgaggcccugcacaaccacuacacccagaagucccugagccucagccccggcaag

SEQ ID NO: 8345 - RNA, 642 nt, Artificial Sequence
  derived and/or modified sequence opt1 from Pogalizumab_LightChain1
gacauccagaugacccagagccccuccagccuguccgccagcgugggcgaccgggucaccaucacgugccgggccucccaggacaucagcaacuaccucaacugguaccagcagaagccggggaaggcgcccaagcugcugaucuacuacaccucccgccuccggagcggcgugcccucccgcuucagcggguccggcagcgggaccgacuucacccugacgaucuccagccugcagcccgaggacuucgccaccuacuacugccagcagggccacacccucccgcccaccuucggccaggggacgaagguggagaucaagcggaccgucgccgcccccuccguguucaucuucccgcccagcgacgagcagcugaaguccggcaccgccagcguggucugccugcucaacaacuucuacccccgcgaggcgaaggugcaguggaagguggacaacgcccugcaguccgggaacagccaggagagcgucaccgagcaggacuccaaggacagcacguacucccugagcuccacccucacccugagcaaggccgacuacgagaagcacaagguguacgccugcgaggugacccaccagggccuguccagccccgucacgaaguccuucaaccgcggggagugc

SEQ ID NO: 8346 - RNA, 1341 nt, Artificial Sequence
  derived and/or modified sequence opt1 from Polatuzumab_vedotin_HeavyChain1
gaggugcagcuggucgagagcggcgggggccucgugcagcccgggggcucccugcgccugagcugcgccgccuccggguacaccuucagcuccuacuggaucgagugggugcggcaggcgccgggcaagggccucgaguggaucggggagauccugcccggcgggggcgacaccaacuacaacgagaucuucaaggggcgcgccacguucagcgccgacaccuccaagaacaccgccuaccugcagaugaacagccuccgggccgaggacaccgcggucuacuacugcacgcgccgggugcccauccgccuggacuacuggggccagggcacccuggugaccgucuccagcgccuccaccaaggggcccagcguguucccgcucgcccccuccagcaaguccacgagcggcgggaccgccgcgcugggcugccuggugaaggacuacuuccccgagcccgucaccguguccuggaacagcggcgcccucaccuccggggugcacacguucccggccguccugcagagcagcggccuguacucccucagcuccguggugaccguccccagcuccagccuggggacccagaccuacaucugcaacgugaaccacaagcccuccaacacgaagguggacaagaaggucgagcccaagagcugcgacaagacccacacgugcccgcccugccccgcccccgagcugcucggcgggccguccguguuccuguucccgcccaagcccaaggacacccugaugaucagccggacccccgaggugaccugcgucgugguggacgucucccacgaggaccccgaggugaaguucaacugguacgucgacggcguggaggugcacaacgccaagaccaagccccgcgaggagcaguacaacagcaccuaccgggucguguccgugcucacgguccugcaccaggacuggcugaacggcaaggaguacaagugcaaggugagcaacaaggcgcuccccgccccgaucgagaagaccaucuccaaggccaaggggcagccccgcgagccccagguguacacccugcccccgagccgggaggagaugaccaagaaccaggucucccugacgugccucgugaagggcuucuaccccagcgacaucgccguggagugggaguccaacgggcagcccgagaacaacuacaagaccaccccgcccguccuggacagcgacggcagcuucuuccuguacuccaagcucaccguggacaagagccgcuggcagcaggggaacguguucuccugcagcgucaugcacgaggcccugcacaaccacuacacgcagaagucccugagccucucccccggcaag

SEQ ID NO: 8347 - RNA, 654 nt, Artificial Sequence
  derived and/or modified sequence opt1 from Polatuzumab_vedotin_LightChain1
gacauccagcugacccagagccccuccagccucuccgccagcgugggcgaccgcgucaccaucacgugcaaggccucccagagcguggacuacgagggggacuccuuccugaacugguaccagcagaagccgggcaaggcgcccaagcugcucaucuacgccgccagcaaccuggaguccggggugcccagccgguucuccggcagcggguccggcaccgacuucacccugaccaucagcucccuccagcccgaggacuucgccacguacuacugccagcagagcaacgaggacccgcugaccuucggccaggggaccaaggucgagaucaagcgcaccguggccgcgcccuccguguucaucuucccgcccagcgacgagcagcugaaguccggcacggccagcgucgugugccuccugaacaacuucuacccccgggaggccaaggugcaguggaaggucgacaacgcccugcagagcgggaacucccaggagagcgugaccgagcaggacuccaaggacagcaccuacucccucagcuccacccugacgcugagcaaggcggacuacgagaagcacaagguguacgccugcgaggucacccaccagggccucuccagccccgugaccaaguccuucaaccgcggggagugc

SEQ ID NO: 8348 - RNA, 1326 nt, Artificial Sequence
  derived and/or modified sequence opt1 from Ponezumab_HeavyChain1
caggugcagcugguccagagcggcgccgaggugaagaagcccggggccuccgugaaggucagcugcaaggcguccggcuacuacaccgaggccuacuacauccacugggugcgccaggccccggggcagggccucgaguggauggggcggaucgaccccgccaccggcaacacgaaguacgcgccccgccugcaggaccgggugaccaugacccgcgacaccagcacguccaccgucuacauggagcugagcucccuccggagcgaggacaccgccguguacuacugcgccucccuguacagccugcccguguacuggggccaggggaccacggucaccguguccagcgccuccaccaagggcccgagcguguucccccucgcccccugcucccgcagcaccuccgagagcacggcggcccuggggugccuggucaaggacuacuuccccgagccggugaccguguccuggaacagcggcgcccucaccagcgggguccacaccuuccccgccgugcugcaguccagcggccuguacucccucagcuccguggucacggugcccagcuccaacuucggcacccagaccuacacgugcaacguggaccacaagcccagcaacaccaaggucgacaagaccguggagcggaagugcugcguggagugcccgcccugccccgcgcccccggucgccgggcccuccguguuccuguucccgcccaagcccaaggacacccugaugaucagccgcacccccgaggucacgugcgugguggucgacgugucccacgaggaccccgaggugcaguucaacugguacgucgacggcguggaggugcacaacgccaagaccaagccccgggaggagcaguucaacagcaccuuccgcgucguguccgugcucaccgucgugcaccaggacuggcugaacgggaaggaguacaagugcaaggugagcaacaagggccugccguccagcaucgagaagacgaucuccaagaccaagggccagccccgggagccccaggucuacacccugcccccgagccgcgaggagaugaccaagaaccaggugucccucacgugccuggugaagggguucuaccccagcgacaucgccgucgagugggagagcaacggccagcccgagaacaacuacaagaccaccccgcccaugcucgacuccgacgggagcuucuuccuguacuccaagcugaccguggacaagagccgguggcagcagggcaacguguucuccugcagcgucaugcacgaggcccuccacaaccacuacacgcagaagucccugagccugucccccgggaag

SEQ ID NO: 8349 - RNA, 657 nt, Artificial Sequence
  derived and/or modified sequence opt1 from Ponezumab_LightChain1
gacguggucaugacgcagagcccccugucccucccggugacccugggccagcccgccagcaucuccugcaagagcucccagagccugcucuacuccgacgccaagacguaccugaacugguuccagcagcgccccgggcagagcccccggcgccugaucuaccagaucucccggcucgacccgggcgugcccgaccgcuucagcggguccggcagcgggaccgacuucacccugaagaucucccgggucgaggcggaggacgugggcguguacuacugccugcagggcacccacuaccccguccucuucgggcagggcacgcgccuggagaucaagcggaccguggccgcccccagcguguucaucuucccgcccuccgacgagcagcucaagagcgggaccgccuccgucgugugccugcugaacaacuucuacccccgcgaggccaaggugcaguggaaggucgacaacgcgcugcagagcggcaacucccaggagagcgugaccgagcaggacagcaaggacuccacguacagccucuccagcacccugacccuguccaaggccgacuacgagaagcacaagguguacgccugcgaggucacccaccaggggcucagcucccccgugaccaagagcuucaaccggggcgagugc

SEQ ID NO: 8350 - RNA, 1362 nt, Artificial Sequence
  derived and/or modified sequence opt1 from Pritoxaximab_HeavyChain1
caggugcagcugcaggagagcggcgccgagcucguccgcuccggggccagcgugcggauguccugcaaggcgagcggcuacaccuucaccuccuacaacaugcacugggugaagcagacgcccgggcagggccuggaguggaucggguacaucuacccgggcaacggcgggaccaacuacauccagaaguucaagggcaaggccauccugaccgccgacaccagcuccagcacggccuacaugcagaucuccagccucaccuccgaggacagcgccgucuacuucugcacccgcucccccagccacuacuccagcgaccccuacuucgacuacugggggcagggcaccacgcugaccguguccagcgaguucgcguccaccaaggggcccagcguguucccgcuggcccccagcuccaagagcaccuccggcggcacggccgcccucgggugccuggucaaggacuacuuccccgagcccgugaccgugagcuggaacuccggcgcgcugaccagcgggguccacaccuucccggccgugcuccaguccagcggccuguacucccugagcuccguggucacggugcccagcuccagccucggcacccagaccuacaucugcaacgugaaccacaagcccuccaacaccaaggucgacaagaagguggagcccaagagcugcgacaagacgcacacgugcccgcccugccccgcccccgagcugcucgggggcccguccguguuccucuucccgcccaagcccaaggacacccugaugaucagccggacccccgaggugaccugcgucguggucgacgugucccacgaggaccccgaggugaaguucaacugguacgucgacgggguggagguccacaacgccaagaccaagccccgcgaggagcaguacaacagcaccuaccggguggugagcguccugaccgugcuccaccaggacuggcugaacggcaaggaguacaagugcaagguguccaacaaggcccugcccgcgccgaucgagaagacgaucagcaaggccaaggggcagccccgcgagccccaggucuacacccugcccccgucccgggacgagcugaccaagaaccaggugagccugaccugccucgugaagggcuucuaccccuccgacaucgccgucgagugggagagcaacggccagcccgagaacaacuacaagacgaccccgcccgugcuggacuccgacgggagcuucuuccuguacuccaagcucaccguggacaagagccgcuggcagcagggcaacgucuucuccugcagcgugaugcacgaggcccugcacaaccacuacacccagaagucccugagccucucccccgggaag

SEQ ID NO: 8351 - RNA, 642 nt, Artificial Sequence
  derived and/or modified sequence opt1 from Pritoxaximab_LightChain1
gacaucgugaugagccagucccacaaguucaugagcaccuccgucggcgaccgggugagcaucacgugcaaggccucccaggacguggggaccgccgucgcgugguaccagcagaaccccggccagagcccgaaguuccugaucuacugggccuccacccggcacaccggggugcccgaccgcuucaccggcagcggguccggcacggacuucacccucaccaucaccaacgugcagagcgaggaccuggccgacuacuucugccagcaguacuccagcuacccccugacguucggcgccgggaccucccucgagcugaagcggaccgucgccgcgcccagcguguucaucuucccgcccuccgacgagcagcucaagagcggcaccgccuccguggucugccugcugaacaacuucuacccccgcgaggccaaggugcaguggaagguggacaacgcccugcagagcgggaacucccaggagagcgucacggagcaggacagcaaggacuccaccuacagccucuccagcacccugacccuguccaaggcggacuacgagaagcacaagguguacgccugcgaggugacgcaccagggccucagcucccccgucaccaagagcuucaaccgcggggagugc

SEQ ID NO: 8352 - RNA, 1350 nt, Artificial Sequence
  derived and/or modified sequence opt1 from Pritumumab_HeavyChain1
gaggugcagcugcucgagagcggcggggaccugguccagcccggcgggucccugcgccucagcugcgccgccuccggcuucaccuucagcaacuacgcgauguccugggugcggcaggcccccgggaagggccuggagugggugagcgccaucacccccuccggcgggagcacgaacuacgccgacuccgucaagggccgcuucaccaucagccgggacaacucccagaacacccuguaccuccagaugaacagccugcgcguggaggacaccgccguguacaucugcgggcggguccccuaccgcuccacgugguacccccuguacuggggccaggggacccucgugaccgugagcuccgcgagcaccaagggcccguccgucuucccccuggcccccagcuccaagagcacgagcggcgggaccgccgcccugggcugccucgugaaggacuacuuccccgagccggugaccgucuccuggaacagcggggcgcugaccuccggcgugcacacguuccccgccgugcugcagagcuccggccucuacagccuguccagcgucgugaccgugcccuccagcucccuggggacccagaccuacaucugcaacgucaaccacaagcccagcaacacgaagguggacaagaagguggagccgaaguccugcgacaagacccacacgugcccgcccugccccgcccccgagcuccugggcgggcccagcgucuuccuguucccgcccaagcccaaggacacccucaugaucucccggacccccgaggugaccugcguggucguggacgucagccacgaggaccccgaggugaaguucaacugguacguggacggcgucgaggugcacaacgccaagaccaagccccgcgaggagcaguacaacuccaccuaccggguggucagcgugcugacggugcugcaccaggacuggcucaacgggaaggaguacaagugcaaggucuccaacaaggcccugccggcgcccaucgagaagaccaucagcaaggccaagggccagccccgcgagccccagguguacacccugccgcccagccgggacgagcucaccaagaaccaggugucccugacgugccuggucaagggcuucuaccccagcgacaucgccguggagugggaguccaacgggcagccggagaacaacuacaagaccaccccgcccgugcucgacagcgacggcuccuucuuccuguacagcaagcugaccgucgacaagucccgcuggcagcaggggaacguguucagcugcuccgugaugcacgaggcccuccacaaccacuacacgcagaagucccugagccugagccccggcaag

SEQ ID NO: 8353 - RNA, 642 nt, Artificial Sequence
  derived and/or modified sequence opt1 from Pritumumab_LightChain1
gacauccagaugacccagagccccuccagccuguccgccagcgugggcgaccgcgucaccaucacgugccgggccucccaggacaucagcaacuaccucgcgugguuccagcagaagccggggaaggcccccaagucccugaucuacgccgccagcucccugcacagcaaggugcccacccaguucuccggcagcggguccggcaccgacuucacccucacgaucagcucccugcagcccgaggacuucgccaccuacuacugccugcaguacagcaccuacccgaucaccuucgggggcggcacgaagguggagaucaagcgcaccgucgcggcccccuccguguucaucuucccgcccagcgacgagcagcucaaguccgggaccgccagcguggucugccugcugaacaacuucuacccccgggaggccaaggugcaguggaagguggacaacgcgcuccagagcggcaacucccaggagagcgucaccgagcaggacuccaaggacagcacguacucccugagcuccacccugacccucagcaaggccgacuacgagaagcacaagguguacgccugcgaggugacccaccaggggcuguccagccccgucacgaaguccuucaaccgcggcgagugc

SEQ ID NO: 8354 - RNA, 1341 nt, Artificial Sequence
  derived and/or modified sequence opt1 from Quilizumab_HeavyChain1
gaggugcagcuggucgagagcggcgggggccucgugcagcccgggggcucccugcgccugagcugcgccgccuccggguucaccuucagcgacuacggcaucgcgugggugcggcaggccccgggcaaggggcucgagugggucgccuucaucuccgaccuggccuacaccaucuacuacgccgacacggugaccggccgcuucaccaucagccgggacaacuccaagaacacccuguaccuccagaugaacagccugcgcgcggaggacacggccguguacuacugcgcccgggacaacugggacgccauggacuacugggggcagggcacccuggucaccguguccagcgcguccaccaaggggcccagcguguucccccucgcccccuccagcaaguccacgagcggcggcaccgccgcccuggggugccuggucaaggacuacuucccggagcccgugaccguguccuggaacagcggcgcccucaccuccgggguccacacguuccccgcggugcugcagagcagcggccuguacucccucagcuccguggucaccgugcccagcuccagccugggcacccagaccuacaucugcaacgugaaccacaagccguccaacacgaaggucgacaagaagguggagcccaagagcugcgacaagacccacacgugcccgcccugccccgcccccgagcugcucgggggccccuccguguuccuguucccgcccaagcccaaggacacccugaugaucagccgcacccccgaggugaccugcgucguggucgacgugucccacgaggaccccgaggucaaguucaacugguacguggacgggguggagguccacaacgccaagaccaagccgcgggaggagcaguacaacagcaccuaccgcgugguguccguccucacggugcugcaccaggacuggcugaacggcaaggaguacaagugcaaggugagcaacaaggcccuccccgcccccaucgagaagaccaucuccaaggcgaaggggcagccccgggagccgcaggucuacacccugccgcccagccgcgaggagaugaccaagaaccaggugucccugacgugccucgugaagggcuucuaccccagcgacaucgccgucgagugggaguccaacggccagcccgagaacaacuacaagaccaccccgcccgugcuggacagcgacgggagcuucuuccuguacuccaagcucaccguggacaagagccgguggcagcagggcaacgucuucuccugcagcgugaugcacgaggcccugcacaaccacuacacgcagaagucccugagccucucccccgggaag

SEQ ID NO: 8355 - RNA, 657 nt, Artificial Sequence
  derived and/or modified sequence opt1 from Quilizumab_LightChain1
gacauccagaugacccagagccccuccagccuguccgccagcgugggcgaccgcgucaccaucacgugccgguccagccagucccucgugcacaacaacgccaacaccuaccugcacugguaccagcagaagccggggaaggcgcccaagcugcucaucuacaaggugagcaaccgcuucuccggcguccccagccgguucuccgggagcggcuccgggaccgacuucacccugacgaucagcucccugcagcccgaggacuucgccaccuacuacugcagccagaacacccucgugccguggaccuucggccagggcacgaagguggagaucaagcgcaccgucgccgcccccuccguguucaucuucccgcccagcgacgagcagcugaaguccgggaccgccagcguggucugccugcucaacaacuucuacccccgggaggcgaaggugcaguggaagguggacaacgcccugcagagcggcaacucccaggagagcgucaccgagcaggacuccaaggacagcacguacucccugagcuccacccucacccugagcaaggccgacuacgagaagcacaagguguacgccugcgaggugacccaccaggggcuguccagccccgucacgaaguccuucaaccgcggcgagugc

SEQ ID NO: 8356 - RNA, 1335 nt, Artificial Sequence
  derived and/or modified sequence opt1 from Racotumomab_HeavyChain1
caggugcagcugcagcagagcggcgccgagcucgucaagcccggggccuccgugaagcugagcugcaaggcguccggcuacaccuucaccagcuacgacaucaacugggugcgccagcggccggagcaggggcuggaguggaucggcuggaucuuccccggggacggcuccaccaaguacaacgagaaguucaagggcaaggccacccucaccaccgacaagagcuccagcacggccuacaugcagcugucccgccugaccagcgaggacuccgccgucuacuucugcgcccgggaggacuacuacgacaacagcuacuacuucgacuacugggggcagggcaccacccucacgguguccagcgcgaagaccaccccgcccuccguguacccccuggcccccgggagcgccgcccagaccaacuccauggucacgcugggcugccucgugaagggguacuuccccgagcccgugaccgucaccuggaacagcggcucccugagcagcggcgugcacaccuucccggcggugcugcaguccgaccucuacacgcugagcuccagcgucaccgugcccuccagcccccgccccuccgagaccgugaccugcaacgucgcccacccggccagcuccacgaagguggacaagaagaucgugccccgggacugcgggugcaagcccugcaucugcaccguccccgaggugagcuccguguucaucuucccgcccaagcccaaggacguccugaccaucacccucacgcccaaggugaccugcguggucguggacaucagcaaggacgacccggagguccaguucuccugguucguggacgacguggagguccacaccgcccagacccagccccgcgaggagcaguucaacagcacguuccgguccgugagcgagcugcccaucaugcaccaggacuggcugaacggcaaggaguucaagugccgcgugaacuccgccgcguuccccgccccgaucgagaagaccaucagcaagaccaaggggcggcccaaggcgccccaggucuacaccaucccgccgcccaaggagcagauggccaaggacaaggugucccucacgugcaugaucaccgacuucuuccccgaggacaucaccguggaguggcaguggaacggccagcccgccgagaacuacaagaacacccagcccaucaugaacacgaacggcagcuacuucgucuacagcaagcugaacgugcagaaguccaacugggaggccgggaacaccuucacgugcagcgugcugcacgagggccuccacaaccaccacaccgagaagucccugagccacucccccgggaag

SEQ ID NO: 8357 - RNA, 642 nt, Artificial Sequence
  derived and/or modified sequence opt1 from Racotumomab_LightChain1
gacauccagaugacccagaccacgagcucccugagcgccucccucggcgaccgcgugaccaucagcugccgggccucccaggacaucagcaacuaccugaacugguaccagcagaagcccgacgggaccgucaagcugcucaucuacuacaccucccgccugcacagcggcgugccgucccgguucagcggguccggcagcgggacggacuacucccugaccaucagcaaccucgagcaggaggacaucgcgaccuacuucugccagcagggcaacacccugcccuggacguucggcgggggcaccaagcuggagaucaagcgcgccgacgccgcccccaccguguccaucuucccgcccagcuccgagcagcucaccagcgggggcgccuccgucgugugcuuccugaacaacuucuaccccaaggacaucaacgugaaguggaagaucgacgggagcgagcggcagaacggcguccugaacagcuggacggaccaggacuccaaggacagcaccuacuccaugagcuccacccucacccugacgaaggacgaguacgagcgccacaacagcuacacgugcgaggcgacccacaagaccuccaccagccccaucgugaaguccuucaaccggaacgagugc

SEQ ID NO: 8358 - RNA, 1089 nt, Artificial Sequence; identical to SEQ ID NO: 8296
  derived and/or modified sequence opt1 from Racotumomab_scVH-VH'-VH_chain

SEQ ID NO: 8359 - RNA, 1071 nt, Artificial Sequence
  derived and/or modified sequence opt1 from Radretumab_HeavyChain1
gaggugcagcugcucgagagcggcgggggccugguccagcccgggggcucccugcgccucagcugcgccgccuccggguucaccuucagcuccuucagcauguccugggugcggcaggcgccgggcaagggccuggagugggugagcuccaucagcggguccagcggcaccacguacuacgccgacuccgucaaggggcgcuucaccaucagccgggacaacuccaagaacacccuguaccuccagaugaacagccugcgcgccgaggacaccgccguguacuacugcgccaagcccuuccccuacuucgacuacuggggccaggggacgcuggugaccgucuccagcggcgacggcuccagcgggggcagcgggggcgcguccgagaucgugcucacccagagccccggcacccugucccugagcccgggggagcgggccacgcucuccugccgcgccagccaguccgugagcuccagcuuccuggccugguaccagcagaagcccggccaggcgccccggcugcucaucuacuacgccuccagccgcgccaccgggauccccgaccgguucuccggcagcggguccggcaccgacuucacccugacgaucagccgccuggagccggaggacuucgccgucuacuacugccagcagaccggccggaucccgcccaccuucgggcagggcaccaagguggagaucaaguccgggggcagcgggggcccccgcgccgcgcccgagguguacgccuucgccacgcccgaguggcccggcucccgggacaagcgcacccucgccugccugauccagaacuucaugcccgaggacaucagcguccaguggcugcacaacgaggugcagcucccggacgcccggcacagcaccacccagccccgcaagacgaagggguccggcuucuucguguucagccggcuggaggucacccgcgcggagugggagcagaaggacgaguucaucugccgggccgugcacgaggccgccucccccagccagaccgugcagcgcgccgucuccgugaaccccgagagcucccggcgcgggggcugc

SEQ ID NO: 8360 - RNA, 414 nt, Artificial Sequence; identical to SEQ ID NO: 8311
  derived and/or modified sequence opt1 from Radretumab_j_chain

SEQ ID NO: 8361 - RNA, 1368 nt, Artificial Sequence
  derived and/or modified sequence opt1 from Rafivirumab_HeavyChain1
caggugcagcugguccagagcggcgccgaggugaagaagcccggguccagcgugaaggucuccugcaaggccagcggcgggaccuucaaccgcuacaccgugaacugggugcggcaggcgccgggccaggggcucgaguggaugggcggcaucauccccaucuucgggacggccaacuacgcccagcgcuuccagggccggcugaccaucaccgccgacgaguccaccagcacggccuacauggagcuguccagccuccgcuccgacgacaccgcggucuacuucugcgcccgggagaaccuggacaacagcgggaccuacuacuacuucuccggcugguucgaccccugggggcagggcacccuggugacggugagcuccgccagcaccaagggccccuccgucuucccgcucgcccccagcuccaagagcaccuccgggggcaccgcggcccuggggugccuggugaaggacuacuuccccgagcccgugacggucagcuggaacagcggcgcccucaccuccggcgugcacaccuucccggccgugcugcagagcuccgggcuguacagccucuccagcgucgugaccgugcccuccagcucccugggcacgcagaccuacaucugcaacgucaaccacaagcccagcaacaccaagguggacaagcgcguggagcccaaguccugcgacaagacccacacgugcccgcccugccccgcccccgagcugcucgggggcccgagcgucuuccuguucccgcccaagcccaaggacacccugaugaucucccggacccccgaggugaccugcguggucguggacgucagccacgaggaccccgaggugaaguucaacugguacguggacggggucgaggugcacaacgcgaagacgaagccccgcgaggagcaguacaacuccaccuaccggguggucagcgugcucaccgugcugcaccaggacuggcugaacggcaaggaguacaagugcaaggucuccaacaaggcccuccccgccccgaucgagaagaccaucagcaaggccaagggccagccccgcgagccccagguguacacgcugcccccgucccgggaggagaugaccaagaaccaggugagccugaccugccucgucaagggguucuaccccagcgacaucgccguggagugggaguccaacggccagcccgagaacaacuacaagaccacgccgcccgugcuggacagcgacggguccuucuuccuguacagcaagcucaccgucgacaagucccgcuggcagcagggcaacguguucagcugcuccgugaugcacgaggcgcugcacaaccacuacacccagaagucccugagccucagccccggg

SEQ ID NO: 8362 - RNA, 1368 nt, Artificial Sequence
  derived and/or modified sequence opt1 from Rafivirumab_HeavyChain
gaggugcagcugguccagagcggcgccgaggugaagaagcccggguccagcgugaaggucuccugcaaggccagcggcgggaccuucaaccgcuacaccgugaacugggugcggcaggcgccgggccaggggcucgaguggaugggcggcaucauccccaucuucgggacggccaacuacgcccagcgcuuccagggccggcugaccaucaccgccgacgaguccaccagcacggccuacauggagcuguccagccuccgcuccgacgacaccgcggucuacuucugcgcccgggagaaccuggacaacagcgggaccuacuacuacuucuccggcugguucgaccccugggggcagggcacccuggugacggugagcuccgccagcaccaagggccccuccgucuucccgcucgcccccagcuccaagagcaccuccgggggcaccgcggcccuggggugccuggugaaggacuacuuccccgagcccgugacggucagcuggaacagcggcgcccucaccuccggcgugcacaccuucccggccgugcugcagagcuccgggcuguacagccucuccagcgucgugaccgugcccuccagcucccugggcacgcagaccuacaucugcaacgucaaccacaagcccagcaacaccaagguggacaagcgcguggagcccaaguccugcgacaagacccacacgugcccgcccugccccgcccccgagcugcucgggggcccgagcgucuuccuguucccgcccaagcccaaggacacccugaugaucucccggacccccgaggugaccugcguggucguggacgucagccacgaggaccccgaggugaaguucaacugguacguggacggggucgaggugcacaacgcgaagacgaagccccgcgaggagcaguacaacuccaccuaccggguggucagcgugcucaccgugcugcaccaggacuggcugaacggcaaggaguacaagugcaaggucuccaacaaggcccuccccgccccgaucgagaagaccaucagcaaggccaagggccagccccgcgagccccagguguacacgcugcccccgucccgggaggagaugaccaagaaccaggugagccugaccugccucgucaagggguucuaccccagcgacaucgccguggagugggaguccaacggccagcccgagaacaacuacaagaccacgccgcccgugcuggacagcgacggguccuucuuccuguacagcaagcucaccgucgacaagucccgcuggcagcagggcaacguguucagcugcuccgugaugcacgaggcgcugcacaaccacuacacccagaagucccugagccucagccccggg

SEQ ID NO: 8363 - RNA, 654 nt, Artificial Sequence
  derived and/or modified sequence opt1 from Rafivirumab_LightChain1
cagagcgcccugacccagccccgcuccgugagcggcuccccggggcagagcgucaccaucuccugcacgggcaccagcuccgacaucgggggcuacaacuucgugagcugguaccagcagcaccccgggaaggcccccaagcucaugaucuacgacgcgaccaagcggcccuccggcgugccggaccgcuucagcggcuccaagagcgggaacaccgccucccugacgaucagcggccugcaggccgaggacgaggccgacuacuacugcugcuccuacgccggggacuacacccccggcgucguguucgggggcggcaccaagcucaccgugcuggggcagcccaaggcggcccccagcgucacgcuguucccgcccuccagcgaggagcuccaggccaacaaggccacccuggugugccugaucuccgacuucuaccccggcgcggugaccgucgccuggaaggccgacagcagccccgugaaggccgggguggagaccacgaccccguccaagcagagcaacaacaaguacgccgcguccagcuaccucucccugacccccgagcaguggaagucccaccggagcuacagcugccaggucacccacgagggcuccacgguggagaagaccguggcccccaccgagugcagc

SEQ ID NO: 8364 - RNA, 654 nt, Artificial Sequence
  derived and/or modified sequence opt1 from Rafivirumab_LightChain
gagagcgcccugacccagccccgcuccgugagcggcuccccggggcagagcgucaccaucuccugcacgggcaccagcuccgacaucgggggcuacaacuucgugagcugguaccagcagcaccccgggaaggcccccaagcucaugaucuacgacgcgaccaagcggcccuccggcgugccggaccgcuucagcggcuccaagagcgggaacaccgccucccugacgaucagcggccugcaggccgaggacgaggccgacuacuacugcugcuccuacgccggggacuacacccccggcgucguguucgggggcggcaccaagcucaccgugcuggggcagcccaaggcggcccccagcgucacgcuguucccgcccuccagcgaggagcuccaggccaacaaggccacccuggugugccugaucuccgacuucuaccccggcgcggugaccgucgccuggaaggccgacagcagccccgugaaggccgggguggagaccacgaccccguccaagcagagcaacaacaaguacgccgcguccagcuaccucucccugacccccgagcaguggaagucccaccggagcuacagcugccaggucacccacgagggcuccacgguggagaagaccguggcccccaccgagugcagc

SEQ ID NO: 8365 - RNA, 1332 nt, Artificial Sequence
  derived and/or modified sequence opt1 from Ralpancizumab_HeavyChain1
caggugcagcugguccagagcggcgccgaggugaagaagcccggggccuccgugaaggucagcugcaaggcguccggcuacaccuucaccagcuacuacaugcacugggugcgccaggccccggggcagggccucgaguggaugggggagauccaccccuccggcggccggacgaacuacaacgagaaguucaagagccgcgugaccaugacccgggacaccuccacgagcaccgucuacauggagcuguccagccugcgcuccgaggacaccgccguguacuacugcgcccgggagcgcccccucuacgccagcgaccugugggggcagggcaccacggugaccgucuccagcgcguccaccaaggggcccagcguguucccgcuggcccccugcucccggagcaccuccgagagcacggccgcccucggcugccuggugaaggacuacuuccccgagcccgucaccgugagcuggaacuccggggcgcugaccagcggcgugcacaccuucccggccguccuccaguccagcggccuguacucccugagcuccguggugacgguccccagcuccaacuucgggacccagaccuacacgugcaacguggaccacaagcccagcaacaccaagguggacaagaccgucgagcgcaagugcugcguggagugcccgcccugccccgccccgcccguggccggccccuccgucuuccucuucccgcccaagcccaaggacacccugaugaucagccggacccccgaggugacgugcgucgugguggacgucucccacgaggaccccgaggugcaguucaacugguacguggacggggucgaggugcacaacgccaagaccaagccccgcgaggagcaguucaacagcaccuuccggguggucuccgugcugaccgugguccaccaggacuggcucaacggcaaggaguacaagugcaaggugagcaacaagggccugcccuccagcaucgagaagacgaucuccaagaccaaggggcagccgcgcgagccccagguguacacccugccgcccagccgggaggagaugaccaagaaccaggucagccucacgugccuggugaagggcuucuaccccuccgacaucgcgguggagugggagagcaacgggcagcccgagaacaacuacaagaccacgcccccgaugcuggacuccgacggcagcuucuuccucuacuccaagcugaccgucgacaagagccgcuggcagcaggggaacguguucuccugcagcgugaugcacgaggcccugcacaaccacuacacccagaagucccucagccugucccccggcaag

SEQ ID NO: 8366 - RNA, 642 nt, Artificial Sequence
  derived and/or modified sequence opt1 from Ralpancizumab_LightChain1
gacauccagaugacgcagagccccuccagccuguccgccagcgugggcgaccgcgucaccaucacgugcaaggccucccaggacgugcacaccgcgguggccugguaccagcagaagccggggaaggcccccaagcuccugaucuaccacgccagcuaccgguacaccggcguccccucccgcuucagcggguccggcagcgggaccgacuucacguucaccaucuccagccugcagcccgaggacaucgccaccuacuacugccagcagcgguacucccucuggcgcaccuucggccagggcacgaagcuggagaucaagcggaccguggcggccccgagcguguucaucuucccgcccuccgacgagcagcucaagagcgggaccgccuccgucgugugccugcugaacaacuucuacccccgcgaggccaaggugcaguggaaggucgacaacgcgcugcagagcggcaacucccaggagagcgugaccgagcaggacagcaaggacuccacguacagccucuccagcacccugacccuguccaaggccgacuacgagaagcacaagguguacgccugcgaggucacccaccaggggcucagcucccccgugaccaagagcuucaaccggggcgagugc

SEQ ID NO: 8367 - RNA, 1338 nt, Artificial Sequence
  derived and/or modified sequence opt1 from Ramucirumab_HeavyChain1
gaggugcagcugguccagagcggcgggggccucgugaagcccgggggcucccugcgccugagcugcgccgccuccggguucaccuucagcuccuacagcaugaacugggugcggcaggcgccgggcaagggccucgagugggucuccagcaucuccagcuccagcuccuacaucuacuacgccgacagcgugaaggggcgcuucaccaucucccgggacaacgccaagaacagccuguaccugcagaugaacucccuccgcgccgaggacacggccguguacuacugcgcgcgggucaccgacgccuucgacaucuggggccaggggaccauggugaccgugagcuccgccagcacgaagggccccagcgucuucccccuggcccccuccagcaaguccaccagcgggggcaccgcggcccugggcugccucgugaaggacuacuucccggagcccgugaccgucuccuggaacagcggggcccugacguccggcgugcacaccuuccccgccgugcugcagagcuccgggcucuacagccuguccagcgucgugaccgugcccuccagcucccugggcacccagacguacaucugcaacgucaaccacaagccgagcaacaccaagguggacaagaagguggagcccaaguccugcgacaagacccacacgugcccgcccugcccggcccccgagcuccugggcgggcccagcgucuuccuguucccgcccaagcccaaggacacccucaugaucucccgcacccccgaggugaccugcguggucguggacgucagccacgaggaccccgaggugaaguucaacugguacguggacggcgucgaggugcacaacgcgaagaccaagccgcgggaggagcaguacaacagcacguaccgcguggucuccgugcugaccgugcugcaccaggacuggcucaacgggaaggaguacaagugcaaggucagcaacaaggcccugcccgcccccaucgagaagaccaucuccaaggccaagggccagccccgggagccccagguguacacccugccgcccagccgcgaggagaugacgaagaaccaggugucccugaccugccucgucaagggguucuaccccagcgacaucgccguggagugggaguccaacggccagcccgagaacaacuacaagaccaccccgcccgugcuggacagcgacggcuccuucuuccucuacagcaagcugacggucgacaagucccgguggcagcaggggaacguguucagcugcuccgugaugcacgaggcgcugcacaaccacuacacccagaagucccucagccugagccccggcaag

SEQ ID NO: 8368 - RNA, 642 nt, Artificial Sequence
  derived and/or modified sequence opt1 from Ramucirumab_LightChain1
gacauccagaugacccagagccccuccagcguguccgccagcaucggcgaccgcgucaccaucacgugccgggccucccaggggaucgacaacuggcugggcugguaccagcagaagccggggaaggcgcccaagcuccugaucuacgacgccagcaaccuggacaccggcgugcccucccgcuucagcggguccggcagcggcaccuacuucacccucacgaucuccagccugcaggccgaggacuucgccguguacuucugccagcaggccaaggcguucccgcccaccuucgggggcgggaccaaggucgacaucaagggcaccguggccgcccccuccguguucaucuucccgcccagcgacgagcagcugaaguccgggacggccagcgucgugugccuccugaacaacuucuacccccgggaggcgaaggugcaguggaaggucgacaacgcccugcaguccggcaacagccaggaguccgugaccgagcaggacagcaaggacagcaccuacucccucagcuccacccugacgcugagcaaggccgacuacgagaagcacaagguguacgccugcgaggucacccaccagggccucuccagccccgugaccaaguccuucaaccgcggggagugc

SEQ ID NO: 8369 - RNA, 687 nt, Artificial Sequence
  derived and/or modified sequence opt1 from Ranibiziuab_HeavyChain1
gaggugcagcuggucgagagcggcgggggccucgugcagcccgggggcucccugcgccugagcugcgccgccuccggguacgacuucacccacuacggcaacugggugcggcaggcgccgggcaaggggcucgagugggucggcuggaucaacaccuacacgggggagcccaccuacgccgccgacuucaagcgccgguucaccuucagccuggacaccuccaagagcacggccuaccugcagaacucccuccgcgccgaggacaccgcgguguacuacugcgccaaguaccccuacuacuacggcaccagccacugguacuucgacgugugggggcagggcacccuggucacgguguccagcgccuccaccaagggccccagcguguucccgcuggcccccuccagcaaguccaccagcgggggcaccgcggcccucgggugccuggucaaggacuacuuccccgagcccgugacgguguccuggaacagcggcgcccugaccuccggcguccacaccuucccggccgugcuccagagcagcgggcuguacucccugagcuccguggucaccgugcccagcuccagccucggcacgcagaccuacaucugcaacgugaaccacaagcccuccaacaccaaggucgacaagaagguggagcccaagagcugcgacaagacccaccug

SEQ ID NO: 8370 - RNA, 642 nt, Artificial Sequence
  derived and/or modified sequence opt1 from Ranibiziuab_LightChain1
gacauccagcugacgcagagccccuccagccucuccgccagcgugggcgaccgcgucaccaucacgugcuccgccagccaggacaucuccaacuaccugaacugguaccagcagaagccggggaaggcgcccaaggugcugaucuacuucaccagcucccuccacagcggcgugcccucccgguucagcggguccggcagcgggaccgacuucacccugacgaucuccagccugcagcccgaggacuucgccaccuacuacugccagcaguacuccaccgucccguggaccuucggccagggcacgaagguggagaucaagcgcaccguggccgcccccagcgucuucaucuucccgcccuccgacgagcagcucaagagcgggaccgccagcguggugugccugcugaacaacuucuacccccgggaggcgaagguccaguggaagguggacaacgcccuccaguccggcaacagccaggaguccgugaccgagcaggacagcaaggacuccacguacagccuguccagcacccugacccucuccaaggccgacuacgagaagcacaaggucuacgccugcgaggugacccaccaggggcugagcucccccgugaccaagagcuucaaccgcggcgagugc

SEQ ID NO: 8371 - RNA, 639 nt, Artificial Sequence
  derived and/or modified sequence opt1 from Ranibizumab_fab_fragment
gacauccagcugacgcagagccccuccagccucuccgccagcgugggcgaccgcgucaccaucacgugcuccgccagccaggacaucuccaacuaccugaacugguaccagcagaagccggggaaggcgcccaaggugcugaucuacuucaccagcucccuccacagcggcgugcccucccgguucagcggguccggcagcgggaccgacuucacccugacgaucuccagccugcagcccgaggacuucgccaccuacuacugccagcaguacuccaccgucccguggaccuucggccagggcacgaagguggagaucaagcgcaccguggccgcccccagcgucuucaucuucccgcccuccgacgagcagcucaagagcgggaccgccagcguggugugccugcugaacaacuucuacccccgggaggcgaagguccaguggaagguggacaacgcccuccaguccggcaacagccaggaguccgugaccgagcaggacagcaaggacuccacguacagccuguccagcacccugacccucuccaaggccgacuacgagaagcacaaggucuacgccugcgaggugacccaccaggggcugagcucccccgugaccaagagcuucaaccgcggcgag

SEQ ID NO: 8372 - RNA, 693 nt, Artificial Sequence
  derived and/or modified sequence opt1 from Ranibizumab_HeavyChain
gaggugcagcuggucgagagcggcgggggccucgugcagcccgggggcucccugcgccugagcugcgccgccuccggguacgacuucacccacuacggcaugaacugggugcggcaggcgccgggcaaggggcucgagugggucggcuggaucaacaccuacacgggggagcccaccuacgccgccgacuucaagcgccgguucaccuucagccuggacaccuccaagagcacggccuaccugcagaugaacucccuccgcgccgaggacaccgcgguguacuacugcgccaaguaccccuacuacuacggcaccagccacugguacuucgacgugugggggcagggcacccuggucacgguguccagcgccuccaccaagggccccagcguguucccgcuggcccccuccagcaaguccaccagcgggggcaccgcggcccucgggugccuggucaaggacuacuuccccgagcccgugacgguguccuggaacagcggcgcccugaccuccggcguccacaccuucccggccgugcuccagagcagcgggcuguacucccugagcuccguggucaccgugcccagcuccagccucggcacgcagaccuacaucugcaacgugaaccacaagcccuccaacaccaaggucgacaagaagguggagcccaagagcugcgacaagacccaccug

SEQ ID NO: 8373 - RNA, 654 nt, Artificial Sequence
  derived and/or modified sequence opt1 from Ranibizumab_LightChain
gaggugcagcuggucgagagcggcgggggccucgugcagcccgggggcucccugcgccugagcugcgccgccuccggguacgacuucacccacuacggcaugaacugggugcggcaggcgccgggcaaggggcucgagugggucggcuggaucaacaccuacacgggggagcccaccuacgccgccgacuucaagcgccgguucaccuucagccuggacaccuccaagagcacggccuaccugcagaugaacucccuccgcgccgaggacaccgcgguguacuacugcgccaaguaccccuacuacuacggcaccagccacugguacuucgacgugugggggcagggcacccuggucacgguguccagcgccuccaccaagggccccagcguguucccgcuggcccccuccgggaccgcggcccucggcugccuggucaaggacuacuuccccgagcccgugaccgugagcuggaacuccggggcccugacgagcggcguccacaccuucccggccgugcuccaguccagcggccuguacucccugagcagcguggucaccgugcccuccagcucccucgggacccagacguacaucugcaacgugaaccacaagcccagcaacaccaaggucgacaagaagguggagcccaag

SEQ ID NO: 8374 - RNA, 642 nt, Artificial Sequence; identical to SEQ ID NO: 8370
  derived and/or modified sequence opt1 from Ranibizumab_LightChain_variant

SEQ ID NO: 8375 - RNA, 1368 nt, Artificial Sequence
  derived and/or modified sequence opt1 from Refanezumab_HeavyChain1
caggugcagcugguccagagcggcuccgagcucaagaagcccggggccagcgugaagguguccugcaaggccagcggcuacaccuucaccaacuacgggaugaacuggguccgccaggcgccgggccaggggcuggaguggaugggcuggaucaacacguacaccggcgagcccaccuacgccgacgacuucaccgggcgguucguguucucccuggacacgagcguguccaccgccuaccuccagaucagcucccugaaggccgaggacaccgccgucuacuacugcgcgcgcaaccccaucaacuacuacggcaucaacuacgagggguacgugauggacuacuggggccaggggacccuggugacggucagcuccgccagcaccaagggccccuccguguucccgcucgcccccagcuccaagagcaccuccggcgggaccgccgcgcugggcugccuggugaaggacuacuuccccgagcccgucacggugagcuggaacuccggggcccucaccagcggcgugcacaccuucccggccguccugcagagcuccggccuguacagccucuccagcguggugaccguccccuccagcucccuggggacgcagaccuacaucugcaacgugaaccacaagcccagcaacaccaagguggacaagaaggucgagcccaaguccugcgacaagacccacacgugcccgcccugccccgcccccgagcuggccggcgcgccgagcguguuccucuucccgcccaagcccaaggacacccugaugaucucccggacccccgaggugaccugcgucguggucgacgugagccacgaggaccccgaggugaaguucaacugguacgucgacgggguggaggugcacaacgccaagacgaagccccgcgaggagcaguacaacuccaccuaccgggucgugagcgugcugaccguccuccaccaggacuggcugaacggcaaggaguacaagugcaagguguccaacaaggcccugcccgccccgaucgagaagaccaucagcaaggccaaggggcagccccgcgagccccagguguacacgcugcccccgucccgggacgagcucaccaagaaccaggucagccugaccugccucgugaagggcuucuaccccuccgacaucgcgguggagugggagagcaacggccagcccgagaacaacuacaagaccacgccgcccguccuggacagcgacggguccuucuuccuguacagcaagcucaccguggacaagucccgcuggcagcagggcaacguguucagcugcuccgucaugcacgaggcccugcacaaccacuacacccagaagucccugagccucagccccgggaag

SEQ ID NO: 8376 - RNA, 657 nt, Artificial Sequence
  derived and/or modified sequence opt1 from Refanezumab_LightChain1
gacaucgugaugacccagagccccgacucccuggccgucagccucggcgagcgcgccaccaucaacugcaaguccagccacuccgugcuguacagcuccaaccagaagaacuaccuggcgugguaccagcagaagccggggcagccgcccaagcuccugaucuacugggccagcacgcgggaguccggcgugcccgaccgcuucagcggguccggcagcgggaccgacuucacccugaccaucuccagccuccaggccgaggacgucgccguguacuacugccaccaguaccuguccagccugacguucggccagggcaccaagcucgagaucaagcggaccguggccgcgcccuccgucuucaucuucccgcccagcgacgagcagcugaaguccgggaccgccagcguggugugccugcucaacaacuucuacccccgcgaggccaagguccaguggaagguggacaacgcccugcagagcggcaacucccaggagagcgugacggagcaggacuccaaggacagcaccuacucccugagcuccacccucacccugagcaaggcggacuacgagaagcacaaggucuacgccugcgaggugacgcaccaggggcuguccagccccgugaccaaguccuucaaccggggcgagugc

SEQ ID NO: 8377 - RNA, 1314 nt, Artificial Sequence
  derived and/or modified sequence opt1 from REGN2810_HeavyChain1
gaggugcagcugcucgagagcggcgggguccuggugcagcccggcgggucccugcgccucagcugcgccgccuccggcuucaccuucagcaacuucgggaccugggugcggcaggcgcccggcaagggccuggagugggucuccgggaucagcggcgggggccgcgacacguacuucgccgacuccgugaaggggcgguucaccaucagccgcgacaacuccaagaacacccuguaccuccagaacagccugaagggcgaggacaccgccguguacuacugcgucaaguggggcaacaucuacuucgacuacugggggcagggcacgcuggugaccguguccagcgccuccaccaaggggcccagcgucuucccccucgcccccugcucccggagcaccuccgagagcacggcggcccugggcugccuggugaaggacuacuucccggagcccgugaccgucuccuggaacagcggcgcccucaccagcggggugcacaccuuccccgccgugcugcaguccagcggccuguacucccucagcuccgucgugacggugcccagcuccagccuggggaccaagaccuacacgugcaacgucgaccacaagccguccaacaccaagguggacaagcgcguggagagcaaguacggcccgcccugcccgcccugccccgcgcccgaguuccucgggggccccuccgucuuccuguucccgcccaagcccaaggacacccugaucagccggacccccgaggugaccugcguggucguggacgucucccaggaggacccggaggugcaguucaacugguacguggacggcgucgaggugcacaacgccaagacgaagccccgcgaggagcaguucaacagcaccuaccggguggucuccgugcugaccgugcuccaccaggacuggcugaacgggaaggaguacaagugcaaggucagcaacaagggccugcccuccagcaucgagaagaccaucuccaaggccaaggggcagccccgcgagccccagguguacacgcucccgcccagccaggaggagaccaagaaccaggugagccugaccugccuggucaagggcuucuaccccuccgacaucgccguggagugggagagcaacgggcagcccgagaacaacuacaagaccacgccgcccgugcucgacuccgacggcagcuucuuccuguacucccggcugaccgucgacaagagccgcuggcaggagggcaacguguucuccugcagcgugcacgaggcccuccacaaccacuacacccagaagucccugagccugucccucggg

SEQ ID NO: 8378 - RNA, 639 nt, Artificial Sequence
  derived and/or modified sequence opt1 from REGN2810_LightChain1
gacauccagacccagagccccuccagccuguccgccagcgugggcgacuccaucaccaucacgugccgcgccagccucuccaucaacaccuuccugaacugguaccagcagaagccggggaaggcgcccaaccugcucaucuacgccgccagcucccugcacggcgggguccccagccgguucuccggcagcggguccggcaccgacuucacccugacgauccgcacccuccagcccgaggacuucgccaccuacuacugccagcagagcuccaacaccccguucacguucggccccgggaccgugguggacuuccggcgcaccgucgccgcgcccagcguguucaucuucccgcccuccgacgagcagcucaagagcggcaccgccuccguggucugccugcugaacaacuucuacccccgggaggccaaggugcaguggaagguggacaacgcccugcagagcgggaacagccaggaguccgucacggagcaggacagcaaggacuccaccuacagccuguccagcacccucacccuguccaaggcggacuacgagaagcacaagguguacgccugcgaggugacgcaccagggccugagcucccccgucaccaagagcuucaaccgcggggagugc

SEQ ID NO: 8379 - RNA, 651 nt, Artificial Sequence
  derived and/or modified sequence opt1 from rhuMab_HER2(9CI)_LightChain
gugcacagcgacauccagaugacccagucccccagcucccugagcgccuccgucggcgaccgggugaccaucacgugcaaggccagccaggacguguccaucggggucgcgugguaccagcagaagccgggcaaggcccccaagcuccugaucuacagcgccuccuaccgguacaccggggugcccagccgcuucuccggcagcggguccggcaccgacuucacccugacgaucagcucccuccagcccgaggacuucgccaccuacuacugccagcaguacuacaucuacccguacaccuucggccaggggaccaagguggagaucaagcggacggucgccgcgcccagcguguucaucuucccgcccuccgacgagcagcucaagagcggcaccgccuccguggucugccugcugaacaacuucuacccccgcgaggccaaggugcaguggaagguggacaacgcccugcagagcgggaacagccaggaguccgucaccgagcaggacagcaaggacuccaccuacagccuguccagcacgcucacccuguccaaggcggacuacgagaagcacaagguguacgccugcgaggugacccaccagggccugagcucccccgucaccaagagcuucaaccgcggggagugc

SEQ ID NO: 8380 - RNA, 1215 nt, Artificial Sequence
  derived and/or modified sequence opt1 from rhuMab_HER2_HeavyChain
gaggugcagcuggucgagagcggcgggggccucgugcagcccgggggcucccugcgccugagcugcgccgccuccggguucaccuucaccgacuacacgauggacugggugcggcaggcgccgggcaagggccucaccgccgucuacuacugcgcccgcaaccuggggcccagcuucuacuucgacuacuggggccaggggacccuggugaccguguccagcgccuccacgaagggccccagcgucuucccccucgccccguccagcaaguccaccagcgggggcaccgcggcccugggcugccuggugaaggacuacuuccccgagcccgugaccgucuccuggaacagcggggcccucacguccggcgugcacaccuuccccgccgugcugcagagcuccgggcuguacagccucuccagcgucgugaccgugccgagcuccagccugggcacccagacguacaucugcaacgucaaccacaagcccuccaacaccaagguggacaagaagguggagcccaagagcugcgacaagacccacacgugcccgcccugccccgcgcccgagcugcucggcgggcccuccgucuuccuguucccgcccaagcccaaggacacccugaugaucagccggacccccgaggugaccugcguggucguggacgugucccacgaggacccggaggucaaguucaacugguacguggacggcgucgaggugcacaacgccaagaccaagccccgcgaggagcaguacaacagcacguaccggguggucuccgugcucaccgugcugcaccaggacuggcugaacgggaaggaguacaagugcaaggucagcaacaaggcccuccccgcccccaucgagaagaccaucuccaaggccaagggccagccgcgcgagccccagguguacacccugccgcccagccgggaggagaugacgaagaaccaggugucccugaccugccucgucaagggguucuaccccagcgacaucgcgguggagugggaguccaacggccagcccgagaacaacuacaagaccacgcccccggugcuggacagcgacggcuccuucuuccuguacagcaagcucaccgucgacaagucccgcuggcagcaggggaacguguucagcugcagcgugaugcacgaggcccugcacaaccacuacacccagaagucccugagccucucccccggccccaag

SEQ ID NO: 8381 - RNA, 645 nt, Artificial Sequence
  derived and/or modified sequence opt1 from rhuMab_HER2_LightChain
agcgacauccagaugacccagucccccagcucccugagcgccuccgugggcgaccgcgucaccaucacgugccgggccagccaggacgugaacaccgcgguggccugguaccagcagaagccggggaaggcccccaagcuccugaucuacuccgccagcuuccuguacuccggcguccccagccgcuucuccgggagccgguccggcaccgacuucacccucacgaucagcucccugcagcccgaggacuucgccaccuacuacugccagcagcacuacaccaccccgcccacguucgggcagggcaccaagguggagaucaagcgcaccguggcggcccccagcgucuucaucuucccgcccuccgacgagcagcucaagagcggcaccgccuccguggugugccugcugaacaacuucuacccccgggaggccaagguccaguggaagguggacaacgcgcugcagagcgggaacagccaggaguccgugacggagcaggacagcaaggacuccaccuacagccucuccagcacccugacccuguccaaggccgacuacgagaagcacaaggucuacgccugcgaggugacgcaccagggccucagcucccccgugaccaagagcuucaaccgcggggagugc

SEQ ID NO: 8382 - RNA, 318 nt, Artificial Sequence
  derived and/or modified sequence opt1 from rhuMab_HER2_LightChain_variant1
accguggccgcccccagcgucuucaucuucccgcccuccgacgagcagcucaagagcggcaccgcguccguggugugccugcugaacaacuucuacccccgggaggccaagguccaguggaagguggacaacgcccugcagagcgggaacucccaggagagcgugacggagcaggacuccaaggacagcaccuacucccucagcuccacccugacccugagcaaggccgacuacgagaagcacaaggucuacgccugcgaggugacgcaccagggccucuccagccccgugaccaaguccuucaaccgcggggagugc

SEQ ID NO: 8383 - RNA, 642 nt, Artificial Sequence
  derived and/or modified sequence opt1 from rhuMab_HER2_LightChain_variant2
gacauccagaugacccagagccccuccagccuguccgccagcgugggcgaccgcgucaccaucacgugccgggccucccaggacgugaacaccgcgguggccugguaccagcagaagccggggaaggcccccaagcuccugaucuacagcgccuccuuccuguacagcggcguccccucccgcuucagcgggucccggagcggcaccgacuucacccucacgaucuccagccugcagcccgaggacuucgccaccuacuacugccagcagcacuacaccaccccgcccacguucgggcagggcaccaagguggagaucaagcggaccugcgcggcccccuccguguucaucuucccgcccagcgacgagcagcugaaguccggcaccgccagcgucgugugccuccugaacaacuucuacccccgcgaggccaaggugcaguggaaggucgacaacgcgcugcaguccgggaacagccaggagagcgugacggagcaggacuccaaggacagcaccuacucccucagcuccacccugacccugagcaaggccgacuacgagaagcacaagguguacgccugcgaggucacgcaccagggccucuccagccccgugaccaaguccuucaaccgcggggagugc

SEQ ID NO: 8384 - RNA, 642 nt, Artificial Sequence
  derived and/or modified sequence opt1 from rhuMab_HER2_LightChain_variant3
gacauccagaugacccagagccccuccagccuguccgccagcgugggcgaccgcgucaccaucacgugccgggccucccaggacgugaacaccgcgguggccugguaccagcagaagccggggaaggcccccaagcuccugaucuacagcgccuccuuccuguacagcggcguccccucccgcuucagcgggucccggagcggcaccgacuucacccucacgaucuccagccugcagcccgaggacuucgccaccuacuacugccagcagcacuacaccaccccgcccacguucgggcagggcaccaagguggagaucaagcgcaccguggcggcccccuccgucuucaucuucccgcccagcgacgagcagcugaaguccggcaccgccagcguggugugccuccugaacaacuucuacccccgggaggccaagguccaguggaagguggacaacgcgcugcaguccgggaacagccaggagagcgugacggagcaggacuccaaggacagcaccuacucccucagcuccacccugacccugagcaaggccgacuacgagaagcacaaggucuacgccugcgaggugacgcaccagggccucuccagccccgugaccaaguccuucaaccgcggggagugc

SEQ ID NO: 8385 - RNA, 645 nt, Artificial Sequence; identical to SEQ ID NO: 8381
  derived and/or modified sequence opt1 from rhuMab_HER2_LightChain_variant4

SEQ ID NO: 8386 - RNA, 321 nt, Artificial Sequence
  derived and/or modified sequence opt1 from rhuMab_HER2_LightChain_V-Region
gacauccagaugacccagagccccuccagccuguccgccagcgugggcgaccgcgucaccaucacgugccgggccucccaggacgugaacaccgcgguggccugguaccagcagaagccggggaaggcccccaagcuccugaucuacagcgccuccuuccuguacagcggcguccccucccgcuucagcgggucccggagcggcaccgacuucacccucacgaucuccagccugcagcccgaggacuucgccaccuacuacugccagcagcacuacaccaccccgcccacguucgggcagggcaccaagguggagaucaag

SEQ ID NO: 8387 - RNA, 1350 nt, Artificial Sequence
  derived and/or modified sequence opt1 from rhuMab_HER2_gamma1-Chain
gaggugcagcuggucgagagcggcgggggccucgugcagcccgggggcucccugcgccugagcugcgccgccuccggguucaacaucaaggacaccuacauccacugggugcggcaggcgccgggcaagggccucgagugggucgcccgcaucuaccccaccaacggguacacgcgguacgccgacagcgugaagggccgcuucaccaucuccgccgacaccagcaagaacaccgccuaccugcagaugaacucccugcgggcggaggacacggccguguacuacugcagccgcuggggcggggacggguucuacgccauggacuacuggggccagggcacccucgucaccguguccagcgccuccaccaaggggcccagcguguucccccuggcgccguccagcaaguccacgagcggcgggaccgccgcccugggcugccucgucaaggacuacuuccccgagcccgugaccguguccuggaacagcggcgcccugaccuccgggguccacacguuccccgccgugcugcagagcagcggccucuacucccugagcuccguggucaccgugccgagcuccagccuggggacccagaccuacaucugcaacgugaaccacaagcccuccaacacgaaggucgacaagaagguggagcccaagagcugcgacaagacccacacgugcccgcccugccccgcgcccgagcuccugggcgggcccuccguguuccuguucccgcccaagcccaaggacacccucaugaucagccggacccccgaggugaccugcgucguggucgacgugucccacgaggacccggaggucaaguucaacugguacguggacggcguggagguccacaacgccaagaccaagccccgcgaggagcaguacaacagcaccuaccgggugguguccguccugacggugcugcaccaggacuggcucaacggcaaggaguacaagugcaaggugagcaacaaggcccugcccgcccccaucgagaagaccaucuccaaggccaaggggcagccgcgcgagccccaggucuacacccugccgcccagccgggaggagaugaccaagaaccaggugucccucacgugccuggugaagggcuucuaccccagcgacaucgcggucgagugggaguccaacgggcagcccgagaacaacuacaagaccacgcccccggugcuggacagcgacggcagcuucuuccucuacuccaagcugaccguggacaagagccgcuggcagcaggggaacgucuucuccugcagcgugaugcacgaggcccugcacaaccacuacacccagaagucccucagccugucccccggcaag

SEQ ID NO: 8388 - RNA, 1350 nt, Artificial Sequence
  derived and/or modified sequence opt1 from rhuMab_HER2__gamma1-Chain
gaggugcagcuggucgagagcggcgggggccucgugcagcccgggggcucccugcgccugagcugcgccgccuccggguucaacaucaaggacaccuacauccacugggugcggcaggcgccgggcaagggccucgagugggucgcccgcaucuaccccaccaacggguacacgcgguacgccgacagcgugaagggccgcuucaccaucuccgccgacaccagcaagaacaccgccuaccugcagaugaacucccugcgggcggaggacacggccguguacuacugcagccgcuggggcggggacggguucuacgccauggacuacuggggccagggcacccucgucaccguguccagcugcuccaccaaggggcccagcguguucccccuggccccguccagcaaguccacgagcggcgggaccgcggcccugggcugccucgucaaggacuacuuccccgagcccgugaccguguccuggaacagcggcgcccugaccuccgggguccacacguuccccgccgugcugcagagcagcggccucuacucccugagcuccguggucaccgugccgagcuccagccuggggacccagaccuacaucugcaacgugaaccacaagcccuccaacacgaaggucgacaagaagguggagcccaagagcugcgacaagacccacacgugcccgcccugccccgcccccgagcuccugggcgggcccuccguguuccuguucccgcccaagcccaaggacacccucaugaucagccggacccccgaggugaccugcgucguggucgacgugucccacgaggacccggaggucaaguucaacugguacguggacggcguggagguccacaacgcgaagaccaagccccgcgaggagcaguacaacagcaccuaccgggugguguccguccugacggugcugcaccaggacuggcucaacggcaaggaguacaagugcaaggugagcaacaaggcccugcccgcccccaucgagaagaccaucuccaaggccaaggggcagccgcgcgagccccaggucuacacccugccgcccagccgggaggagaugaccaagaaccaggugucccucacgugccuggugaagggcuucuaccccagcgacaucgccgucgagugggaguccaacgggcagcccgagaacaacuacaagaccacgcccccggugcuggacagcgacggcagcuucuuccucuacuccaagcugaccguggacaagagccgcuggcagcaggggaacgucuucuccugcagcgugaugcacgaggcgcugcacaaccacuacacccagaagucccucagccugucccccggcaag

SEQ ID NO: 8389 - RNA, 729 nt, Artificial Sequence
  derived and/or modified sequence opt1 from rhuMab_HER2_gamma1-Chain__rhuMab_HER2_LightChain_sc4D5
gaggugcagcuggucgagagcggcgggggccucgugcagcccgggggcucccugcgccugagcugcgccgccuccggguucaacaucaaggacaccuacauccacugggugcggcaggcgccgggcaagggccucgagugggucgcccgcaucuaccccaccaacggguacacgcgguacgccgacagcgugaagggccgcuucaccaucuccgccgacaccagcaagaacaccgccuaccugcagaugaacucccugcgggcggaggacacggccguguacuacugcagccgcuggggcggggacggguucuacgccauggacuacuggggccagggcacccucgucaccguguccagcgggggcgggggcuccggcgggggcgggagcggcgggggcggcuccgacauccagaugacccagagccccuccagccuguccgccagcgugggggaccgggucacgaucacgugccgcgcgucccaggacgugaacaccgccguggccugguaccagcagaagcccggcaaggccccgaagcugcucaucuacagcgccagcuuccuguacuccgggguccccagccgguucuccggcagccgcuccgggaccgacuucacccugaccaucagcucccuccagcccgaggacuucgcgaccuacuacugccagcagcacuacaccacgcccccgaccuucggccagggcaccaagguggagaucaagcgg

SEQ ID NO: 8390 - RNA, 1350 nt, Artificial Sequence; identical to SEQ ID NO: 8387
  derived and/or modified sequence opt1 from rhuMab_HER2_gamma1-Chain_variant1

SEQ ID NO: 8391 - RNA, 1350 nt, Artificial Sequence; identical to SEQ ID NO: 8388
  derived and/or modified sequence opt1 from rhuMab_HER2_gamma1-Chain_variant2

SEQ ID NO: 8392 - RNA, 1350 nt, Artificial Sequence
  derived and/or modified sequence opt1 from rhuMab_HER2_gamma1-Chain_variant3
gaggugcagcuggucgagagcggcgggggccucgugcagcccgggggcucccugcgccugagcugcgccgccuccggguucaacaucaaggacaccuacauccacugggugcggcaggcgccgggcaagggccucgagugggucgcccgcaucuaccccaccaacggguacacgcgguacgccgacagcgugaagggccgcuucaccaucuccgccgacaccagcaagaacaccgccuaccugcagaugaacucccugcggugcgaggacacggcgguguacuacugcagccgcuggggcggggacggguucuacgccauggacuacuggggccagggcacccucgucaccguguccagcgccuccaccaaggggcccagcguguucccccuggccccguccagcaaguccacgagcggcgggaccgcggcccugggcugccucgucaaggacuacuuccccgagcccgugaccguguccuggaacagcggcgcccugaccuccgggguccacacguuccccgccgugcugcagagcagcggccucuacucccugagcuccguggucaccgugccgagcuccagccuggggacccagaccuacaucugcaacgugaaccacaagcccuccaacacgaaggucgacaagaagguggagcccaagagcugcgacaagacccacacgugcccgcccugccccgcccccgagcuccugggcgggcccuccguguuccuguucccgcccaagcccaaggacacccucaugaucagccggacccccgaggugaccugcgucguggucgacgugucccacgaggacccggaggucaaguucaacugguacguggacggcguggagguccacaacgcgaagaccaagccccgcgaggagcaguacaacagcaccuaccgggugguguccguccugacggugcugcaccaggacuggcucaacggcaaggaguacaagugcaaggugagcaacaaggcccugcccgcccccaucgagaagaccaucuccaaggccaaggggcagccgcgcgagccccaggucuacacccugccgcccagccgggaggagaugaccaagaaccaggugucccucacgugccuggugaagggcuucuaccccagcgacaucgccgucgagugggaguccaacgggcagcccgagaacaacuacaagaccacgcccccggugcuggacagcgacggcagcuucuuccucuacuccaagcugaccguggacaagagccgcuggcagcaggggaacgucuucuccugcagcgugaugcacgaggcgcugcacaaccacuacacccagaagucccucagccugucccccggcaag

SEQ ID NO: 8393 - RNA, 360 nt, Artificial Sequence
  derived and/or modified sequence opt1 from rhuMab_HER2_gamma1-Chain_V-Region
gaggugcagcuggucgagagcggcgggggccucgugcagcccgggggcucccugcgccugagcugcgccgccuccggguucaacaucaaggacaccuacauccacugggugcggcaggcgccgggcaagggccucgagugggucgcccgcaucuaccccaccaacggguacacgcgguacgccgacagcgugaagggccgcuucaccaucuccgccgacaccagcaagaacaccgccuaccugcagaugaacucccugcgggcggaggacacggccguguacuacugcagccgcuggggcggggacggguucuacgccauggacuacuggggccagggcacccucgucaccguguccagc

SEQ ID NO: 8394 - RNA, 1359 nt, Artificial Sequence; identical to SEQ ID NO: 7725
  derived and/or modified sequence opt1 from rhuMAb-VEGF_HeavyChain1

SEQ ID NO: 8395 - RNA, 642 nt, Artificial Sequence; identical to SEQ ID NO: 7726
  derived and/or modified sequence opt1 from rhuMAb-VEGF_LightChain1

SEQ ID NO: 8396 - RNA, 642 nt, Artificial Sequence; identical to SEQ ID NO: 7726
  derived and/or modified sequence opt1 from rhuMAb-VEGF_LightChain

SEQ ID NO: 8397 - RNA, 321 nt, Artificial Sequence; identical to SEQ ID NO: 7735
  derived and/or modified sequence opt1 from rhuMAb-VEGF_LightChain__VG-Region

SEQ ID NO: 8398 - RNA, 1359 nt, Artificial Sequence; identical to SEQ ID NO: 7725
  derived and/or modified sequence opt1 from rhuMAb-VEGF_gamma1-Chain

SEQ ID NO: 8399 - RNA, 369 nt, Artificial Sequence; identical to SEQ ID NO: 7730
  derived and/or modified sequence opt1 from rhuMAb-VEGF_gamma1-Chain_VDG-Region

SEQ ID NO: 8400 - RNA, 1338 nt, Artificial Sequence
  derived and/or modified sequence opt1 from Rilotumumab_HeavyChain1
caggugcagcugcaggagagcggccccgggcucgucaagcccuccgagacccugagccugaccugcacgguguccggcgggagcaucuccaucuacuacuggagcuggauccgccagccgcccggcaaggggcucgaguggaucggcuacguguacuacuccggcagcaccaacuacaaccccucccucaagagccgggucaccaucuccguggacaccagcaagaaccaguucucccugaagcucaacagcgugacggccgccgacaccgcggucuacuacugcgcccgcgggggcuacgacuucugguccggguacuucgacuacuggggccaggggacccuggugaccgugagcuccgccagcacgaagggccccuccgucuucccccuggcccccugcagccggagcaccuccgagagcaccgccgcgcucggcugccuggugaaggacuacuuccccgagccggugaccgucuccuggaacagcggggcccugacguccggcgugcacaccuuccccgccgugcuccagagcuccgggcuguacagccuguccagcgucgugaccgugcccuccagcaacuucggcacccagacguacacgugcaacgucgaccacaagcccuccaacaccaagguggacaagaccguggagcgcaagugcugcgucgagugcccgcccugccccgcgcccccgguggccggccccagcguguuccucuucccgcccaagcccaaggacacccugaugaucucccggacccccgaggugaccugcgucgucguggacgugagccacgaggaccccgagguccaguucaacugguacguggacgggguggagguccacaacgccaagaccaagccccgcgaggagcaguucaacuccacguuccggguggugagcguccugaccguggugcaccaggacuggcucaacggcaaggaguacaagugcaaggucuccaacaaggggcugccggcccccaucgagaagaccaucagcaagaccaagggccagccccgcgagccccagguguacacgcugccgcccagccgggaggagaugaccaagaaccaggugucccugaccugccuggucaagggguucuaccccagcgacaucgccguggagugggaguccaacggccagccggagaacaacuacaagaccacgccgcccaugcuggacagcgacggcuccuucuuccucuacagcaagcugaccguggacaagucccgcuggcagcaggggaacgucuucagcugcuccgugaugcacgaggcccugcacaaccacuacacccagaagucccucagccugagccccggcaag

SEQ ID NO: 8401 - RNA, 645 nt, Artificial Sequence
  derived and/or modified sequence opt1 from Rilotumumab_LightChain1
gagaucgugaugacccagagccccgccacccuguccgucagcccgggcgagcgggccacgcucuccugccgggcgagccaguccguggacagcaaccuggccugguaccgccagaagcccgggcaggcgccccggcugcucaucuacggcgccuccacccgcgccaccgggauccccgcccgguucagcggcuccgggagcggcaccgaguucacgcugaccaucuccagccugcaguccgaggacuucgccguguacuacugccagcaguacaucaacuggccgcccaucaccuucggccaggggacccgccucgagaucaagcggacggucgccgcccccagcguguucaucuucccgcccuccgacgagcagcucaagagcggcaccgcguccguggucugccugcugaacaacuucuacccccgcgaggccaaggugcaguggaagguggacaacgcccugcagagcgggaacucccaggagagcgucaccgagcaggacagcaaggacuccaccuacagccuguccagcacgcucacccuguccaaggccgacuacgagaagcacaagguguacgccugcgaggugacccaccagggccugagcucccccgucaccaagagcuucaaccgcggggagugc

SEQ ID NO: 8402 - RNA, 1071 nt, Artificial Sequence; identical to SEQ ID NO: 8359
  derived and/or modified sequence opt1 from Rilotumumab_scFv-CH_chain

SEQ ID NO: 8403 - RNA, 1347 nt, Artificial Sequence
  derived and/or modified sequence opt1 from Rinucumab_HeavyChain1
cagcugcagcuccaggagagcggccccgggcuggugaagccguccgagacccugagccugaccugcacggucuccggcgggagcaucaccuccagcuccuacuacuggggcuggauccgccagccgcccgggaagggccucgaguggaucggcagcaucuacuaccggggguccaccaacuacaaccccagccugaagucccgcgugaccaucagcguggacuccagcaagaaccaguucuaccucaaggucuccagcgugacggccguggacaccgccgucuacuacugcgcgcggcagaacggcgccgcccgccccuccugguucgaccccugggggcagggcacccuggugaccgugagcuccgccagcacgaaggggcccagcgucuucccccuggccccgugcucccggagcaccuccgagagcaccgcggcccucggcugccuggugaaggacuacuuccccgagcccgugaccgucuccuggaacagcggcgcccugacguccggggugcacaccuuccccgccgugcuccagagcuccggccuguacagccuguccagcgucgugaccgugccguccagcucccucgggaccaagacguacacgugcaacgucgaccacaagcccagcaacaccaagguggacaagcgcguggaguccaaguacggcccgcccugcccgcccugccccgcgcccgaguuccugggcgggcccagcgucuuccuguucccgcccaagcccaaggacacccucaugaucucccggacccccgaggugaccugcguggucguggacgucagccaggaggaccccgaggugcaguucaacugguacguggacggcgucgaggugcacaacgccaagaccaagccccgcgaggagcaguucaacagcaccuaccggguggucuccgugcugacggugcugcaccaggacuggcucaacgggaaggaguacaagugcaaggucagcaacaagggccugcccuccagcaucgagaagaccaucuccaaggccaaggggcagccgcgcgagccccagguguacacccugcccccgagccaggaggagaugaccaagaaccaggugucccucacgugccuggucaagggcuucuaccccagcgacaucgccguggagugggaguccaacggccagcccgagaacaacuacaagaccacgcccccggugcuggacagcgacggguccuucuuccucuacagccggcugaccgucgacaagucccgcuggcaggagggcaacguguucagcugcuccgugaugcacgaggcccugcacaaccacuacacccagaagucccucagccugagccuggggaag

SEQ ID NO: 8404 - RNA, 1344 nt, Artificial Sequence
  derived and/or modified sequence opt1 from Rinucumab_HeavyChain
cagcugcagcuccaggagagcggccccgggcuggugaagccguccgagacccugagccugaccugcacggucuccggcgggagcaucaccuccagcuccuacuacuggggcuggauccgccagccgcccgggaagggccucgaguggaucggcagcaucuacuaccggggguccaccaacuacaaccccagccugaagucccgcgugaccaucagcguggacuccagcaagaaccaguucuaccucaaggucuccagcgugacggccguggacaccgccgucuacuacugcgcgcggcagaacggcgccgcccgccccuccugguucgaccccugggggcagggcacccuggugaccgugagcuccgccagcacgaaggggcccagcgucuucccccuggccccgugcucccggagcaccuccgagagcaccgcggcccucggcugccuggugaaggacuacuuccccgagcccgugaccgucuccuggaacagcggcgcccugacguccggggugcacaccuuccccgccgugcuccagagcuccggccuguacagccuguccagcgucgugaccgugccguccagcucccucgggaccaagacguacacgugcaacgucgaccacaagcccagcaacaccaagguggacaagcgcguggaguccaaguacggcccgcccugcccgcccugccccgcgcccgaguuccugggcgggcccagcgucuuccuguucccgcccaagcccaaggacacccucaugaucucccggacccccgaggugaccugcguggucguggacgucagccaggaggaccccgaggugcaguucaacugguacguggacggcgucgaggugcacaacgccaagaccaagccccgcgaggagcaguucaacagcaccuaccggguggucuccgugcugacggugcugcaccaggacuggcucaacgggaaggaguacaagugcaaggucagcaacaagggccugcccuccagcaucgagaagaccaucuccaaggccaaggggcagccgcgcgagccccagguguacacccugcccccgagccaggaggagaugaccaagaaccaggugucccucacgugccuggucaagggcuucuaccccagcgacaucgccguggagugggaguccaacggccagcccgagaacaacuacaagaccacgcccccggugcuggacagcgacggguccuucuuccucuacagccggcugaccgucgacaagucccgcuggcaggagggcaacguguucagcugcuccgugaugcacgaggcccugcacaaccacuacacccagaagucccucagccugagccugggg

SEQ ID NO: 8405 - RNA, 645 nt, Artificial Sequence
  derived and/or modified sequence opt1 from Rinucumab_LightChain1
gagaucgugcugacccagagccccgacaccaucucccucagcccgggcgagcgggccacgcuguccugccgggccagccaguccaucagcuccaucuaccuggcgugguaccagcagaagcccgggcaggcgccccgccuccugaucuacggcgccagcucccgggucaccgggauccccgaccgcuucagcguguccggcagcgggaccgacuucacccugacgaucucccggcucgagccggaggacuucgccguguacuacugccagcacuacggcaucagccccuucaccuucggccccgggaccaaggucgacauccgccggaccguggccgcccccuccguguucaucuucccgcccagcgacgagcagcugaaguccggcacggccagcgucgugugccugcucaacaacuucuacccccgcgaggccaaggugcaguggaaggucgacaacgcccugcaguccgggaacagccaggagagcgugaccgagcaggacuccaaggacagcaccuacucccugagcuccacccucacgcugagcaaggcggacuacgagaagcacaagguguacgccugcgaggucacccaccagggccuguccagccccgugaccaaguccuucaaccgcggggagugc

SEQ ID NO: 8406 - RNA, 1347 nt, Artificial Sequence
  derived and/or modified sequence opt1 from Risankizumab_HeavyChain1
caggugcagcugguccagagcggcgccgaggugaagaagcccggguccagcgugaaggucuccugcaaggccagcggcuacaccuucaccgaccagacgauccacuggaugcgccaggcgcccgggcagggccucgaguggaucggguacaucuacccccgggacgacucccccaaguacaacgagaacuucaagggcaaggugaccaucaccgccgacaagagcaccuccacggccuacauggagcugagcucccugcgcagcgaggacaccgccguguacuacugcgccauccccgaccgguccggcuacgcgugguucaucuacugggggcagggcacccucgucaccgugagcuccgccagcacgaaggggccguccguguucccccuggcccccagcuccaagagcaccuccggcgggaccgccgcgcugggcugccucgucaaggacuacuuccccgagccggugaccgugagcuggaacagcggcgcccugacguccgggguccacaccuuccccgccgugcugcagagcuccggccucuacagccuguccagcguggucaccgugcccuccagcucccuggggacccagacguacaucugcaacgugaaccacaagcccagcaacaccaaggucgacaagcgcguggagccgaaguccugcgacaagacccacacgugcccgcccugccccgcccccgaggccgcgggcggccccagcguguuccucuucccgcccaagcccaaggacacccugaugaucucccggacccccgaggugaccugcgucguggucgacgugagccacgaggaccccgaggucaaguucaacugguacguggacgggguggagguccacaacgccaagaccaagccccgcgaggagcaguacaacuccacguaccggguggugagcguccugaccgugcuccaccaggacuggcugaacggcaaggaguacaagugcaagguguccaacaaggcccugccggcccccaucgagaagaccaucagcaaggccaaggggcagccccgcgagccccaggucuacacccucccgcccucccgggaggagaugacgaagaaccaggugagccugaccugccuggugaagggcuucuaccccagcgacaucgcggucgagugggaguccaacgggcagccggagaacaacuacaagaccaccccgcccgugcucgacagcgacggcuccuucuuccuguacagcaagcugacgguggacaagucccgcuggcagcagggcaacgucuucagcugcuccgugaugcacgaggcccuccacaaccacuacacccagaagucccugagccugagccccggg

SEQ ID NO: 8407 - RNA, 642 nt, Artificial Sequence
  derived and/or modified sequence opt1 from Risankizumab_LightChain1
gacauccagaugacccagagccccuccagccuguccgccagcgugggcgaccgggucaccaucacgugcaaggccucccgggacguggcgaucgccguggccugguaccagcagaagccggggaagguccccaagcuccugaucuacugggccagcacccgccacaccggcgugcccucccgguucagcggguccggcagccgcaccgacuucacgcugaccaucuccagccuccagcccgaggacguggccgacuacuucugccaccaguacuccagcuacccguucaccuucggguccggcaccaagcuggagaucaagcggacggucgcggcccccagcguguucaucuucccgcccuccgacgagcagcucaagagcggcaccgccuccguggucugccugcugaacaacuucuacccccgcgaggccaaggugcaguggaagguggacaacgcgcugcagagcgggaacagccaggaguccgucaccgagcaggacagcaaggacuccaccuacagccucuccagcacgcugacccuguccaaggccgacuacgagaagcacaagguguacgccugcgaggugacccaccagggccucagcucccccgucaccaagagcuucaaccgcggggagugc

SEQ ID NO: 8408 - RNA, 1353 nt, Artificial Sequence
  derived and/or modified sequence opt1 from Rituximab_HeavyChain
caggugcagcugcagcagcccggcgccgagcucgucaagccgggggccagcgugaagauguccugcaaggcgagcggcuacaccuucaccuccuacaacaugcacugggugaagcagacgcccgggcgcggccuggaguggaucggggccaucuaccccggcaacggcgacaccagcuacaaccagaaguucaaggggaaggccacccugaccgccgacaaguccagcuccacggccuacaugcagcucagcucccugaccagcgaggacuccgcggucuacuacugcgcccggagcaccuacuacggcggggacugguacuucaacguguggggcgccgggaccacggugaccgucuccgccgcgagcaccaagggccccuccguguucccgcuggcccccagcuccaagagcaccuccggcgggacggccgcccucggcugccuggugaaggacuacuuccccgagcccgucaccgugagcuggaacagcggggcccugaccuccggcgugcacaccuucccggcgguccuccagagcuccggccuguacagccuguccagcguggugacgguccccuccagcucccucgggacccagaccuacaucugcaacgugaaccacaagcccagcaacaccaagguggacaagaaggucgagcccaaguccugcgacaagacgcacacgugcccgcccugccccgcccccgagcugcugggcgggccgagcguguuccucuucccgcccaagcccaaggacacccugaugaucucccgcacccccgaggugaccugcgucgugguggacgucagccacgaggaccccgaggugaaguucaacugguacgucgacggcguggaggugcacaacgccaagaccaagccccgggaggagcaguacaacuccaccuaccgcgucgugagcgugcugaccguccuccaccaggacuggcugaacgggaaggaguacaagugcaagguguccaacaaggcccugcccgccccgaucgagaagacgaucagcaaggcgaagggccagccccgggagccccagguguacacccugcccccgucccgcgacgagcucaccaagaaccaggucagccugaccugccucgugaagggcuucuaccccagcgacaucgccguggagugggaguccaacgggcagcccgagaacaacuacaagacgaccccgcccguccuggacagcgacggcuccuucuuccuguacagcaagcucaccguggacaagucccgguggcagcaggggaacguguucagcugcuccgucaugcacgaggcccugcacaaccacuacacccagaagucccugagccucagccccggcaag

SEQ ID NO: 8409 - RNA, 1353 nt, Artificial Sequence
  derived and/or modified sequence opt1 from Rituximab_HeavyChain_variant
caggugcagcugcagcagcccggcgccgagcucgucaagccgggggccagcgugaagauguccugcaaggcgagcggcuacaccuucaccuccuacaacaugcacugggugaagcagacgcccgggcgcggccuggaguggaucggggccaucuaccccggcaacggcgacaccagcuacaaccagaaguucaaggggaaggccacccugaccgccgacaaguccagcuccacggccuacaugcagcucagcucccugaccagcgaggacuccgcggucuacuacugcgcccggagcaccuacuacggcggggacugguacuucaacguguggggcgccgggaccacggugaccgucuccgccgcgagcaccaagggccccuccguguucccgcuggcccccagcuccaagagcaccuccggcgggacggccgcccucggcugccuggugaaggacuacuuccccgagcccgucaccgugagcuggaacagcggggcccugaccuccggcgugcacaccuucccggcgguccuccagagcuccggccuguacagccuguccagcguggugacgguccccuccagcucccucgggacccagaccuacaucugcaacgugaaccacaagcccagcaacaccaagguggacaagaaggccgagcccaaguccugcgacaagacgcacacgugcccgcccugccccgcccccgagcugcugggcgggccgagcgucuuccucuucccgcccaagcccaaggacacccugaugaucucccgcacccccgaggugaccugcguggucguggacgugagccacgaggaccccgaggucaaguucaacugguacguggacggcgucgaggugcacaacgccaagaccaagccccgggaggagcaguacaacuccaccuaccgcguggucagcgugcugaccgugcuccaccaggacuggcugaacgggaaggaguacaagugcaaggucuccaacaaggcccugcccgcgccgaucgagaagacgaucagcaaggccaagggccagccccgggagccccagguguacacccugcccccgucccgcgacgagcucaccaagaaccaggugagccugaccugccucgucaagggcuucuaccccagcgacaucgccguggagugggaguccaacgggcagcccgagaacaacuacaagacgaccccgcccgugcuggacagcgacggcuccuucuuccuguacagcaagcucaccgucgacaagucccgguggcagcaggggaacguguucagcugcuccgugaugcacgaggcccugcacaaccacuacacccagaagucccugagccucagccccggcaag

SEQ ID NO: 8410 - RNA, 639 nt, Artificial Sequence
  derived and/or modified sequence opt1 from Rituximab_LightChain
cagaucgugcugagccagucccccgccauccucagcgccucccccggcgagaaggucaccaugaccugccgggcgagcuccagcguguccuacauccacugguuccagcagaagcccgggagcucccccaagcccuggaucuacgccacgagcaaccuggccuccggcgugccgguccgguucagcggguccggcagcgggaccuccuacagccugaccaucucccgcguggaggccgaggacgccgcgaccuacuacugccagcaguggacgagcaacccgcccaccuucggcggcgggaccaagcucgagaucaagcggaccguggccgcccccuccgucuucaucuucccgcccagcgacgagcagcucaagagcggcacggccuccguggugugccugcugaacaacuucuacccccgcgaggcgaagguccaguggaagguggacaacgcccugcagagcgggaacucccaggagagcgugaccgagcaggacuccaaggacagcaccuacucccugagcuccacccucacgcugagcaaggccgacuacgagaagcacaaggucuacgccugcgaggugacccaccagggccuguccagccccgugaccaaguccuucaaccgcggggagugc

SEQ ID NO: 8411 - RNA, 714 nt, Artificial Sequence
  derived and/or modified sequence opt1 from Rivabazumab_pegol_HeavyChain1
gaggugcagcuggucgagagcggcgggggcguggugcagcccgggcgcucccuccggcugagcugcgccgccuccggcuucaccuucagcaacuacccgaugcacuggguccgccaggcgcccgggaagggccuggaguggguggccgugaucuccuacgacggcagcgagaagugguacgccgacuccgucaaggggcgguucaccaucagccgcgacaacuccaagaacacccucuaccuggagaugaacagccugcggcccgaggacaccgccguguacuacugcgcccgcaaccggggcgacaucuacuacgacuucaccuacgcgauggacaucugggggcagggcaccacggugaccgucuccagcgccuccaccaaggggcccagcguguucccgcucgcccccuccagcaaguccaccagcggcggcacggccgcgcuggggugccuggugaaggacuacuuccccgagcccgucaccguguccuggaacagcggcgcccucaccagcggggugcacaccuucccggccguccugcaguccagcggccuguacucccucagcuccguggugacgguccccagcuccagccugggcacccagaccuacaucugcaacgugaaccacaagcccuccaacaccaagguggacaagaaggucgagcccaagagcuccgacaagacgcacacgugcccgcccugccccgcc

SEQ ID NO: 8412 - RNA, 642 nt, Artificial Sequence
  derived and/or modified sequence opt1 from Rivabazumab_pegol_LightChain1
gacauccagcugacccagagccccuccacccucagcgccuccgugggcgacagcgucacgaucacgugccgcgccuccgaggggguggaccgguggcuggcgugguaccagcagaagccgggccgcgcccccaagcugcucaucuacgacgccagcacccugcaguccggggugcccagccgguucuccggcagcggguccggcaccgaguucagccugaccaucuccagccuccagcccgacgacgucgccaccuacuacugccagcacuucuggggcaccccguacaccuucgggcagggcacgaagcuggagaucaagcgcaccguggccgcgcccuccguguucaucuucccgcccagcgacgagcagcugaaguccgggaccgccagcgucgugugccuccugaacaacuucuacccccgggaggccaaggugcaguggaaggucgacaacgcccugcaguccggcaacagccaggagagcgugaccgagcaggacuccaaggacagcacguacucccucagcuccacccugacccugagcaaggcggacuacgagaagcacaagguguacgccugcgaggucacccaccaggggcucuccagccccgugacgaaguccuucaaccgcggcgagagc

SEQ ID NO: 8413 - RNA, 1344 nt, Artificial Sequence
  derived and/or modified sequence opt1 from Robatumumab_HeavyChain1
gaggugcagcugguccagagcggcgggggccucgugaagcccgggggcucccugcgccugagcugcgccgccuccggguucaccuucagcuccuucgcgaugcacugggugcggcaggccccgggcaagggccucgaguggaucagcgucaucgacacccgcggggccacguacuacgccgacuccgugaagggccgguucaccaucagccgcgacaacgccaagaacucccuguaccugcagaugaacagccuccgggcggaggacaccgccguguacuacugcgcccgccuggggaacuucuacuacggcauggacgucugggggcagggcaccacggugaccguguccagcgccuccaccaagggccccagcgucuucccccuggcgcccuccagcaaguccaccagcgggggcacggccgcccucgggugccuggugaaggacuacuucccggagcccgugaccgucuccuggaacagcggcgcccugaccagcggcgugcacaccuuccccgccgugcuccaguccagcgggcuguacucccugagcuccgucgugacggugcccagcuccagccucggcacccagaccuacaucugcaacgucaaccacaagccguccaacaccaagguggacaagaagguggagcccaagagcugcgacaagacgcacacgugcccgcccugcccggcgcccgagcugcucgggggccccuccgucuuccuguucccgcccaagcccaaggacacccugaugaucagccggacccccgaggugaccugcguggucguggacgucucccacgaggaccccgaggugaaguucaacugguacguggacggggucgaggugcacaacgccaagaccaagccgcgcgaggagcaguacaacagcaccuaccggguggucuccgugcugaccgugcuccaccaggacuggcugaacggcaaggaguacaagugcaaggucagcaacaaggcccugcccgcccccaucgagaagacgaucuccaaggccaagggccagccccgcgagccccagguguacacccucccgcccagccgggacgagcugaccaagaaccaggugucccugaccugccucgucaagggguucuaccccagcgacaucgcgguggagugggagagcaacggccagcccgagaacaacuacaagacgaccccgcccgugcuggacuccgacgggagcuucuuccuguacuccaagcucaccgucgacaagagccgcuggcagcagggcaacguguucuccugcagcgugaugcacgaggcccugcacaaccacuacacccagaagucccugagccucucccccgggaag

SEQ ID NO: 8414 - RNA, 642 nt, Artificial Sequence
  derived and/or modified sequence opt1 from Robatumumab_LightChain1
gagaucgugcugacccagagccccggcacccucuccgucagcccgggggagcgcgccacgcuguccugccgggccagccaguccaucggcagcucccugcacugguaccagcagaagcccgggcaggcgccccgccuccugaucaaguacgccagccagucccugagcggcauccccgaccgguucuccgggagcggcuccggcaccgacuucacccucaccaucagccgccuggagccggaggacuucgccguguacuacugccaccaguccagccggcugccccacacguucgggcagggcaccaagguggagaucaagcgcaccgucgccgcccccuccguguucaucuucccgcccagcgacgagcagcucaaguccgggaccgcgagcguggucugccugcugaacaacuucuacccccgggaggccaaggugcaguggaagguggacaacgcccuccagagcggcaacucccaggagagcgucacggagcaggacuccaaggacagcaccuacucccugagcuccacccugacccucagcaaggccgacuacgagaagcacaagguguacgcgugcgaggugacgcaccaggggcuguccagccccgucaccaaguccuucaaccgcggcgagugc

SEQ ID NO: 8415 - RNA, 1368 nt, Artificial Sequence
  derived and/or modified sequence opt1 from Roledumab_HeavyChain1
caggugcagcuggucgagagcggcgggggcguggugcagcccgggcgcucccuccggcugagcugcaccgccuccggcuucaccuucaagaacuacgccaugcacuggguccgccaggcgccggccaaggggcuggaguggguggccacgaucagcuacgacggccggaacauccaguacgccgacuccgugaagggccgcuucaccuucagccgggacaacucccaggacacccucuaccugcagcugaacagccuccgccccgaggacaccgccgucuacuacugcgcgcggcccgugcgcucccgguggcugcagcuggggcucgaggacgccuuccacaucuggggccaggggacgauggugaccgucagcuccgccagcaccaagggccccuccguguucccgcuggcccccagcuccaagagcaccuccgggggcacggcggcccugggcugccucgugaaggacuacuuccccgagcccgucaccgugagcuggaacuccggggcccugaccagcggcgugcacaccuucccggccguccugcagagcuccgggcucuacagccuguccagcguggugacgguccccuccagcucccugggcacccagaccuacaucugcaacgugaaccacaagcccagcaacaccaagguggacaagaaggucgagcccaaguccugcgacaagacgcacacgugcccgcccugccccgcccccgagcuccugggcgggccgagcguguuccuguucccgcccaagcccaaggacacccucaugaucucccgcacccccgaggugaccugcgucguggucgacgugagccacgaggaccccgaggugaaguucaacugguacgucgacggcguggaggugcacaacgcgaagaccaagccccgggaggagcaguacaacuccaccuaccgcgucgugagcgugcugaccguccugcaccaggacuggcucaacgggaaggaguacaagugcaagguguccaacaaggcccugcccgccccgaucgagaagacgaucagcaaggccaagggccagccccgggagccccagguguacacccugcccccgucccgcgacgagcucaccaagaaccaggucagccugaccugccuggugaagggguucuaccccuccgacaucgccguggagugggagagcaacggccagcccgagaacaacuacaagacgaccccgcccguccucgacagcgacggcuccuucuuccuguacagcaagcugaccguggacaagucccgguggcagcaggggaacguguucagcugcuccgucaugcacgaggcgcuccacaaccacuacacccagaagucccugagccugagccccggcaag

SEQ ID NO: 8416 - RNA, 642 nt, Artificial Sequence
  derived and/or modified sequence opt1 from Roledumab_LightChain1
gccauccgcaugacccagagccccuccagcuucuccgccagcaccggcgaccgggugacgaucacgugccgcgcgucccaggacauccggaacuacgucgccugguaccagcagaaguccgggaaggccccgaaguuccugaucuacgccgccagcacccuccagagcggcgugcccucccgcuucagcggguccggcagcgggaccgacuucacccugaccaucaacucccugcagagcgaggacuucgcgaccuacuacugccagcaguacuacaacuccccgcccaccuucggccagggcacgcggguggagaucacccgcaccgucgccgcccccagcguguucaucuucccgcccuccgacgagcagcucaagagcgggaccgccuccguggucugccugcugaacaacuucuacccccgggaggcgaaggugcaguggaagguggacaacgcccuccagagcggcaacagccaggaguccgucacggagcaggacagcaaggacuccaccuacagccuguccagcacccugacccucuccaaggccgacuacgagaagcacaagguguacgccugcgaggugacgcaccaggggcugagcucccccgucaccaagagcuucaaccgcggcgagugc

SEQ ID NO: 8417 - RNA, 639 nt, Artificial Sequence; identical to SEQ ID NO: 8371
  derived and/or modified sequence opt1 from Romosozumab_fab_fragment

SEQ ID NO: 8418 - RNA, 1347 nt, Artificial Sequence
  derived and/or modified sequence opt1 from Romosozumab_HeavyChain1
gaggugcagcugguccagagcggcgccgaggugaagaagcccggggccuccgugaaggucagcugcaaggcguccggcuacaccuucaccgacuacaacaugcacugggugcgccaggccccggggcagggccucgaguggaugggggagaucaaccccaacagcggcggcgccggguacaaccagaaguucaagggccgggugacgaugaccaccgacaccuccacgagcaccgccuacauggagcugcgcucccugcggagcgacgacaccgccgucuacuacugcgcgcgccucggguacgacgacaucuacgacgacugguacuucgacguguggggccaggggaccacggugaccgucuccagcgccuccaccaagggccccagcguguucccccuggccccgugcucccggagcaccuccgagagcacggccgcgcugggcugccucgugaaggacuacuuccccgagcccgucaccguguccuggaacagcggggcccugaccuccggcgugcacaccuuccccgccguccugcagagcagcgggcucuacucccugagcuccguggugacggucccgagcuccaacuucggcacccagaccuacacgugcaacguggaccacaagcccagcaacaccaagguggacaagaccgucgagcgcaagugcugcguggagugcccgcccugccccgccccgcccguggccggccccuccgucuuccuguucccgcccaagcccaaggacacccucaugaucagccggacccccgaggugacgugcgucgugguggacgucucccacgaggaccccgaggugcaguucaacugguacguggacggggucgaggugcacaacgcgaagaccaagccccgcgaggagcaguucaacagcaccuuccggguggucuccgugcugaccgugguccaccaggacuggcugaacggcaaggaguacaagugcaaggugagcaacaaggggcuccccgcccccaucgagaagacgaucuccaagaccaagggccagccgcgcgagccccagguguacacccugccgcccagccgggaggagaugaccaagaaccaggucucccugacgugccucgugaagggguucuaccccagcgacaucgccguggagugggaguccaacggccagcccgagaacaacuacaagaccacgcccccgaugcuggacagcgacggcuccuucuuccuguacagcaagcucaccgucgacaagagccgcuggcagcaggggaacguguucuccugcagcgugaugcacgaggcccugcacaaccacuacacccagaagucccugagccucucccccggcaag

SEQ ID NO: 8419 - RNA, 642 nt, Artificial Sequence
  derived and/or modified sequence opt1 from Romosozumab_LightChain1
gacauccagaugacccagagccccuccagccuguccgccagcgugggcgaccgcgucaccaucacgugccgggccucccaggacaucagcaacuaccucaacugguaccagcagaagccggggaaggcgcccaagcugcugaucuacuacaccucccgccuccugagcggcgugcccucccgguucagcggguccggcagcgggaccgacuucacccugacgaucuccagccuccagcccgaggacuucgccaccuacuacugccagcagggcgacacccugccguacaccuucggcgggggcacgaagguggagaucaagcgcaccgucgccgcccccuccguguucaucuucccgcccagcgacgagcagcugaaguccgggaccgccagcguggucugccuccugaacaacuucuacccccgggaggcgaaggugcaguggaagguggacaacgcccugcaguccggcaacagccaggagagcgucaccgagcaggacuccaaggacagcacguacucccucagcuccacccugacccugagcaaggccgacuacgagaagcacaagguguacgccugcgaggugacccaccaggggcucuccagccccgucacgaaguccuucaaccgcggcgagugc

SEQ ID NO: 8420 - RNA, 1326 nt, Artificial Sequence
  derived and/or modified sequence opt1 from Rontalizuab_HeavyChain1
gaggugcagcuggucgagagcggcgggggccucgugcagcccgggggcucccugcgccugagcugcgccaccuccggguacaccuucacggaguacaucauccacugggugcggcaggccccgggcaagggccucgagugggucgcgagcaucaaccccgacuacgacaucaccaacuacaaccagcgcuucaaggggcgguucaccaucucccuggacaagagcaagcgcaccgccuaccugcagaacucccuccgggccgaggacacggccguguacuacugcgccagcuggaucuccgacuucuucgacuacuggggccaggggacccuggugaccgucagcuccgcgagcaccaagggccccuccguguucccccuggccccgagcuccaagagcacguccgggggcaccgccgcccucggcugccuggugaaggacuacuuccccgagcccgucaccgugagcuggaacuccggggcgcugaccagcggcgugcacacguuccccgccguccuccagagcuccgggcuguacagccuguccagcguggugaccgucccguccagcucccucggcacccagaccuacaucugcaacgugaaccacaagcccagcaacacgaagguggacaagaaggucgagcccaaguccugcgacaagacccacacgugcccgcccugccccgcccccgagcugcugggcgggcccagcguguuccucuucccgcccaagcccaaggacacccugaucucccgcacccccgaggugaccugcgucgugguggacgucagccacgaggacccggaggugaaguucaacugguacgucgacggcguggaggugcacaacgccaagaccaagccccgggaggagcaguacaacuccaccuaccgcgucgugagcgugcugacgguccuccaccaggacuggcugaacgggaaggaguacaagugcaagguguccaacaaggcccugcccgcgcccaucgagaagaccaucagcaaggccaagggccagccgcgggagccccagguguacacccucccgcccucccgcgaggagaccaagaaccaggucagccugacgugccuggugaagggguucuaccccuccgacaucgccguggagugggagagcaacggccagcccgagaacaacuacaagaccacgcccccgguccucgacagcgacggcuccuucuuccuguacagcaagcugaccguggacaagucccgguggcagcaggggaacguguucagcugcuccguccacgaggcccuccacaaccacuacacccagaagucccugagccugagccccggc

SEQ ID NO: 8421 - RNA, 648 nt, Artificial Sequence
  derived and/or modified sequence opt1 from Rontalizuab_LightChain1
gacauccagacccagagccccuccagccuguccgccagcgugggcgaccgcgucaccaucacgugccgggccucccagagcguguccaccagcuccuacagcuaccacugguaccagcagaagccggggaaggcgcccaaggugcucaucuccuacgccagcaaccuggaguccggcguccccagccgcuucuccgggagcggcuccgggaccgacuucacccugacgaucagcucccuccagcccgaggacuucgccaccuacuacugccagcacagcuggggcaucccgcggaccuucggccaggggaccaagguggagaucaagcgcacgguggccgcccccagcgucuucaucuucccgcccuccgacgagcagcucaagagcggcaccgcguccguggugugccugcugaacaacuucuacccccgggaggccaagguccaguggaagguggacaacgcccugcagagcgggaacucccaggagagcgugaccgagcaggacuccaaggacagcaccuacucccugagcuccacgcucacccugagcaaggccgacuacgagaagcacaaggucuacgcgugcgaggugacccaccagggccuguccagccccgugaccaaguccuucaaccgcggggagugc

SEQ ID NO: 8422 - RNA, 1341 nt, Artificial Sequence
  derived and/or modified sequence opt1 from Rontalizumab_HeavyChain1
gaggugcagcuggucgagagcggcgggggccucgugcagcccgggggcucccugcgccugagcugcgccaccuccggguacaccuucacggaguacaucauccacugggugcggcaggccccgggcaagggccucgagugggucgcgagcaucaaccccgacuacgacaucaccaacuacaaccagcgcuucaaggggcgguucaccaucucccuggacaagagcaagcgcaccgccuaccugcagaugaacucccuccgggccgaggacacggccguguacuacugcgccagcuggaucuccgacuucuucgacuacuggggccaggggacccuggugaccgucagcuccgcgagcaccaagggccccuccguguucccccuggccccgagcuccaagagcacguccgggggcaccgccgcccucggcugccuggugaaggacuacuuccccgagcccgucaccgugagcuggaacuccggggcgcugaccagcggcgugcacacguuccccgccguccuccagagcuccgggcuguacagccuguccagcguggugaccgucccguccagcucccucggcacccagaccuacaucugcaacgugaaccacaagcccagcaacacgaagguggacaagaaggucgagcccaaguccugcgacaagacccacacgugcccgcccugccccgcccccgagcugcugggcgggcccagcguguuccucuucccgcccaagcccaaggacacccugaugaucucccgcacccccgaggugaccugcgucgugguggacgucagccacgaggacccggaggugaaguucaacugguacgucgacggcguggaggugcacaacgccaagaccaagccccgggaggagcaguacaacuccaccuaccgcgucgugagcgugcugacgguccuccaccaggacuggcugaacgggaaggaguacaagugcaagguguccaacaaggcccugcccgcgcccaucgagaagaccaucagcaaggccaagggccagccgcgggagccccagguguacacccucccgcccucccgcgaggagaugaccaagaaccaggucagccugacgugccuggugaagggguucuaccccuccgacaucgccguggagugggagagcaacggccagcccgagaacaacuacaagaccacgcccccgguccucgacagcgacggcuccuucuuccuguacagcaagcugaccguggacaagucccgguggcagcaggggaacguguucagcugcuccgucaugcacgaggcccuccacaaccacuacacccagaagucccugagccugagccccggcaag

SEQ ID NO: 8423 - RNA, 654 nt, Artificial Sequence
  derived and/or modified sequence opt1 from Rontalizumab_LightChain1
gacauccagaugacccagagccccuccagccuguccgccagcgugggcgaccgcgucaccaucacgugccgggccucccagagcguguccaccagcuccuacagcuacaugcacugguaccagcagaagccggggaaggcgcccaaggugcucaucuccuacgccagcaaccuggaguccggcguccccagccgcuucuccgggagcggcuccgggaccgacuucacccugacgaucagcucccuccagcccgaggacuucgccaccuacuacugccagcacagcuggggcaucccgcggaccuucggccaggggaccaagguggagaucaagcgcacgguggccgcccccagcgucuucaucuucccgcccuccgacgagcagcucaagagcggcaccgcguccguggugugccugcugaacaacuucuacccccgggaggccaagguccaguggaagguggacaacgcccugcagagcgggaacucccaggagagcgugaccgagcaggacuccaaggacagcaccuacucccugagcuccacgcucacccugagcaaggccgacuacgagaagcacaaggucuacgcgugcgaggugacccaccagggccuguccagccccgugaccaaguccuucaaccgcggggagugc

SEQ ID NO: 8424 - RNA, 1341 nt, Artificial Sequence
  derived and/or modified sequence opt1 from Rovalpituzumab_tesirine_HeavyChain1
caggugcagcugguccagagcggcgccgaggugaagaagcccggggccuccgugaaggucagcugcaaggcguccggcuacaccuucaccaacuacgggaugaacugggugcgccaggccccgggccaggggcucgaguggaugggcuggaucaacacguacaccggcgagcccaccuacgccgacgacuucaaggggcgggugaccaugacgaccgacaccagcaccuccacggccuacauggagcugcgcagccugcgguccgacgacaccgccgucuacuacugcgcgcgcaucggcgacagcucccccagcgacuacugggggcagggcacccucgugaccguguccagcgccuccacgaaggggcccagcgucuucccgcuggcccccuccagcaaguccaccagcggcggcaccgccgcgcuggggugccucgugaaggacuacuuccccgagcccgugaccgucuccuggaacagcggcgcccugacgagcggggugcacaccuucccggccgugcugcaguccagcggccucuacucccugagcuccgucgugaccgugcccagcuccagccugggcacccagacguacaucugcaacgucaaccacaagcccuccaacaccaagguggacaagaagguggagcccaagagcugcgacaagacccacacgugcccgcccugccccgcccccgagcuccucgggggcccguccgucuuccuguucccgcccaagcccaaggacacccugaugaucagccggacccccgaggugaccugcguggucguggacgucucccacgaggaccccgaggugaaguucaacugguacguggacggggucgaggugcacaacgccaagaccaagccccgcgaggagcaguacaacagcacguaccggguggucuccgugcugaccgugcugcaccaggacuggcucaacggcaaggaguacaagugcaaggucagcaacaaggcgcugcccgccccgaucgagaagaccaucuccaaggccaaggggcagccccgcgagccccagguguacacccugcccccgagccgggacgagcucacgaagaaccaggugucccugaccugccuggucaagggcuucuaccccagcgacaucgccguggagugggagagcaacggccagcccgagaacaacuacaagaccaccccgcccgugcucgacuccgacgggagcuucuuccuguacuccaagcugacggucgacaagagccgcuggcagcagggcaacguguucuccugcagcgugaugcacgaggcccuccacaaccacuacacccagaagucccugagccugucccccggg

SEQ ID NO: 8425 - RNA, 642 nt, Artificial Sequence
  derived and/or modified sequence opt1 from Rovalpituzumab_tesirine_LightChain1
gagaucgugaugacccagagccccgccacccuguccgucagcccgggcgagcgcgccacgcucuccugcaaggcgagccaguccgugagcaacgacguggucugguaccagcagaagcccgggcaggcgccccggcugcugaucuacuacgccuccaaccgcuacaccggcauccccgcccgguucagcggguccggcagcgggaccgaguucacccucacgaucuccagccugcaguccgaggacuucgccguguacuacugccagcaggacuacaccagcccguggaccuucggccagggcaccaagcuggagaucaagcgcacgguggccgcccccuccgucuucaucuucccgcccagcgacgagcagcucaaguccgggaccgccagcguggugugccugcugaacaacuucuacccccgggaggccaagguccaguggaagguggacaacgcgcuccaguccggcaacagccaggagagcgugaccgagcaggacuccaaggacagcaccuacucccugagcuccacgcugacccucagcaaggccgacuacgagaagcacaaggucuacgccugcgaggugacccaccaggggcuguccagccccgugaccaaguccuucaaccgcggcgagugc

SEQ ID NO: 8426 - RNA, 1341 nt, Artificial Sequence
  derived and/or modified sequence opt1 from Rovelizumab_HeavyChain1
caggugcagcugguccagagcggcgccgaggugaagaagcccggggccuccgugaaggucagcugcaaggcguccggcuacaccuucaccaacaacuggaugcagugggugcgccaggccccggggcagggccucgaguggaugggggccaucuuccccggcgacgacgagacgcgguacacccagaaguuccgcggcaaggccaccaucaccgccgacacgagcaccuccaccgcguacauggagcugagcucccugcggagcgaggacaccgccguguacuacugcgggcgcggcgggaagcuccggcccuucgcccuggacuacuggggccaggggacgcuggucaccguguccagcgccuccaccaagggccccagcguguucccgcucgcgcccugcucccgcagcaccuccgagagcacggccgcccugggcugccuggucaaggacuacuuccccgagcccgugaccguguccuggaacagcggggcccucaccuccggcguccacaccuucccggccgugcugcagagcagcgggcuguacucccucagcuccguggucacggugcccagcuccagccugggcaccaagaccuacacgugcaacguggaccacaagcccuccaacaccaaggucgacaagcggguggagagcaaguacgggcccccgugccccuccugccccgcgcccgaguuccugggcggcccgagcguguuccucuucccgcccaagcccaaggacacccugaugaucucccgcacccccgaggugaccugcgucguggucgacgugagccaggaggaccccgagguccaguucaacugguacguggacgggguggagguccacaacgccaagacgaagccccgggaggagcaguucaacuccaccuaccgcguggugagcguccugaccgugcuccaccaggacuggcugaacggcaaggaguacaagugcaagguguccaacaaggggcugcccagcuccaucgagaagaccaucagcaaggccaagggccagccgcgggagccccaggucuacacgcucccgcccucccaggaggagaugaccaagaaccaggugagccugaccugccuggugaagggcuucuaccccagcgacaucgccgucgagugggaguccaacgggcagcccgagaacaacuacaagaccacgcccccggugcucgacagcgacggcuccuucuuccuguacagccgccugaccguggacaagucccgguggcaggaggggaacgucuucagcugcuccgugaugcacgaggcccuccacaaccacuacacccagaagucccugagccugagccucggcaag

SEQ ID NO: 8427 - RNA, 654 nt, Artificial Sequence
  derived and/or modified sequence opt1 from Rovelizumab_LightChain1
gacauccagaugacccagagccccuccagccuguccgccagcgugggcgaccgggucaccaucacgugccgggccuccgagagcguggaguccuacgggaacaacuucauguacugguaccagcagaagccgggcaaggcgcccaagcuccugaucuaccuggccagcaaccucgaguccggggugcccagccgcuucuccggcagcggguccggcaccgacuucacccugaccaucagcucccugcagcccgaggacuucgccacguacuacugccaccaggacaacgaggacccgcccaccuucggccaggggaccaagcucgagaucaagcggaccgucgccgcccccagcguguucaucuucccgcccuccgacgagcagcucaagagcggcacggcguccguggucugccugcugaacaacuucuacccccgcgaggccaaggugcaguggaagguggacaacgcccugcagagcgggaacagccaggaguccgucaccgagcaggacagcaaggacuccaccuacagccuguccagcacccucacgcuguccaaggccgacuacgagaagcacaagguguacgcgugcgaggugacccaccagggccugagcucccccgucaccaagagcuucaaccgcggggagugc

SEQ ID NO: 8428 - RNA, 1341 nt, Artificial Sequence
  derived and/or modified sequence opt1 from Ruplizumab_HeavyChain1
caggugcagcugguccagagcggcgccgagguggugaagcccggggccuccgucaagcucagcugcaaggcguccggcuacaucuucaccagcuacuacauguacugggugaagcaggccccggggcagggccuggaguggaucggggagaucaaccccuccaacggcgacaccaacuucaacgagaaguucaagagcaaggccacgcugaccguggacaaguccgccagcaccgccuacauggagcucuccagccugcgcuccgaggacaccgcggucuacuacugcacgcggagcgacggccgcaacgacauggacuccugggggcagggcacccuggugaccgugagcuccgccagcaccaaggggcccuccgucuucccccucgccccgagcuccaagagcacgagcggcgggaccgccgcgcugggcugccuggugaaggacuacuuccccgagcccgugaccgucuccuggaacagcggcgcccucaccuccggggugcacacguuccccgccgugcugcagagcuccggccuguacagccucuccagcgucgugaccgugccguccagcucccuggggacccagaccuacaucugcaacgucaaccacaagcccagcaacacgaagguggacaagaagguggagcccaaguccugcgacaagacccacacgugcccgcccugccccgcccccgagcugcucggcggccccagcgucuuccuguucccgcccaagcccaaggacacccugaugaucucccggacccccgaggugaccugcguggucguggacgucagccacgaggacccggaggugaaguucaacugguacguggacggggucgaggugcacaacgccaagaccaagccccgcgaggagcaguacaacuccaccuaccggguggucagcgugcucacggugcugcaccaggacuggcugaacggcaaggaguacaagugcaaggucuccaacaaggcgcuccccgcccccaucgagaagaccaucagcaaggccaaggggcagccgcgcgagccccagguguacacccugccgcccagccgggacgagcugaccaagaaccaggugucccucacgugccuggucaagggcuucuaccccagcgacaucgccguggagugggaguccaacgggcagcccgagaacaacuacaagaccacgcccccggugcuggacagcgacggcuccuucuuccucuacagcaagcugaccgucgacaagucccgcuggcagcagggcaacguguucagcugcuccgugaugcacgaggcccugcacaaccacuacacccagaagucccucagccugagccccggg

SEQ ID NO: 8429 - RNA, 654 nt, Artificial Sequence
  derived and/or modified sequence opt1 from Ruplizumab_LightChain1
gacaucgugcugacccagagccccgccacccucuccgucagcccgggcgagcgcgccacgaucuccugccgggcgagccagcgcguguccagcuccaccuacagcuacaugcacugguaccagcagaagcccgggcagccgcccaagcugcugaucaaguacgccuccaaccucgagagcggcgugcccgcccgguucuccgggagcggcuccgggaccgacuucacccugacgaucagcuccgucgagcccgaggacuucgccaccuacuacugccagcacagcugggagaucccgcccaccuucggcggcgggaccaagcuggagaucaagcgcacgguggccgcgcccuccguguucaucuucccgcccagcgacgagcagcucaaguccggcaccgccagcgucgugugccugcugaacaacuucuacccccgggaggccaaggugcaguggaaggucgacaacgcccuccagagcgggaacucccaggagagcgugaccgagcaggacuccaaggacagcaccuacucccugagcuccacgcugacccucagcaaggcggacuacgagaagcacaagguguacgccugcgaggucacccaccagggccuguccagccccgugaccaaguccuucaaccgcggggagugc

SEQ ID NO: 8430 - RNA, 1353 nt, Artificial Sequence
  derived and/or modified sequence opt1 from Sacituzumab_govitecan_HeavyChain1
caggugcagcugcagcagagcggcuccgagcucaagaagcccggggccagcgucaagguguccugcaaggccagcggcuacaccuucaccaacuacgggaugaacugggugaagcaggcgccgggccaggggcugaaguggaugggcuggaucaacacguacaccggcgagcccaccuacaccgacgacuucaaggggcgcuucgccuucucccuggacacgagcgucuccaccgccuaccuccagaucagcucccugaaggccgacgacaccgccguguacuucugcgcgcggggcggguucggcagcuccuacugguacuucgacgugugggggcagggcagccuggucaccguguccagcgccuccacgaagggccccagcguguucccccucgccccguccagcaaguccaccagcgggggcaccgccgcgcuggggugccuggucaaggacuacuuccccgagcccgugaccgugagcuggaacuccggcgcccucacgagcggcguccacaccuuccccgccgugcugcaguccagcgggcuguacucccucagcuccguggucaccgugccgagcuccagccugggcacccagacguacaucugcaacgugaaccacaagcccuccaacaccaaggucgacaagcgcguggagcccaagagcugcgacaagacccacacgugcccgcccugccccgcccccgagcugcucgggggccccuccguguuccuguucccgcccaagcccaaggacacccugaugaucagccggacccccgaggugaccugcgucguggucgacgugucccacgaggacccggaggucaaguucaacugguacguggacgggguggagguccacaacgccaagaccaagccccgcgaggagcaguacaacagcacguaccgggugguguccguccucaccgugcugcaccaggacuggcugaacggcaaggaguacaagugcaaggugagcaacaaggcgcuccccgcccccaucgagaagaccaucuccaaggccaagggccagccgcgcgagccccaggucuacacccugccgcccagccgggaggagaugacgaagaaccaggugagccugaccugccucgugaagggguucuaccccuccgacaucgccgucgagugggagagcaacggccagcccgagaacaacuacaagaccacgcccccggugcuggacuccgacgggagcuucuuccuguacuccaagcucaccguggacaagagccgcuggcagcagggcaacgucuucuccugcagcgugaugcacgaggcccugcacaaccacuacacccagaagucccugagccucucccccgggaag

SEQ ID NO: 8431 - RNA, 642 nt, Artificial Sequence
  derived and/or modified sequence opt1 from Sacituzumab_govitecan_LightChain1
gacauccagcugacccagagccccuccagccucuccgccagcgugggcgaccgcgucuccaucacgugcaaggccagccaggacguguccaucgcgguggccugguaccagcagaagccggggaaggcccccaagcugcugaucuacagcgccuccuaccgguacaccggcguccccgaccgcuucagcggguccggcagcgggaccgacuucacccucaccaucuccagccugcagcccgaggacuucgccguguacuacugccagcagcacuacaucacgccgcugaccuucggcgcgggcaccaagguggagaucaagcggaccgucgccgcccccuccguguucaucuucccgcccagcgacgagcagcucaaguccgggacggccagcguggucugccugcugaacaacuucuacccccgcgaggcgaaggugcaguggaagguggacaacgcccuccaguccggcaacagccaggagagcgucaccgagcaggacuccaaggacagcaccuacucccugagcuccacccugacgcucagcaaggccgacuacgagaagcacaagguguacgccugcgaggugacccaccaggggcuguccagccccgucaccaaguccuucaaccggggcgagugc

SEQ ID NO: 8432 - RNA, 1326 nt, Artificial Sequence
  derived and/or modified sequence opt1 from Samalizumab_HeavyChain1
caggugcagcugcagcagagcggcuccgagcucaagaagcccggggccagcgucaagaucuccugcaaggccagcggcuacuccuucaccgacuacaucauccugugggugcgccagaaccccgggaagggccuggaguggaucgggcacaucgaccccuacuacggcagcuccaacuacaaccucaaguucaagggccgggugaccaucacggcggaccagagcaccaccaccgccuacauggagcuguccagccugcgcuccgaggacacggccgucuacuacugcgggcggagcaagcgcgacuacuucgacuacuggggccaggggaccacccucaccguguccagcgccuccacgaagggccccagcguguucccccuggccccgugcucccggagcaccuccgagagcaccgcggcccuggggugccucgucaaggacuacuuccccgagcccgugaccgugagcuggaacuccggcgcccugacgagcggcguccacaccuuccccgccgugcugcaguccagcgggcucuacucccugagcuccguggucaccgugccgagcuccaacuucggcacccagacguacacgugcaacguggaccacaagcccagcaacaccaaggucgacaagaccguggagcgcaagugcugcguggagugcccgcccugcccggcgccgcccgucgccgggcccuccguguuccuguucccgcccaagcccaaggacacccucaugaucagccggacccccgaggugaccugcgucgugguggacgucucccaggaggaccccgaggugcaguucaacugguacgucgacggcguggaggugcacaacgccaagaccaagccccgcgaggagcaguucaacagcacguaccgggucguguccgugcugaccguccugcaccaggacuggcucaacggcaaggaguacaagugcaaggugagcaacaaggggcugcccuccagcaucgagaagaccaucuccaaggccaagggccagccccgcgagccccagguguacacccugccgcccagccaggaggagaugacgaagaaccaggucagccugaccugccucgugaagggguucuaccccuccgacaucgccguggagugggagagcaacggccagcccgagaacaacuacaagaccaccccgcccguccuggacuccgacgggagcuucuuccucuacucccggcugacgguggacaagagccgcuggcaggagggcaacguguucuccugcagcgucaugcacgaggcgcugcacaaccacuacacccagaagucccucagccugucccugggc

SEQ ID NO: 8433 - RNA, 642 nt, Artificial Sequence
  derived and/or modified sequence opt1 from Samalizumab_LightChain1
gacauccagaugacccagagccccuccagccuguccgccagcaucggcgaccgcgugaccaucacgugcaaggccucccaggacaucaacagcuaccucuccugguuccagcagaagccggggaaggcgcccaagcugcugaucuaccgggccaaccgccucgucgacggcgugcccagccgguucuccgggagcggcuccgggaccgacuacacccugaccaucagcucccugcagcccgaggacuucgccguguacuacugccuccaguacgacgaguucccguacacguucggcggcgggaccaagcuggagaucaagcgcaccgucgccgcccccagcguguucaucuucccgcccuccgacgagcagcucaagagcggcaccgcguccguggucugccugcugaacaacuucuacccccgggaggccaaggugcaguggaagguggacaacgcccugcagagcgggaacucccaggagagcgucacggagcaggacagcaaggacuccaccuacagccucuccagcacccugacccuguccaaggccgacuacgagaagcacaagguguacgcgugcgaggugacgcaccagggccucagcucccccgucaccaagagcuucaaccgcggggagugc

SEQ ID NO: 8434 - RNA, 1338 nt, Artificial Sequence
  derived and/or modified sequence opt1 from Sarilumab_HeavyChain1
gaggugcagcuggucgagagcggcgggggccucgugcagcccgggcgcucccugcggcugagcugcgccgccucccgcuucaccuucgacgacuacgcgaugcacugggugcggcaggccccgggcaaggggcucgagugggucagcggcaucuccuggaacagcggccgcaucggguacgccgacuccgugaagggccgguucaccaucagccgcgacaacgccgagaacucccuguuccugcagaugaacgggcuccgggccgaggacacggcgcuguacuacugcgccaagggccgcgacagcuucgacaucugggggcagggcaccauggugaccgucuccagcgccuccaccaagggccccagcguguucccccuggcccccuccagcaaguccacgagcgggggcaccgcggcccucgggugccuggugaaggacuacuucccggagcccgucaccguguccuggaacagcggcgcccugaccagcggcgugcacacguuccccgccguccuccaguccagcgggcuguacucccugagcuccguggugaccguccccagcuccagccucggcacccagaccuacaucugcaacgugaaccacaagccguccaacacgaagguggacaagaaggucgagcccaagagcugcgacaagacccacacgugcccgcccugcccggcccccgagcugcucgggggccccuccguguuccuguucccgcccaagcccaaggacacccugaugaucagccggacccccgaggugaccugcgucgugguggacgucucccacgaggaccccgaggugaaguucaacugguacgucgacgggguggaggugcacaacgcgaagaccaagccgcgcgaggagcaguacaacagcaccuaccgggucguguccgugcugacgguccuccaccaggacuggcugaacggcaaggaguacaagugcaaggugagcaacaaggcccugcccgcccccaucgagaagaccaucuccaaggccaagggccagccccgcgagccccagguguacacccucccgcccagccgggacgagcugaccaagaaccaggucucccugacgugccucgugaagggguucuaccccagcgacaucgccguggagugggagagcaacggccagcccgagaacaacuacaagaccaccccgcccguccuggacuccgacgggagcuucuuccuguacuccaagcucaccguggacaagagccgcuggcagcagggcaacguguucuccugcagcgucaugcacgaggcgcugcacaaccacuacacgcagaagucccugagccucucccccgggaag

SEQ ID NO: 8435 - RNA, 642 nt, Artificial Sequence
  derived and/or modified sequence opt1 from Sarilumab_LightChain1
gacauccagaugacccagagccccuccagcguguccgccagcgucggcgaccgcgugaccaucacgugccgggccucccaggggaucagcuccuggcuggcgugguaccagcagaagccgggcaaggcccccaagcuccugaucuacggggccagcucccuggagagcggcgugcccucccgcuucagcggguccggcagcggcaccgacuucacccucaccaucuccagccugcagcccgaggacuucgccuccuacuacugccagcaggccaacagcuucccguacacguucgggcagggcaccaagcuggagaucaagcggaccgucgcggcccccuccguguucaucuucccgcccagcgacgagcagcucaagagcgggaccgccuccguggucugccugcugaacaacuucuacccccgcgaggccaaggugcaguggaagguggacaacgcgcuccagagcggcaacucccaggagagcgucacggagcaggacuccaaggacagcaccuacucccugagcuccacccugacccucagcaaggccgacuacgagaagcacaagguguacgccugcgaggugacgcaccaggggcuguccagccccgucaccaaguccuucaaccggggcgagugc

SEQ ID NO: 8436 - RNA, 1296 nt, Artificial Sequence
  derived and/or modified sequence opt1 from Satumomab_pendetide_HeavyChain
caggugcagcugcagcagagcgacgccgagcucgucaagcccggcgccuccgugaagaucagcugcaaggccuccggguacacguucaccgaccacgccauccacugggccaagcagaagccggagcagggccuggaguggaucggguacaucagccccggcaacgacgacaucaaguacaacgagaaguucaaggggaaggccacgcugaccgccgacaaguccagcuccaccgcguacaugcagcucaacagccugaccuccgaggacagcgccguguacuucugcaagcgcuccuacuacggccacuggggccaggggacgacccugaccgucagcuccgccagcaccaagggccccuccguguucccccucgccccgugcagccgguccacgagcgaguccaccgcggcccuggggugccuggugaaggacuacuuccccgagcccgucaccgugagcuggaacagcggcgcccucaccuccggggugcacacguuccccgccguccugcagagcuccggccuguacagccucuccagcguggugaccgucccguccagcucccugggcaccaagaccuacacgugcaacguggaccacaagcccagcaacaccaagguggacaagcgcgucugcccgcccugcaagugccccgcccccaaccugcucgggggccccuccguguucaucuucccgcccaagaucaaggacgugcugaugaucagccugucccccaucgugaccugcgugguggucgacgugagcgaggacgaccccgacgugcagaucuccugguucgucaacaacguggagguccacaccgcgcagacgcagacccaccgggaggacuacaacagcacccuccgcgugguguccgcccugcccauccagcaccaggacuggaugagcgggaaggaguucaagugcaaggucaacaacaaggaccugccggcccccaucgagcggaccaucuccaagcccaagggcagcgugcgcgcgccccagguguacguccucccgccgcccgaggaggagaugacgaagaagcaggucacccugaccugcauggugaccgacuucaugcccgaggacaucuacgucgaguggacgaacaacggcaagaccgagcugaacuacaagaacaccgagcccgugcucgacagcgacggguccuacuucauguacagcaagcugcggguggagaagaagaacugggucgagcgcaacuccuacagcugcuccguggugcacgagggccugcacaaccaccacaccaccaagagcuucucccgg

SEQ ID NO: 8437 - RNA, 630 nt, Artificial Sequence
  derived and/or modified sequence opt1 from Satumomab_pendetide_LightChain
gacauccagaugacccagagccccgccucccugagcguguccgucggcgagaccgugacgaucacgugccgcgccagcgagaacaucuacuccaaccucgcgugguaccagcagaagcagggcaagagcccgcagcugcugguguacgccgccaccaaccucgccgacgggguccccucccgguucagcggguccggcagcgggacccaguacucccugaagaucaacagccugcaguccgaggacuucggcagcuacuacugccagcacuucuggggcacccccuacaccuucgggggcgggacccgccucgagaucaagcgggccgacgcggcccccaccguguucaucuucccgcccuccgacgagcagcucaagagcggcacggccuccguggucugccugcugaacaacuucuacccccgcgaggccaaggugcaguggaagguggacaacgcgcugcagagcgggaacucccaggagagcgucaccgagcaggacagcaaggacuccaccuacagccuguccagcacccucacgcuguccaaggccgacuacgagaagcacaagguguacgccugcgaggugacccaccagggccugagcucccccgucaccaagagcuucaac

SEQ ID NO: 8438 - RNA, 1371 nt, Artificial Sequence
  derived and/or modified sequence opt1 from Secukinumab_HeavyChain1
gaggugcagcuggucgagagcggcgggggccucgugcagcccgggggcucccugcgccugagcugcgccgccuccggguucaccuucagcaacuacuggaugaacugggugcggcaggcgccgggcaagggccucgagugggucgccgccaucaaccaggacggguccgagaaguacuacgugggcagcgugaaggggcgcuucaccaucucccgggacaacgccaagaacagccuguaccugcagaugaacucccuccgcgucgaggacacggccguguacuacugcgugcgggacuacuacgacauccugaccgacuacuacauccacuacugguacuucgaccuguggggccgcgggacccucgucaccgugagcuccgcgagcacgaagggccccuccguguucccccuggcccccagcuccaagagcaccuccggcgggaccgccgcccugggcugccucgucaaggacuacuucccggagcccgugaccgugagcuggaacuccggggcgcugacgagcggcguccacaccuuccccgccgugcugcagagcuccggccucuacagccuguccagcguggucaccgugcccuccagcucccuggggacccagacguacaucugcaacgugaaccacaagccgagcaacaccaaggucgacaagcggguggagcccaaguccugcgacaagacccacacgugcccgcccugccccgcccccgagcuccugggcgggcccagcguguuccuguucccgcccaagcccaaggacacccucaugaucucccgcacccccgaggugaccugcgucgucguggacgugagccacgaggaccccgaggucaaguucaacugguacguggacggcguggagguccacaacgccaagaccaagccgcgggaggagcaguacaacuccacguaccgcguggugagcguccugaccgugcugcaccaggacuggcucaacgggaaggaguacaagugcaagguguccaacaaggcccugcccgcgcccaucgagaagaccaucagcaaggccaagggccagccccgggagccgcaggucuacacccugccgcccucccgcgaggagaugacgaagaaccaggugagccugaccugccucgugaagggcuucuaccccuccgacaucgccgucgagugggagagcaacgggcagcccgagaacaacuacaagaccaccccgcccgugcuggacagcgacggcuccuucuuccucuacagcaagcugacgguggacaagucccgguggcagcaggggaacgucuucagcugcuccgugaugcacgaggcccugcacaaccacuacacccagaagucccucagccugagccccggcaag

SEQ ID NO: 8439 - RNA, 645 nt, Artificial Sequence
  derived and/or modified sequence opt1 from Secukinumab_LightChain1
gagaucgugcugacccagagccccggcacccucucccugagcccgggggagcgcgccacgcuguccugccgggccagccaguccgucagcuccagcuaccucgcgugguaccagcagaagcccggccaggcgccccgccugcugaucuacggggccuccagccgggccaccggcauccccgaccgcuucuccgggagcggcuccggcaccgacuucacccucacgaucagccggcuggagccggaggacuucgccguguacuacugccagcaguacggguccagccccugcaccuucggccaggggacccgccuggagaucaagcggaccguggccgcccccuccgucuucaucuucccgcccagcgacgagcagcucaaguccggcacggccagcguggugugccugcugaacaacuucuacccccgcgaggccaagguccaguggaagguggacaacgcgcuccagagcgggaacucccaggagagcgugaccgagcaggacuccaaggacagcaccuacucccugagcuccacccugacgcucagcaaggccgacuacgagaagcacaaggucuacgccugcgaggugacccaccagggccuguccagccccgugaccaaguccuucaaccggggcgagugc

SEQ ID NO: 8440 - RNA, 1335 nt, Artificial Sequence
  derived and/or modified sequence opt1 from Seribantumab_HeavyChain1
gaggugcagcugcucgagagcggcgggggccugguccagcccgggggcucccugcgccucagcugcgccgccuccggguucaccuucagccacuacgugauggcgugggugcggcaggccccgggcaagggccuggagugggucuccagcaucuccagcuccgggggcuggacccuguacgccgacagcgugaaggggcgcuucacgaucucccgggacaacagcaagaacacccucuaccugcagaugaacucccugcgcgccgaggacaccgccguguacuacugcacccggggccucaagauggcgacgaucuucgacuacugggggcagggcacccuggucaccgugagcuccgccagcaccaagggccccuccguguucccccuggcccccugcagccgcuccacgagcgagagcaccgccgcgcucgggugccuggucaaggacuacuucccggagcccgugaccguguccuggaacagcggcgcccugaccuccgggguccacacguuccccgccgugcuccagagcuccggccuguacagccuguccagcguggucaccgugcccuccagcaacuucggcacccagaccuacacgugcaacguggaccacaagccguccaacaccaaggucgacaagaccguggagcggaagugcugcguggagugcccgcccugccccgccccgcccgucgccgggcccagcguguuccucuucccgcccaagcccaaggacacccugaugaucucccgcacgcccgaggugaccugcgucguggucgacgugagccacgaggaccccgaggugcaguucaacugguacgucgacggcguggaggugcacaacgcgaagaccaagccccgggaggagcaguucaacuccaccuuccgcgucgugagcgugcugacggucgugcaccaggacuggcucaacgggaaggaguacaagugcaagguguccaacaagggccugcccgcccccaucgagaagaccaucagcaagaccaaggggcagccccgggagccgcaggucuacacccugccgcccucccgcgaggagaugacgaagaaccaggugagccugaccugccucgugaagggcuucuaccccagcgacaucgccgucgagugggaguccaacggccagcccgagaacaacuacaagaccaccccgcccaugcuggacagcgacggguccuucuuccucuacagcaagcugacgguggacaagucccgguggcagcagggcaacguguucagcugcuccgucaugcacgaggcccugcacaaccacuacacccagaagucccucagccugagccccgggaag

SEQ ID NO: 8441 - RNA, 651 nt, Artificial Sequence
  derived and/or modified sequence opt1 from Seribantumab_LightChain1
cagagcgcccugacccagcccgccuccgugagcggcuccccggggcagagcaucaccaucuccugcacgggcaccagcuccgacgucgggagcuacaacgugguguccugguaccagcagcaccccggcaaggcgcccaagcucaucaucuacgaggucagccagcgccccuccggggugagcaaccgguucuccggcagcaaguccggcaacaccgccagccugaccaucuccgggcugcagacggaggacgaggccgacuacuacugcugcagcuacgccggcuccagcaucuucgugaucuucgggggcgggaccaaggucaccgugcucggccagccgaaggccgcgcccagcgugacccuguucccgcccuccagcgaggagcugcaggccaacaaggccacgcucgucugccugguguccgacuucuaccccggcgccgugaccgucgcguggaaggccgacgggagccccgugaaggugggcgucgagaccaccaagcccuccaagcagagcaacaacaaguacgccgccuccagcuaccugucccucacgcccgagcaguggaagucccaccgcagcuacagcugccgggugacccacgagggguccaccguggagaagaccgucgccccggcggagugcagc

SEQ ID NO: 8442 - RNA, 1353 nt, Artificial Sequence
  derived and/or modified sequence opt1 from Setoxaximab_HeavyChain1
gaggugcagcugcagcagcccggccccgagcucgagaagcccggggccagcgucaagcuguccugcaaggccagcggcuacuccuucaccgacuacaacaugaacugggugaagcagaacaacggggagagccuggaguggaucggcaagaucgaccccuacuacgggggccccuccuacaaccagaaguucaaggacaaggcgacccucacgguggacaagagcuccagcaccgccuacaugcagcugaagucccugaccagcgaggacuccgccgucuacuacugcacccgcggcgggaaccgggacugguacuucgacguguggggcgccgggacgacccucaccgugagcgccgaguucgcguccaccaagggcccgagcgucuucccccuggcccccuccagcaaguccacgagcgggggcaccgccgcccugggcugccucgugaaggacuacuuccccgagccggugaccgucuccuggaacagcggggcgcugaccagcggcgugcacacguuccccgccgugcugcaguccagcgggcucuacucccugagcuccgucgugaccgugcccagcuccagccugggcacccagaccuacaucugcaacgucaaccacaagcccuccaacacgaagguggacaagaagguggagcccaagagcugcgacaagacccacacgugcccgcccugccccgccccggagcuccugggcgggcccuccgucuuccuguucccgcccaagcccaaggacacccucaugaucagccgcacccccgaggugaccugcguggucguggacgugucccacgaggaccccgaggucaaguucaacugguacguggacggcgucgaggugcacaacgccaagaccaagccccgggaggagcaguacaacagcaccuaccgcguggucuccgugcugacggugcugcaccaggacuggcucaacgggaaggaguacaagugcaaggucagcaacaaggcccugccggcgcccaucgagaagaccaucuccaaggccaagggccagccccgggagccccagguguacacccugccgcccagccgcgacgagcucaccaagaaccaggugucccugacgugccuggucaagggguucuaccccagcgacaucgccguggagugggagagcaacggccagccggagaacaacuacaagaccaccccgcccgugcucgacuccgacggcagcuucuuccuguacuccaagcugaccgucgacaagagccgguggcagcaggggaacguguucuccugcagcgugaugcacgaggcccuccacaaccacuacacgcagaagucccugagccugucccccggcaag

SEQ ID NO: 8443 - RNA, 660 nt, Artificial Sequence
  derived and/or modified sequence opt1 from Setoxaximab_LightChain1
gacaucgugcugagccagucccccagcucccucgucgugagcgugggcgagaaggucaccauguccugcaagagcucccagagccugcuguacucccgcaaccagaagaacuaccucgccugguaccagcagaagccggggcagagccccaaggugcugaucuacugggccuccacccgggagagcggcgugcccgaccgccugacgggguccggcagcgggaccgacuucacccucaccaucuccagcgucaaggcggaggaccuggccguguacuacugccagcaguacuacuccuacccccugacguucggcgccggcaccaagcucgagcugaagcggaccguggccgccccgagcgucuucaucuucccgcccuccgacgagcagcucaagagcgggaccgcgagcguggugugccugcugaacaacuucuacccccgcgaggccaagguccaguggaagguggacaacgcccugcaguccggcaacagccaggaguccgugacggagcaggacagcaaggacuccaccuacagccucuccagcacccugacccuguccaaggccgacuacgagaagcacaaggucuacgcgugcgaggugacgcaccaggggcucagcucccccgugaccaagagcuucaaccggggcgagugc

SEQ ID NO: 8444 - RNA, 1338 nt, Artificial Sequence
  derived and/or modified sequence opt1 from Sifalimumab_HeavyChain1
caggugcagcugguccagagcggcgccgaggugaagaagcccggggccuccgugaaggucagcugcaaggcguccggcuacaccuucaccagcuacuccaucagcugggugcgccaggccccggggcagggccucgaguggaugggguggaucuccguguacaacggcaacaccaacuacgcccagaaguuccagggccgggucaccaugaccaccgacacgagcaccuccaccgccuaccuggagcugcgcagccuccgguccgacgacaccgccguguacuacugcgcgcgcgaccccaucgccgccggguacuggggccaggggacgcuggugaccgucagcuccgccagcaccaagggccccuccguguucccccuggcgccgagcuccaagagcaccuccgggggcacggccgcccucggcugccuggugaaggacuacuuccccgagcccgucaccgugagcuggaacagcggggcccugaccuccggcgugcacaccuuccccgccguccuccagagcuccgggcuguacagccuguccagcguggugacggucccguccagcucccucggcacccagaccuacaucugcaacgugaaccacaagcccagcaacaccaagguggacaagaaggucgagcccaaguccugcgacaagacgcacacgugcccgcccugccccgcgcccgagcugcugggcgggcccagcguguuccucuucccgcccaagcccaaggacacccugaugaucucccggacccccgaggugaccugcgucguggucgacgugagccacgaggacccggaggugaaguucaacugguacgucgacggcguggaggugcacaacgccaagaccaagccccgcgaggagcaguacaacuccaccuaccgggucgugagcgugcugaccguccuccaccaggacuggcugaacgggaaggaguacaagugcaagguguccaacaaggcccugcccgcccccaucgagaagacgaucagcaaggccaagggccagccgcgcgagccccagguguacacccucccgcccucccgggaggagaugaccaagaaccaggucagccugaccugccuggugaagggguucuaccccagcgacaucgcgguggagugggaguccaacggccagcccgagaacaacuacaagacgacgcccccgguccucgacagcgacggcuccuucuuccuguacagcaagcugaccguggacaagucccgcuggcagcaggggaacguguucagcugcuccgucaugcacgaggcccuccacaaccacuacacccagaagucccugagccugagccccggcaag

SEQ ID NO: 8445 - RNA, 645 nt, Artificial Sequence
  derived and/or modified sequence opt1 from Sifalimumab_LightChain1
gagaucgugcugacccagagccccggcacccucucccugagcccgggggagcgcgccacgcuguccugccgggccagccaguccgucagcuccaccuaccucgcgugguaccagcagaagcccggccaggcgccccgccugcugaucuacggggccagcucccgggccaccggcauccccgaccgcuucagcggguccggcagcggcaccgacuucacgcucaccaucucccggcuggagccggaggacuucgccguguacuacugccagcaguacgggagcagcccccgcaccuucggccaggggaccaagguggagaucaagcggacggucgccgcccccagcguguucaucuucccgcccuccgacgagcagcugaaguccggcaccgccuccguggucugccuccugaacaacuucuacccccgcgaggccaaggugcaguggaagguggacaacgcgcugcagagcgggaacagccaggaguccgucaccgagcaggacagcaaggacuccaccuacagccucuccagcacgcugacccuguccaaggccgacuacgagaagcacaagguguacgccugcgaggugacccaccagggccucagcucccccgucaccaagagcuucaaccggggcgagugc

SEQ ID NO: 8446 - RNA, 1347 nt, Artificial Sequence
  derived and/or modified sequence opt1 from Siltuximab_HeavyChain1
gaggugcagcuggucgagagcggcgggaagcuccugaagcccggcgggucccugaagcucagcugcgccgccuccggcuucaccuucagcuccuucgcgaugagcugguuccgccaguccccggagaagcggcuggaguggguggccgagaucagcuccgggggcagcuacaccuacuaccccgacacggugaccggccgcuucaccaucucccgggacaacgccaagaacacccuguaccucgagaugagcucccugcgcagcgaggacacggccauguacuacugcgcccgggggcuguggggcuacuacgcgcucgacuacugggggcagggcaccuccgucaccgugagcuccgccagcaccaaggggcccuccguguucccccuggccccgagcagcaaguccacgagcggcggcaccgccgcgcuggggugccucgucaaggacuacuuccccgagcccgugaccguguccuggaacagcggcgcccugaccuccgggguccacacguuccccgccgugcugcagagcuccggccucuacagccuguccagcguggucaccgugccguccagcucccugggcacccagaccuacaucugcaacgugaaccacaagcccagcaacacgaaggucgacaagaagguggagcccaaguccugcgacaagacccacacgugcccgcccugccccgcccccgagcuccucgggggccccagcguguuccuguucccgcccaagcccaaggacacccugaugaucucccgcacccccgaggugaccugcgucguggucgacgugagccacgaggacccggaggugaaguucaacugguacgucgacgggguggagguccacaacgccaagaccaagccccgggaggagcaguacaacuccaccuaccgcguggugagcguccugacggugcugcaccaggacuggcucaacggcaaggaguacaagugcaaggugagcaacaaggcgcugcccgcccccaucgagaagaccaucuccaaggccaaggggcagccgcgggagccccaggucuacacccugccgcccagccgcgacgagcucaccaagaaccaggugucccugacgugccuggugaagggcuucuaccccagcgacaucgccgucgagugggaguccaacggccagcccgagaacaacuacaagaccacgcccccggugcucgacagcgacggguccuucuuccuguacagcaagcugaccguggacaagucccgguggcagcagggcaacgucuucagcugcuccgugaugcacgaggcccuccacaaccacuacacccagaagucccugagccugagccccgggaag

SEQ ID NO: 8447 - RNA, 639 nt, Artificial Sequence
  derived and/or modified sequence opt1 from Siltuximab_LightChain1
cagaucgugcugauccagagccccgccaucauguccgccagcccgggcgagaaggucaccaugaccugcuccgcgagcuccagcguguccuacauguacugguaccagcagaagcccgggagcagcccccgccuccugaucuacgacacgagcaaccuggccuccggcgugcccguccgguucagcggguccggcagcgggaccuccuacagccucaccaucucccgcauggaggccgaggacgccgccaccuacuacugccagcaguggagcggcuacccguacacguucggcgggggcaccaagcuggagaucaagcggaccguggcggcccccuccguguucaucuucccgcccagcgacgagcagcugaaguccgggaccgccuccgucgugugccuccugaacaacuucuacccccgcgaggccaaggugcaguggaaggucgacaacgcgcugcagagcggcaacucccaggagagcgugacggagcaggacuccaaggacagcaccuacucccucagcuccacccugacccugagcaaggccgacuacgagaagcacaagguguacgccugcgaggucacgcaccaggggcucuccagccccgugaccaaguccuucaaccggggcgagugc

SEQ ID NO: 8448 - RNA, 1329 nt, Artificial Sequence
  derived and/or modified sequence opt1 from Simtuzumab_HeavyChain1
caggugcagcugguccagagcggcgccgaggugaagaagcccggggccuccgugaaggucagcugcaaggcguccggcuacgccuucaccuacuaccucaucgagugggugcgccaggcccccgggcagggccuggaguggaucggggugaucaaccccggcagcggcgggaccaacuacaacgagaaguucaagggccgggccacgaucaccgccgacaaguccaccagcaccgcguacauggagcuguccagccuccgcuccgaggacacggccgucuacuucugcgcccggaacuggaugaacuucgacuacugggggcagggcaccaccgugaccgugagcuccgccagcacgaaggggcccuccgucuucccccuggcgccgugcagccgcuccaccagcgaguccaccgccgcccugggcugccucgugaaggacuacuuccccgagcccgugaccgucagcuggaacuccggcgcccugacgagcggggugcacaccuuccccgccgugcugcagagcuccggccucuacagccuguccagcgucgugaccgugccguccagcucccuggggaccaagacguacacgugcaacgucgaccacaagcccagcaacaccaagguggacaagcggguggaguccaaguacggcccgcccugcccgcccugccccgcgcccgaguuccucggcgggccgagcgucuuccuguucccgcccaagcccaaggacacccugaugaucucccgcacccccgaggugaccugcguggucguggacgucagccaggaggaccccgaggugcaguucaacugguacguggacggcgucgaggugcacaacgccaagaccaagccccgggaggagcaguucaacuccaccuaccgcguggucagcgugcucacggugcugcaccaggacuggcugaacgggaaggaguacaagugcaaggucuccaacaagggccuccccagcuccaucgagaagaccaucagcaaggccaaggggcagccgcgggagccccagguguacacccugccgcccucccaggaggagaugaccaagaaccaggugagccugacgugccucgucaagggcuucuaccccagcgacaucgccguggagugggaguccaacggccagcccgagaacaacuacaagaccaccccgcccgugcuggacagcgacggguccuucuuccuguacagccgccucaccgucgacaagucccgguggcaggagggcaacguguucagcugcuccgugaugcacgaggcccugcacaaccacuacacgcagaagucccugagccucagccuggggaag

SEQ ID NO: 8449 - RNA, 657 nt, Artificial Sequence
  derived and/or modified sequence opt1 from Simtuzumab_LightChain1
gacaucgugaugacccagacgccccugagccucuccgucaccccgggccagcccgccagcaucuccugccgcagcuccaagagccugcugcacuccaacgggaacaccuaccucuacugguuccugcagaagcccggccagagcccccaguuccugaucuaccggauguccaaccucgccagcggggugccggaccgcuucuccggcagcggguccggcaccgacuucacccugaagaucagccggguggaggcggaggacgucggcguguacuacugcaugcagcaccuggaguaccccuacacguucgggggcgggaccaagguggagaucaagcgcaccgucgccgcccccuccguguucaucuucccgcccagcgacgagcagcucaaguccggcaccgccagcguggucugccugcugaacaacuucuacccccgggaggccaaggugcaguggaagguggacaacgcgcuccaguccgggaacagccaggagagcgucacggagcaggacuccaaggacagcaccuacucccugagcuccacccugacccucagcaaggccgacuacgagaagcacaagguguacgccugcgaggugacgcaccagggccuguccagccccgucaccaaguccuucaaccgcggcgagugc

SEQ ID NO: 8450 - RNA, 1347 nt, Artificial Sequence
  derived and/or modified sequence opt1 from Sirukumab_HeavyChain1
gaggugcagcuggucgagagcggcgggggccucgugcagcccgggggcucccugcgccugagcugcgccgccuccggguucaccuucagcccguucgcgauguccugggugcggcaggcccccggcaagggccucgagugggucgccaagaucagccccgggggcuccuggaccuacuacagcgacacggugaccgggcgcuucaccaucucccgggacaacgccaagaacagccuguaccugcagaugaacucccuccgcgccgaggacaccgcgguguacuacugcgcccggcagcuguggggcuacuacgcccuggacaucugggggcagggcacgaccgucaccgugagcuccgccagcaccaagggccccuccguguucccgcucgcgcccagcuccaagagcacguccgggggcaccgccgcccuggggugccuggucaaggacuacuuccccgagcccgugaccgugagcuggaacagcggcgcccucaccuccggcguccacacguucccggccgugcugcagagcuccgggcuguacagccucuccagcguggucaccgugcccuccagcucccugggcacccagaccuacaucugcaacgugaaccacaagcccagcaacacgaaggucgacaagaagguggagcccaaguccugcgacaagacccacacgugcccgcccugccccgcgcccgagcugcucgggggcccgagcguguuccuguucccgcccaagcccaaggacacccugaugaucucccgcacccccgaggugaccugcgucguggucgacgugagccacgaggaccccgaggucaaguucaacugguacguggacgggguggagguccacaacgccaagaccaagccccgggaggagcaguacaacuccaccuaccgcguggugagcguccucacggugcugcaccaggacuggcugaacggcaaggaguacaagugcaagguguccaacaaggcccuccccgccccgaucgagaagaccaucagcaaggccaagggccagccccgggagccccaggucuacacccugcccccgucccgcgacgagcugaccaagaaccaggugagccucacgugccuggugaagggguucuaccccagcgacaucgcggucgagugggaguccaacggccagcccgagaacaacuacaagaccaccccgcccgugcuggacagcgacggguccuucuuccucuacagcaagcugaccguggacaagucccgguggcagcagggcaacgucuucagcugcuccgugaugcacgaggcccugcacaaccacuacacgcagaagucccucagccugagccccgggaag

SEQ ID NO: 8451 - RNA, 639 nt, Artificial Sequence
  derived and/or modified sequence opt1 from Sirukumab_LightChain1
gagaucgugcugacccagagccccgccacccucucccugagcccgggcgagcgcgccacgcuguccugcagcgcguccaucagcgucuccuacauguacugguaccagcagaagcccgggcaggcgccccggcuccugaucuacgacaugagcaaccuggccuccggcauccccgcccgcuucagcggguccggcagcgggaccgacuucacccucaccaucuccagccuggagccggaggacuucgccguguacuacugcaugcagugguccggcuaccccuacacguucggcgggggcaccaagguggagaucaagcggaccgucgccgcccccagcguguucaucuucccgcccuccgacgagcagcucaagagcgggaccgccuccguggucugccugcugaacaacuucuacccccgcgaggccaaggugcaguggaagguggacaacgcgcugcagagcggcaacagccaggaguccgucacggagcaggacagcaaggacuccaccuacagccucuccagcacccugacccuguccaaggccgacuacgagaagcacaagguguacgccugcgaggugacgcaccaggggcucagcucccccgucaccaagagcuucaaccggggcgagugc

SEQ ID NO: 8452 - RNA, 1338 nt, Artificial Sequence
  derived and/or modified sequence opt1 from Sofituzumab_vedotin_HeavyChain1
gaggugcagcuggucgagagcggcgggggccucgugcagcccgggggcucccugcgccugagcugcgccgccuccggguacagcaucaccaacgacuacgcguggaacugggugcggcaggccccgggcaagggccucgagugggucggguacaucuccuacagcggcuacaccacguacaaccccucccucaagagccgcuucaccaucucccgggacaccagcaagaacacccuguaccuccagaugaacucccugcgcgccgaggacacggccguguacuacugcgcccgguggaccagcgggcuggacuacuggggccaggggacccucgugaccgucuccagcgcguccacgaagggccccagcguguucccccuggccccguccagcaaguccaccagcggcgggaccgccgcccugggcugccucgugaaggacuacuuccccgagcccgucaccgugagcuggaacuccggggcgcugacgagcggcgugcacaccuuccccgccguccugcaguccagcggccucuacucccugagcuccguggugaccgucccgagcuccagccuggggacccagacguacaucugcaacgugaaccacaagcccuccaacaccaagguggacaagaaggucgagcccaagagcugcgacaagacccacacgugcccgcccugccccgcccccgagcuccugggcgggcccuccguguuccuguucccgcccaagcccaaggacacccucaugaucagccgcacccccgaggugaccugcgucgugguggacgucucccacgaggacccggaggugaaguucaacugguacgucgacggcguggaggugcacaacgccaagaccaagccccgggaggagcaguacaacagcacguaccgcgucguguccgugcugaccguccugcaccaggacuggcucaacgggaaggaguacaagugcaaggugagcaacaaggcccugcccgcgcccaucgagaagaccaucuccaaggccaagggccagccgcgggagccccagguguacacccugccgcccagccgcgaggagaugacgaagaaccaggucagccugaccugccuggugaagggcuucuaccccuccgacaucgccguggagugggagagcaacgggcagcccgagaacaacuacaagaccacgcccccgguccuggacuccgacggcagcuucuuccucuacuccaagcugaccguggacaagagccgguggcagcaggggaacguguucuccugcagcgucaugcacgaggcccugcacaaccacuacacccagaagucccucagccugucccccggcaag

SEQ ID NO: 8453 - RNA, 642 nt, Artificial Sequence
  derived and/or modified sequence opt1 from Sofituzumab_vedotin_LightChain1
gacauccagaugacccagagccccuccagccuguccgccagcgugggcgaccgcgucaccaucacgugcaaggccuccgaccucauccacaacuggcuggcgugguaccagcagaagccggggaaggcccccaagcugcucaucuacggcgccaccagccuggagaccggggugcccucccgguucagcggcuccgggagcggcaccgacuucacgcugaccaucuccagccuccagcccgaggacuucgccaccuacuacugccagcaguacuggaccacgccguucaccuucggccaggggaccaagguggagaucaagcgcaccgucgccgcgcccuccguguucaucuucccgcccagcgacgagcagcugaaguccggcacggccagcguggucugccugcucaacaacuucuacccccgggaggccaaggugcaguggaagguggacaacgcccugcaguccgggaacagccaggaguccgucaccgagcaggacagcaaggacagcaccuacucccugagcuccacccucacgcugagcaaggcggacuacgagaagcacaagguguacgccugcgaggugacccaccagggccuguccagccccgucaccaaguccuucaaccgcggggagugc

SEQ ID NO: 8454 - RNA, 1323 nt, Artificial Sequence
  derived and/or modified sequence opt1 from Solanezumab_HeavyChain1
gaggugcagcuggucgagagcggcgggggccucgugcagcccgggggcucccugcgccugagcugcgccgccuccggguucaccuucagccgguacuccaugagcugggugcgccaggcgccgggcaagggccucgagcuggucgcccagaucaacuccguggggaacagcaccuacuaccccgacaccgugaagggccgguucaccaucucccgcgacaacgccaagaacacccuguaccuccagaugaacagccugcgggccgaggacaccgccgucuacuacugcgcguccggggacuacuggggccaggggacgcuggugaccgugagcuccgccagcaccaagggccccuccgucuucccccucgccccgagcuccaagagcaccuccggcgggacggccgcgcugggcugccuggugaaggacuacuuccccgagcccgugaccgucagcuggaacagcggggcccucaccuccggcgugcacaccuuccccgccgugcugcagagcuccggccuguacagccucuccagcgucgugacggugccguccagcucccuggggacccagaccuacaucugcaacgucaaccacaagcccagcaacaccaagguggacaagaagguggagcccaaguccugcgacaagacgcacacgugcccgcccugccccgcccccgagcugcucggcgggcccagcgucuuccuguucccgcccaagcccaaggacacccugaugaucucccgcacccccgaggugaccugcguggucguggacgucagccacgaggacccggaggugaaguucaacugguacguggacggcgucgaggugcacaacgccaagaccaagccccgggaggagcaguacaacuccaccuaccgcguggucagcgugcucaccgugcugcaccaggacuggcugaacgggaaggaguacaagugcaaggucuccaacaaggcgcuccccgcccccaucgagaagacgaucagcaaggccaagggccagccgcgggagccccagguguacacccugccgcccucccgcgacgagcugaccaagaaccaggugagccugaccugccucgucaagggcuucuaccccagcgacaucgccguggagugggaguccaacgggcagcccgagaacaacuacaagacgacgcccccggugcuggacagcgacggcuccuucuuccucuacagcaagcugaccgucgacaagucccgguggcagcaggggaacguguucagcugcuccgugaugcacgaggcccugcacaaccacuacacccagaagucccucagccugagccccggc

SEQ ID NO: 8455 - RNA, 1326 nt, Artificial Sequence
  derived and/or modified sequence opt1 from Solanezumab_HeavyChain
gaggugcagcuggucgagagcggcgggggccucgugcagcccgggggcucccugcgccugagcugcgccgccuccggguucaccuucagccgguacuccaugagcugggugcgccaggcgccgggcaagggccucgagcuggucgcccagaucaacuccguggggaacagcaccuacuaccccgacaccgugaagggccgguucaccaucucccgcgacaacgccaagaacacccuguaccuccagaugaacagccugcgggccgaggacaccgccgucuacuacugcgcguccggggacuacuggggccaggggacgcuggugaccgugagcuccgccagcaccaagggccccuccgucuucccccucgccccgagcuccaagagcaccuccggcgggacggccgcgcugggcugccuggugaaggacuacuuccccgagcccgugaccgucagcuggaacagcggggcccucaccuccggcgugcacaccuuccccgccgugcugcagagcuccggccuguacagccucuccagcgucgugacggugccguccagcucccuggggacccagaccuacaucugcaacgucaaccacaagcccagcaacaccaagguggacaagaagguggagcccaaguccugcgacaagacgcacacgugcccgcccugccccgcccccgagcugcucggcgggcccagcgucuuccuguucccgcccaagcccaaggacacccugaugaucucccgcacccccgaggugaccugcguggucguggacgucagccacgaggacccggaggugaaguucaacugguacguggacggcgucgaggugcacaacgccaagaccaagccccgggaggagcaguacaacuccaccuaccgcguggucagcgugcucaccgugcugcaccaggacuggcugaacgggaaggaguacaagugcaaggucuccaacaaggcgcuccccgcccccaucgagaagacgaucagcaaggccaagggccagccgcgggagccccagguguacacccugccgcccucccgcgacgagcugaccaagaaccaggugagccugaccugccucgucaagggcuucuaccccagcgacaucgccguggagugggaguccaacgggcagcccgagaacaacuacaagacgacgcccccggugcuggacagcgacggcuccuucuuccucuacagcaagcugaccgucgacaagucccgguggcagcaggggaacguguucagcugcuccgugaugcacgaggcccugcacaaccacuacacccagaagucccucagccugagccccggcaag

SEQ ID NO: 8456 - RNA, 657 nt, Artificial Sequence
  derived and/or modified sequence opt1 from Solanezumab_LightChain1
gacguggucaugacccagagcccccugucccucccggugacccugggccagcccgccagcaucuccugccgcagcucccagagccugaucuacuccgacgggaacgccuaccuccacugguuccugcagaagcccggccagagcccccggcugcucaucuacaagguguccaaccgcuucagcggggucccggaccgguucuccggcagcggguccggcacggacuucacccugaagaucagccgcguggaggcggaggacgugggcgucuacuacugcucccagagcacccacgugcccuggaccuucgggcagggcacgaagguggagaucaagcggaccgucgccgcccccuccguguucaucuucccgcccagcgacgagcagcugaaguccgggaccgccagcguggucugccuccugaacaacuucuacccccgcgaggccaaggugcaguggaagguggacaacgcgcugcagagcggcaacucccaggagagcgucaccgagcaggacuccaaggacagcacguacucccucagcuccacccugacccugagcaaggccgacuacgagaagcacaagguguacgccugcgaggugacccaccaggggcucuccagccccgucacgaaguccuucaaccggggcgagugc

SEQ ID NO: 8457 - RNA, 1506 nt, Artificial Sequence
  derived and/or modified sequence opt1 from Solitomab_HeavyChain1
gagcuggugaugacccagagccccuccagccucaccgucacggccggcgagaaggugaccauguccugcaagagcucccagagccugcugaacuccgggaaccagaagaacuaccucaccugguaccagcagaagccgggccagccgcccaagcugcugaucuacugggccagcacccgcgaguccggggugcccgaccgguucacgggcagcggguccggcaccgacuucacccucaccaucagcuccguccaggcggaggaccuggccguguacuacugccagaacgacuacagcuacccccugacguucggcgccgggaccaagcucgagaucaagggcgggggcggguccggcggcgggggcagcgggggcggcggguccgaggugcagcugcuggagcagagcggcgccgagcucguccgccccgggaccuccgugaagaucagcugcaaggccagcggcuacgcguucaccaacuacuggcuggggugggugaagcagcggcccggccacggccuggaguggaucggggacaucuuccccggcuccgggaacauccacuacaacgagaaguucaagggcaaggccacgcucaccgccgacaagagcuccagcaccgccuacaugcagcuguccagccugaccuucgaggacuccgcggucuacuucugcgcccgccuccggaacugggacgagccgauggacuacugggggcagggcacgaccgugaccgugagcuccggcgggggcgggagcgacguccagcuggugcaguccggcgccgaggugaagaagcccggggccagcgucaagguguccugcaaggccagcggcuacaccuucacgcgcuacaccaugcacugggugcggcaggcgcccggccaggggcuggaguggaucggcuacaucaaccccucccgcggguacaccaacuacgccgacagcgucaagggccgguucaccaucacgaccgacaaguccaccagcaccgccuacauggagcucuccagccugcgcagcgaggacacggccaccuacuacugcgcccgguacuacgacgaccacuacugccuggacuacuggggccaggggaccaccgugacgguguccagcggcgaggggaccuccaccggcagcgggggcuccggcgggagcggcggggcggacgacaucguccucacccaguccccggccacgcugagccugucccccggcgagcgcgccacccucagcugccgggccucccagagcguguccuacaugaacugguaccagcagaagcccgggaaggcccccaagcgcuggaucuacgacaccagcaagguggcguccggcgucccggcccgguucagcggcuccgggagcggcaccgacuacagccugaccaucaacucccuggaggccgaggacgccgccacguacuacugccagcaguggagcuccaacccccucaccuucgggggcgggaccaagguggagaucaagcaccaccaccaccaccac

SEQ ID NO: 8458 - RNA, 1506 nt, Artificial Sequence; identical to SEQ ID NO: 8457
  derived and/or modified sequence opt1 from Solitomab_SingleChain

SEQ ID NO: 8459 - RNA, 702 nt, Artificial Sequence
  derived and/or modified sequence opt1 from Sonepcizumab_LightChain_Precursor
augagcgugcccacccagguccugggccuccugcugcucuggcugaccgacgcccgcugcgagacgaccgugacccaguccccgagcuuccuguccgccagcgugggggaccgggucaccaucacgugcaucaccaccaccgacaucgacgacgacaugaacugguuccagcaggagcccggcaaggcgcccaagcuccugaucuccgaggggaacauccugcgccccggcgugccgagccgguucuccagcuccggguacggcacggacuucacccucaccaucagcaagcugcagcccgaggacuucgccaccuacuacugccugcaguccgacaaccuccccuucacguucggccaggggaccaagcuggagaucaagcgcaccguggccgcccccagcgucuucaucuucccgcccuccgacgagcagcucaagagcggcaccgccuccguggugugccugcugaacaacuucuacccccgggaggcgaagguccaguggaagguggacaacgcccugcagagcgggaacucccaggagagcgugacggagcaggacuccaaggacagcaccuacagccucuccagcacccugacccuguccaaggccgacuacgagaagcacaaggucuacgccugcgaggugacgcaccagggccucagcucccccgugaccaagagcuucaaccgcggggagugc

SEQ ID NO: 8460 - RNA, 1365 nt, Artificial Sequence
  derived and/or modified sequence opt1 from Sonepcizumab_gamma1-Chain_Precursor
auggaguggagcuggguguuccuguucuuccucuccgucaccaccggcgugcacagcgaggugcagcugguccaguccggggccgaggugaagaagcccggcgagagccugaagaucuccugccagagcuucggguacaucuucaucgaccacacgauccacuggaugcgccagaugccgggccaggggcucgaguggaugggcgccaucagcccccggcacgacaucaccaaguacaacgagauguuccgcggccaggugaccaucuccgcggacaaguccagcuccaccgccuaccugcaguggagcucccugaaggccagcgacacggccauguacuucugcgcccgcgggggcuucuacggguccaccaucugguucgacuucuggggccaggggaccauggucaccgugagcuccgcgagcacgaagggccccuccguguucccccucgccccgagcagcaaguccaccagcggcgggaccgccgcccugggcugccuggucaaggacuacuuccccgagcccgugaccguguccuggaacagcggggcgcucacguccggcguccacaccuuccccgccgugcugcagagcuccggccuguacagccucuccagcguggucaccgugccguccagcucccuggggacccagacguacaucugcaacgugaaccacaagcccagcaacaccaaggucgacaagcggguggcccccgagcugcucggcgggcccuccguguuccuguucccgcccaagcccaaggacacccugaugaucagccggacccccgaggucacgugcgugguggucgacgugucccacgaggacccggaggucaaguucaacugguacguggacggcguggagguccacaacgccaagaccaagccccgcgaggagcaguacaacagcaccuaccgggugguguccguccucaccgugcugcaccaggacuggcugaacgggaaggaguacaagugcaaggugagcaacaaggcccuccccgcgcccaucgagaagacgaucagcaaggccaagggccagccgcgcgagccccaggucuacacccugccgcccucccgggaggagaugaccaagaaccaggugagccugaccugccucgugaagggcuucuaccccuccgacaucgccgucgagugggagagcaacgggcagcccgagaacaacuacaagacgaccccgcccgugcuggacuccgacggcagcuucuuccuguacuccaagcucaccguggacaagagccgcuggcagcaggggaacgucuucuccugcagcgugaugcacgaggcccugcacaaccacuacacccagaagucccugagccucucccccggcaag

SEQ ID NO: 8461 - RNA, 1338 nt, Artificial Sequence
  derived and/or modified sequence opt1 from Stamulumab_HeavyChain1
gugcagcugguccagagcggcgccgaggugaagaagcccggggccuccgugaaggucagcugcaaggcguccggcuacaccuucaccagcuacuacaugcacugggugcgccaggccccggggcagggccucgaguggauggggaucaucaaccccuccggcggcagcacguccuacgcccagaaguuccaggggcgggugaccaugacccgcgacaccagcacguccaccgucuacauggagcugagcucccugcggagcgaggacaccgccguguacuacugcgcccgcgacgagaacuggggcuucgaccccugggggcagggcacccucgugacggucuccagcgcguccaccaaggggcccagcguguucccgcuggcccccuccagcaaguccaccagcggcggcaccgccgcccuggggugccucgugaaggacuacuuccccgagcccgucacggugagcuggaacuccggcgcgcugaccagcggggugcacaccuucccggccguccugcaguccagcggccucuacucccugagcuccguggugaccguccccagcuccagccugggcacgcagaccuacaucugcaacgugaaccacaagcccuccaacaccaagguggacaagaaggucgagcccaagagcugcgacaagacccacacgugcccgcccugccccgcccccgagcuccucgggggcccguccguguuccuguucccgcccaagcccaaggacacccucaugaucagccggacccccgaggugaccugcgucguggucgacgugucccacgaggaccccgaggugaaguucaacugguacgucgacgggguggaggugcacaacgccaagacgaagccccgcgaggagcaguacaacagcaccuaccgggucguguccgugcugaccguccugcaccaggacuggcucaacggcaaggaguacaagugcaaggugagcaacaaggcccugcccgcgccgaucgagaagaccaucuccaaggccaaggggcagccccgcgagccccagguguacacgcugcccccgagccgggaggagaugaccaagaaccaggucagccugaccugccuggugaagggcuucuaccccuccgacaucgccguggagugggagagcaacggccagcccgagaacaacuacaagaccacgccgcccguccuggacuccgacgggagcuucuuccucuacuccaagcugaccguggacaagagccgcuggcagcagggcaacguguucuccugcagcgucaugcacgaggcccugcacaaccacuacacccagaagucccucagccugucccccgggaag

SEQ ID NO: 8462 - RNA, 633 nt, Artificial Sequence
  derived and/or modified sequence opt1 from Stamulumab_LightChain1
agcuacgagcugacccagcccccguccgugagcgucucccccggccagaccgccagcaucacgugcuccgggcacgcccucggcgacaaguucgugagcugguaccagcagaagcccgggcagucccccgugcuggucaucuacgacgacacccagcgcccgagcggcauccccgagcgguucuccgggagcaacuccggcaacaccgcgacccugacgaucagcggcacccaggccauggacgaggccgacuacuacugccaggccugggacuccagcuucguguucgggggcgggaccaaggugaccguccucggccagcccaaggccgcgcccuccgugacgcuguucccgcccagcuccgaggagcugcaggccaacaaggccacccucgugugccugaucagcgacuucuaccccggggccgucaccguggcguggaaggccgacuccagccccgugaaggccggcgucgagaccacgaccccgagcaagcaguccaacaacaaguacgccgccagcuccuaccugagccucacccccgagcaguggaagucccaccgcagcuacuccugccaggugacccacgagggcagcacgguggagaagaccgucgcgcccaccgagugcucc

SEQ ID NO: 8463 - RNA, 1356 nt, Artificial Sequence
  derived and/or modified sequence opt1 from Suptavumab_HeavyChain1
gaggugcagcuggucgagagcggcggggaccucgugcagcccggccgcucccugcggcugagcugcguggccuccggguucaccuucgacgacuacgccaugcacuggguccgccaggcgccgggcaaggggcucgagugggugagcggcguguccuggagcggcuccaccgucggguacgccgacagcgugaagggccgguucacggugucccgcgacaacgcccagaagucccuguaccugcagaugaacagccuccgggccgaggacaccgcccuguacuacugcgucaaggacgcguacaaguucaacuacuacuacuacgggcuggacguguggggccaggggaccaccgugacggucagcuccgccagcaccaagggccccuccguguucccccucgcccccagcuccaagagcaccuccggcgggaccgccgcgcugggcugccuggugaaggacuacuucccggagcccgucacggugagcuggaacagcggggcccucaccuccggcgugcacaccuuccccgccguccugcagagcuccggccuguacagccucuccagcguggugaccguccccuccagcucccuggggacgcagaccuacaucugcaacgugaaccacaagccgagcaacaccaagguggacaagaaggucgagcccaaguccugcgacaagacccacacgugcccgcccugcccggcccccgagcugcucggcgggcccagcguguuccuguucccgcccaagcccaaggacacccugaugaucucccgcacccccgaggugaccugcgucguggucgacgugagccacgaggaccccgaggugaaguucaacugguacgucgacggcguggaggugcacaacgccaagacgaagccgcgggaggagcaguacaacuccaccuaccgcgucgugagcgugcucaccguccugcaccaggacuggcugaacgggaaggaguacaagugcaagguguccaacaaggcgcuccccgcccccaucgagaagaccaucagcaaggccaagggccagccccgggagccccagguguacacgcugccgcccucccgcgacgagcugaccaagaaccaggucagccugaccugccucgugaagggcuucuaccccagcgacaucgccguggagugggaguccaacgggcagcccgagaacaacuacaagaccacgccgcccguccuggacagcgacggcuccuucuuccucuacagcaagcugaccguggacaagucccgguggcagcaggggaacguguucagcugcuccgucaugcacgaggcccugcacaaccacuacacccagaagucccucagccugagccccggc

SEQ ID NO: 8464 - RNA, 642 nt, Artificial Sequence
  derived and/or modified sequence opt1 from Suptavumab_LightChain1
gagaucgugaugacccagagccccgccacccuguccgucagcccgggcgagcgcgccacgcucuccugccgggcgagccagaccauccuguccaaccuggccugguaccuccagaagcccgggcaggcgccccgccugcugaucuacggcgccagcacccgggccaccgggcuccccgcccgcuucuccggcagcggguccggcacggaguucacccugaccaucagcucccugcagagcgaggacuucgccguguacuacugccagcaguacaacaacuggccgcucaccuucggcgggggcacgaagguggagaucaagcggaccgucgccgcccccuccguguucaucuucccgcccagcgacgagcagcugaaguccgggaccgcgagcguggucugccugcucaacaacuucuacccccgcgaggccaaggugcaguggaagguggacaacgcccugcaguccggcaacagccaggaguccgucaccgagcaggacagcaaggacagcacguacucccugagcuccacccucacccugagcaaggccgacuacgagaagcacaagguguacgccugcgaggugacccaccaggggcuguccagccccgucacgaaguccuucaaccggggcgagugc

SEQ ID NO: 8465 - RNA, 1344 nt, Artificial Sequence
  derived and/or modified sequence opt1 from Suvizumab_HeavyChain1
caggugcagcugguccagagcggcgccgaggugaagaagcccggggccuccgugaaggucagcugcaaggcguccggcuacaccuucaccaacagcuggaucgggugguuccgccaggccccgggccaggggcucgaguggaucggcgacaucuaccccggcgggggcuacacgaacuacaacgagaucuucaaggggaaggccaccaugaccgccgacaccuccacgaacaccgccuacauggagcugagcucccugcggagcgaggacaccgcgguguacuacugcucccgcggcauccccggguacgccauggacuacuggggccagggcacccucgugacggucagcuccgccagcaccaaggggcccuccguguucccgcuggcccccagcuccaagagcaccuccggcgggaccgcggcccugggcugccucgugaaggacuacuuccccgagcccgucacggugagcuggaacuccggcgcccugaccagcggggugcacaccuucccggccguccugcagagcuccggccucuacagccuguccagcguggugaccguccccuccagcucccuggggacgcagaccuacaucugcaacgugaaccacaagcccagcaacaccaagguggacaagaaggucgagcccaaguccugcgacaagacccacacgugcccgcccugccccgcccccgagcuccugggcgggccgagcguguuccuguucccgcccaagcccaaggacacccucaugaucucccggacccccgaggugaccugcgucgugguggacgucagccacgaggaccccgaggugaaguucaacugguacgucgacggcguggaggugcacaacgcgaagacgaagccccgcgaggagcaguacaacuccaccuaccgggucgugagcgugcugaccguccugcaccaggacuggcucaacggcaaggaguacaagugcaagguguccaacaaggcccugcccgccccgaucgagaagaccaucagcaaggccaaggggcagccccgcgagccccagguguacacgcugcccccgucccgggacgagcucaccaagaaccaggucagccugaccugccuggugaagggcuucuaccccuccgacaucgccguggagugggagagcaacgggcagcccgagaacaacuacaagaccacgccgcccguccucgacagcgacggcuccuucuuccuguacagcaagcugaccguggacaagucccgcuggcagcaggggaacguguucagcugcuccgucaugcacgaggcgcuccacaaccacuacacccagaagucccugagccugagccccggcaag

SEQ ID NO: 8466 - RNA, 660 nt, Artificial Sequence
  derived and/or modified sequence opt1 from Suvizumab_LightChain1
gacauccagaugacccagcgccccgacagccuguccgccagcgugggcgaccgggucaccauguccugcaagagcucccagagccuccugaacuccggggaccagaagaacuaccugacgugguaccagcagaagccgggccagccgcccaagcuccugaucuacugggccagcaccggggaguccggcgugcccgaccgcuucagcggguccggcagcggcaccgacuucaccuucacgaucuccagccugcagcccgaggacaucgcgaccuacuacugccagaacgacuacuccuaccccuggaccuucgggcagggcaccaagguggagaucaagcggacggucgccgcccccagcguguucaucuucccgcccuccgacgagcagcucaagagcgggaccgccuccguggucugccugcugaacaacuucuacccccgcgaggccaaggugcaguggaagguggacaacgcgcuccagagcggcaacagccaggaguccgucaccgagcaggacagcaaggacuccaccuacagccuguccagcacgcugacccucuccaaggccgacuacgagaagcacaagguguacgccugcgaggugacccaccaggggcugagcucccccgucaccaagagcuucaaccggggcgagugc

SEQ ID NO: 8467 - RNA, 1350 nt, Artificial Sequence
  derived and/or modified sequence opt1 from Tabalumab_HeavyChain1
caggugcagcugcagcaguggggcgccgggcuccugaagcccagcgagacccugucccugaccugcgccgucuacggcgggagcuucuccggcuacuacuggagcuggauccgccagccgcccgggaagggccuggaguggaucggcgagaucaaccacuccgggagcacgaacuacaaccccucccucaagagccgggugaccaucuccguggacaccagcaagaaccaguucucccucaagcugagcuccgucaccgcggccgacacggccguguacuacugcgcccgcggcuacuacgacauccugaccggguacuacuacuacuucgacuacuggggccaggggacccucgugaccgucagcuccgccagcacgaagggccccuccguguucccgcuggcgcccugcagccgguccaccagcgagagcaccgccgcccugggcugccucgugaaggacuacuuccccgagcccgucaccguguccuggaacagcggggcccugacguccggcgugcacaccuucccggcgguccugcagagcuccgggcucuacagccuguccagcguggugaccguccccuccagcucccugggcaccaagacguacacgugcaacguggaccacaagcccagcaacaccaagguggacaagcgcgucgaguccaaguacgggcccccgugcccgcccugccccgcccccgaguuccucggcggccccagcguguuccuguucccgcccaagcccaaggacacccugaugaucucccggacccccgaggugaccugcgucgugguggacgucagccaggaggaccccgaggugcaguucaacugguacgucgacgggguggaggugcacaacgccaagaccaagccccgcgaggagcaguucaacuccaccuaccgggucgugagcgugcucacgguccugcaccaggacuggcugaacggcaaggaguacaagugcaagguguccaacaaggggcucccgagcagcaucgagaagaccaucuccaaggccaagggccagccccgcgagccccagguguacacccugcccccgagccaggaggagaugaccaagaaccaggucucccugacgugccucgugaagggcuucuaccccagcgacaucgccguggagugggaguccaacgggcagcccgagaacaacuacaagaccaccccgcccguccuggacagcgacggcuccuucuuccuguacagccggcucaccguggacaagucccgcuggcaggaggggaacguguucagcugcuccgucaugcacgaggcgcugcacaaccacuacacgcagaagucccugagccucagccugggcaag

SEQ ID NO: 8468 - RNA, 642 nt, Artificial Sequence
  derived and/or modified sequence opt1 from Tabalumab_LightChain1
gagaucgugcugacccagagccccgccacccucucccugagcccgggcgagcgcgccacgcuguccugccgggcgagccaguccgucagccgcuaccucgccugguaccagcagaagcccgggcaggcgccccggcugcugaucuacgacgccuccaaccgcgccaccggcauccccgcccgguucagcggguccggcagcgggaccgacuccacccucacgaucagcucccuggagccggaggacuucgccguguacuacugccagcagcgcagcaacuggccccggaccuucggccagggcaccaagguggagaucaagcgcaccgucgccgcccccuccguguucaucuucccgcccagcgacgagcagcugaaguccgggacggcgagcguggucugccuccugaacaacuucuacccccgggaggccaaggugcaguggaagguggacaacgcccugcaguccggcaacagccaggagagcgucaccgagcaggacuccaaggacagcaccuacucccucagcaacacccugacgcuguccaaggccgacuacgagaagcacaagguguacgccugcgaggugacccaccaggggcucagcucccccgucaccaagagcuucaaccgcggcgagugc

SEQ ID NO: 8469 - RNA, 1332 nt, Artificial Sequence
  derived and/or modified sequence opt1 from Tacatuzuab_HeavyChain1
caggugcagcugcagcagagcggcgccgaggucaagaagcccggguccagcgugaagguguccugcaaggccagcggcuacgcguucaccuccuacgucauccacugggugcgccaggccccggggcagggccucuacuggaucggguacauccaccccuacaacggcggcaccaaguacaacgagaaguucaaggggaaggccacgaucaccgccgacgagagcaccaacaccgccuacgagcuguccagccugcgguccgaggacacggcguucuacuucugcgcccgcagcggcgggggcgaccccuucgccuacugggggcagggcucccucgugaccgucagcuccgccagcaccaagggccccuccguguucccgcuggcgcccagcuccaagagcaccuccgggggcacggccgcccuggggugccucgugaaggacuacuuccccgagcccgucaccgugagcuggaacagcggcgcccugaccuccggcgugcacaccuucccggccguccugcagagcuccgggcucuacagccuguccagcguggugacgguccccuccagcucccugggcacccagaccuacaucugcaacgugaaccacaagcccagcaacaccaagguggacaagcgggucgagcccaaguccugcgacaagacgcacacgugcccgcccugccccgcgcccgagcuccucgggggcccgagcguguuccuguucccgcccaagcccaaggacacccucaucucccgcacccccgaggugaccugcgucgugguggacgucagccacgaggaccccgaggugaaguucaacugguacgucgacgggguggaggugcacaacgccaagaccaagccccgggaggagcaguacaacuccaccuaccgcgucgugagcgugcugaccguccugcaccaggacuggcucaacggcaaggaguacaagugcaagguguccaacaaggcccugcccgccccgaucgagaagacgaucagcaaggccaagggccagccccgggagccccagguguacacccugcccccgucccgcgaggagaccaagaaccaggucagccugaccugccuggugaagggguucuaccccagcgacaucgcgguggagugggaguccaacggccagcccgagaacaacuacaagacgaccccgcccguccuggacagcgacggguccuucuuccucuacagcaagcugaccguggacaagucccgguggcagcagggcaacguguucagcugcuccguccacgaggcccugcacaaccacuacacccagaagucccucagccugagccccgggaag

SEQ ID NO: 8470 - RNA, 636 nt, Artificial Sequence
  derived and/or modified sequence opt1 from Tacatuzuab_LightChain1
gacauccagcugacccagagccccuccagccucuccgccagcgugggcgaccgcgucaccaucacgugcaaggccucccaggacaucaacaaguacaucgggugguaccagcagaagccgggcaaggcgcccaagcugcugcacuacaccagcgcccuccugcccgggauccccucccgguucagcggcuccgggagcggccgcgacuacaccuucaccaucuccagccugcagccggaggacaucgccacguacuacugccuccaguacgacgaccuguggaccuucggcgggggcaccaagcugcagaucaagcggaccguggccgcccccuccguguucaucuucccgcccagcgacgagcagcucaaguccgggacggcgagcgucgugugccugcugaacaacuucuacccccgcgaggccaaggugcaguggaaggucgacaacgcccuccaguccggcaacagccaggaguccgugaccgagcaggacagcaaggacagcaccuacucccugagcuccacccugacgcucagcaaggccgacuacgagaagcacaagguguacgcgugcgaggucacccaccaggggcuguccagccccgugaccaaguccuucaaccggggcgagugc

SEQ ID NO: 8471 - RNA, 678 nt, Artificial Sequence
  derived and/or modified sequence opt1 from Tadocizumab_fab_fragment_HeavyChain
caggugcagcugguccagagcggcgccgaggugaagaagcccggguccagcgugaaggucuccugcaaggccagcggcuacgcguucaccaacuaccucaucgagugggugcgccaggccccggggcagggccuggaguggaucggggugaucuaccccggcuccggcgggaccaacuacaacgagaaguucaagggccgggucacgcugaccguggacgagagcaccaacaccgccuacauggagcucuccagccugcgcuccgaggacacggccguguacuucugcgcccggcgcgacgggaacuacggcugguucgcguacugggggcagggcacccuggucaccgugagcuccgccagcaccaagggccccuccguguucccccucgccccgagcuccaagagcacguccgggggcaccgccgcgcuggggugccuggucaaggacuacuuccccgagcccgugaccgugagcuggaacuccggcgcccucaccagcggcguccacacguuccccgccgugcugcagagcuccgggcuguacagccucuccagcguggucaccgugccguccagcucccugggcacccagaccuacaucugcaacgugaaccacaagcccagcaacacgaaggucgacaagaagguggagcccaaguccugcgacaagacccac

SEQ ID NO: 8472 - RNA, 582 nt, Artificial Sequence
  derived and/or modified sequence opt1 from Tadocizumab_fab_fragment_LightChain
gacauccagaugacccagacccccagcacgcuguccgccagcgugggcgaccgcgucaccaucuccugccgggccagccaggacaucaacaacuaccucaacugguaccagcagaagccggggaaggcgcccaagcugcugaucuacuacaccuccacccuccacagcggcgugcccucccgcuucagcggguccggcagcgggacggacuacacccugaccaucuccagccugcagcccgacgacuucgccaccuacuucugccagcagggcaacacgcucccguggaccuucggccaggggaccaagguggaggucaagcggaccguggccgcccccuccguguucaucuucccgcccagcgacgagcagcugaaguccggcacggccagcgucgugugccugcucaacaacuucuacgaguccgugaccgagcaggacagcaaggacuccaccuacagccugagcuccacccugacgcucagcaaggcggacuacgagaagcacaaggucuacgccugcgaggugacccaccaggggcuguccagccccgugaccaaguccuucaaccgcggcgagugc

SEQ ID NO: 8473 - RNA, 1359 nt, Artificial Sequence
  derived and/or modified sequence opt1 from Talizumab_HeavyChain1
caggugcagcugguccagagcggcgccgaggugaagaagcccggggccuccgugaaggucagcugcaaggcguccggcuacaccuucagcauguacuggcucgagugggugcgccaggccccggggcacggccuggagugggugggggagaucucccccggcaccuucaccaccaacuacaacgagaaguucaaggcccgggccaccuucaccgccgacacgagcaccaacaccgcguacauggagcuguccagccuccgcuccgaggacaccgccgucuacuacugcgcccgguucagccacuucuccggcagcaacuacgacuacuucgacuacugggggcagggcacgcuggugaccguguccagcgccuccaccaaggggcccagcgucuucccccuggcgccguccagcaaguccaccagcggcgggacggccgcccucggcugccuggugaaggacuacuuccccgagcccgugaccgucagcuggaacuccggcgcccugaccagcggggugcacaccuuccccgccgugcuccaguccagcggccuguacucccugagcuccgucgugacggugccgagcuccagccucgggacccagaccuacaucugcaacgucaaccacaagcccuccaacaccaagguggacaagaagguggagcccaagagcugcgacaagacgcacacgugcccgcccugccccgcgcccgagcugcugggcggccccuccgucuuccucuucccgcccaagcccaaggacacccugaugaucagccgcacccccgaggugaccugcguggucguggacgucucccacgaggacccggaggugaaguucaacugguacguggacggggucgaggugcacaacgccaagaccaagccccgggaggagcaguacaacagcaccuaccgcguggucuccgugcugaccgugcuccaccaggacuggcugaacggcaaggaguacaagugcaaggucagcaacaaggcccugcccgcccccaucgagaagacgaucuccaaggccaaggggcagccgcgggagccccagguguacacccucccgcccagccgcgacgagcugaccaagaaccaggugagccugaccugccucgucaagggcuucuaccccuccgacaucgcgguggagugggagagcaacgggcagcccgagaacaacuacaagacgacgcccccggugcuggacuccgacggcagcuucuuccuguacuccaagcucaccgucgacaagagccgguggcagcagggcaacguguucuccugcagcgugaugcacgaggcccugcacaaccacuacacccagaagucccugagccucucccccgggaag

SEQ ID NO: 8474 - RNA, 642 nt, Artificial Sequence
  derived and/or modified sequence opt1 from Talizumab_LightChain1
gacauccugcucacccagagccccggcacccugucccugagcccgggggagcgcgccacgcucuccugccgggccagccaguccaucggcaccaacauccacugguaccagcagaagcccgggcaggcgccccgccugcugaucaaguacgccagcgaguccaucagcggcauccccucccgguucagcggguccggcagcggcaccgacuucacccucacgaucucccgccuggagccggaggacuucgccauguacuacugccagcagagcgacuccuggcccaccaccuucgggcagggcaccaagguggagaucaagcggacggucgccgcccccagcguguucaucuucccgcccuccgacgagcagcucaagagcgggaccgcguccguggucugccugcugaacaacuucuacccccgcgaggccaaggugcaguggaagguggacaacgcccugcagagcggcaacagccaggaguccgucaccgagcaggacagcaaggacuccaccuacagccucuccagcacgcugacccuguccaaggccgacuacgagaagcacaagguguacgcgugcgaggugacccaccaggggcucagcucccccgucaccaagagcuucaaccggggcgagugc

SEQ ID NO: 8475 - RNA, 1368 nt, Artificial Sequence
  derived and/or modified sequence opt1 from Tamtuvetmab_HeavyChain1
gaggugaagcugcucgagagcggcgggggccugguccagcccgggggcuccaugcgccugagcugcgccggguccggcuucaccuucaccgacuucuacaugaacuggauccggcagcccgccggcaaggcgcccgaguggcucggguucauccgcgacaaggccaagggcuacacgaccgaguacaaccccagcgugaaggggcgguucaccaucucccgcgacaacacccagaacaugcuguaccugcagaugaacacgcuccgggccgaggacaccgccaccuacuacugcgcccgcgagggccacaccgcggcccccuucgacuacugggggcagggcacgcuggugaccgucagcuccgccagcaccaccgccccguccguguucccccuggcgcccagcugcggcuccacgagcggguccaccguggcccucgccugccuggucagcggcuacuuccccgagccggugaccguguccuggaacagcgggucccugaccagcggcguccacacguuccccuccgugcuccagagcagcggccuguacucccugagcuccauggugaccguccccagcucccgguggcccagcgagaccuucacgugcaacguggcccacccggccuccaagaccaagguggacaagcccguccccaagcgcgagaacgggcgggugccccgcccgcccgacugccccaagugccccgcgccggagaugcucggcgggcccagcguguucaucuucccgcccaagcccaaggacacccugcugaucgcccggacccccgaggugaccugcgucguggucgaccucgaccccgaggaccccgaggugcagaucuccugguucguggacggcaagcagaugcagacggccaagacccagccgcgcgaggagcaguucaacgggaccuaccgggucgugagcguccugcccaucggccaccaggacuggcugaagggcaagcaguucacgugcaaggugaacaacaaggcccuccccuccccgaucgagcgcaccaucagcaaggcccgggggcaggcgcaccagcccuccguguacguccugccgcccagccgcgaggagcuguccaagaacaccgugagccugaccugccucaucaaggacuucuucccgcccgacaucgacguggaguggcaguccaacggccagcaggagcccgagagcaaguaccggaccacgccgccccagcuggacgaggacggguccuacuuccucuacagcaagcugagcgucgacaagucccgcuggcagcggggcgacaccuucaucugcgccgugaugcacgaggcccugcacaaccacuacacccagaagucccucagccacagccccgggaag

SEQ ID NO: 8476 - RNA, 639 nt, Artificial Sequence
  derived and/or modified sequence opt1 from Tamtuvetmab_LightChain1
gacaucaagaugacccagagccccuccuuccugagcgccuccgugggcgaccgcgucacccucaacugcaaggccagccagaacaucgacaaguaccugaacugguaccagcagaagcugggggaguccccgaagcuccugaucuacaacacgaacaaccugcagaccggcauccccagccgguucuccgggagcggcuccgggaccgacuucacccucacgaucagcucccugcagcccgaggacguggcgaccuacuucugccugcagcacaucagccgcccccggaccuucggcggcgggacccaccucacggugcugggccagccgaaggccucccccagcgucacccuguucccgcccuccagcgaggagcucggggccaacaaggccacccuggugugccugaucuccgacuucuaccccagcggcgugaccgucgccuggaaggcggacgggucccccaucacgcagggcguggagaccaccaagcccagcaagcagagcaacaacaaguacgccgccuccagcuaccucucccugacccccgacaaguggaagucccacagcagcuucuccugccuggugacgcacgagggcagcaccgucgagaagaagguggccccggcggagugcucc

SEQ ID NO: 8477 - RNA, 360 nt, Artificial Sequence
  derived and/or modified sequence opt1 from Tanezumab_HeavyChain
caggugcagcugcaggagagcggccccgggcucgucaagcccuccgagacccugagccugaccugcacgguguccggcuucagccucaucggguacgaccugaacuggauccgccagccgcccggcaaggggcuggaguggaucggcaucaucuggggcgacgggaccaccgacuacaacuccgccgucaagagccgggugaccaucuccaaggacacgagcaagaaccaguucucccucaagcugagcuccgugaccgccgcggacaccgccguguacuacugcgcccgcggcggguacugguacgccaccagcuacuacuucgacuacuggggccaggggacgcuggucaccgugucc

SEQ ID NO: 8478 - RNA, 327 nt, Artificial Sequence
  derived and/or modified sequence opt1 from Tanezumab_LightChain
gacauccagaugacccagagccccuccagccuguccgccagcgugggcgaccgcgucaccaucacgugccgggccucccagagcaucuccaacaaccucaacugguaccagcagaagccggggaaggcgcccaagcugcugaucuacuacaccagccgcuuccacuccggcgugcccagccgguucuccgggagcggcuccgggaccgacuucaccuucacgaucagcucccuccagcccgaggacaucgccaccuacuacugccagcaggagcacacccugccguacaccuucggccagggcacgaagcuggagaucaagcgcacc

SEQ ID NO: 8479 - RNA, 1323 nt, Artificial Sequence
  derived and/or modified sequence opt1 from Tarextumab_HeavyChain1
gaggugcagcuggucgagagcggcgggggccucgugcagcccgggggcucccugcgccugagcugcgccgccuccggguucaccuucagcuccagcggcauguccugggugcggcaggcgccgggcaaggggcucgagugggucagcgugaucgccuccagcggcuccaacaccuacuacgccgacagcgugaaggggcgcuucacgaucucccgggacaacagcaagaacacccuguaccugcagaugaacucccuccgcgccgaggacaccgccgucuacuacugcgcgcggagcaucuucuacaccacguggggccaggggacccuggugaccguguccagcgccuccaccaagggccccagcgucuucccccuggcccccugcagccgcuccacgagcgaguccaccgccgcgcucggcugccuggugaaggacuacuucccggagcccgugaccgucagcuggaacuccggggcccugaccagcggcgugcacacguuccccgccgugcuccaguccagcgggcuguacucccugagcuccgucgugaccgugcccagcuccaacuucggcacccagaccuacacgugcaacgucgaccacaagccgagcaacaccaagguggacaagaccguggagcggaagugcugcgucgagugcccgcccugccccgccccgcccguggccggccccuccguguuccucuucccgcccaagcccaaggacacccugaugaucagccgcacgcccgaggugaccugcgucgucguggacgugucccacgaggaccccgagguccaguucaacugguacguggacgggguggagguccacaacgcgaagaccaagccgcgggaggagcaguucaacagcaccuuccgcgugguguccguccugacgguggugcaccaggacuggcucaacggcaaggaguacaagugcaaggucagcaacaaggggcugcccgcccccaucgagaagaccaucagcaagaccaagggccagccccgggagccccagguguacacccugccgcccucccgcgaggagaugacgaagaaccaggugagccugaccugccucgucaagggguucuaccccuccgacaucgccguggagugggagagcaacggccagcccgagaacaacuacaagaccaccccgcccaugcuggacuccgacggcagcuucuuccucuacuccaagcugacgguggacaagagccgguggcagcaggggaacgucuucuccugcagcgugaugcacgaggcccugcacaaccacuacacccagaagucccucagccugucccccggcaag

SEQ ID NO: 8480 - RNA, 645 nt, Artificial Sequence
  derived and/or modified sequence opt1 from Tarextumab_LightChain1
gacaucgugcugacccagagccccgccacccucucccugagcccgggcgagcgcgccacgcuguccugccgggcgagccaguccguccgcagcaacuaccucgccugguaccagcagaagcccgggcaggcgccccggcugcugaucuacggcgccuccagccgcgccaccggggugcccgcccgguucuccggcagcggguccggcaccgacuucacccucacgaucagcucccuggagccggaggacuucgccguguacuacugccagcaguacagcaacuuccccaucaccuucggccaggggaccaaggucgagaucaagcgcaccguggccgcccccuccguguucaucuucccgcccagcgacgagcagcugaaguccggcacggcgagcgucgugugccuccugaacaacuucuacccccgggaggccaaggugcaguggaaggucgacaacgcccugcaguccgggaacagccaggagagcgugaccgagcaggacuccaaggacagcaccuacucccucagcuccacccugacgcugagcaaggccgacuacgagaagcacaagguguacgccugcgaggucacccaccagggccucuccagccccgugaccaaguccuucaaccgcggggagugc

SEQ ID NO: 8481 - RNA, 363 nt, Artificial Sequence
  derived and/or modified sequence opt1 from Tefibazumab_HeavyChain1
caggugcagcugaaggagagcggccccgggcucgucaagcccucccagacccugagcaucacgugcaccaucuccggcuucagccugucccgcuacagcgugcacugggugcggcagccgcccgggaagggccucgaguggcuggggaugaucuggggcggcgggaacaccgacuacaacuccgcccucaagagccgccuguccaucagcaaggacaacuccaagaaccaggucuuccugaagaugaacagccugaccgccgcggacaccgccguguacuacugcgcccggaagggcgaguucuacuacggguacgacggcuucguguacugggggcagggcacgcucgucaccguguccagc

SEQ ID NO: 8482 - RNA, 336 nt, Artificial Sequence
  derived and/or modified sequence opt1 from Tefibazumab_LightChain1
gacaucgugaugacccagagccccgacucccuggccgucagccucggcgagcgcgugaccaugaacugcaaguccagccaguccgugcuguacagcuccaaccagaagaacuaccuggccugguaccagcagaagccggggcagagccccaagcuccugaucuacugggcguccacgcgggagagcggcguccccgaccgcuucuccgggagcggcuccgggaccgacuucacccugaccaucagcuccgugcaggccgaggaccucgccguguacuacugccaccaguaccugagcuccuacacguucggcggcgggaccaagcuggagaucaag

SEQ ID NO: 8483 - RNA, 1368 nt, Artificial Sequence
  derived and/or modified sequence opt1 from Tenatumomab_HeavyChain1
gagauccagcugcagcagagcggccccgagcucgugaagccgggggccuccgucaaggugagcugcaaggccuccggcuacgcguucaccagcuacaacauguacugggugaagcagucccacggcaagagccuggaguggaucggguacaucgaccccuacaacggggucaccuccuacaaccagaaguucaagggcaaggccacgcugaccguggacaagagcuccagcaccgccuacaugcaccucaacucccugaccagcgaggacuccgccguguacuacugcgcccgcggcgggggcagcaucuacuacgcgauggacuacugggggcagggcacguccgucaccgugagcuccgccaagaccaccccgcccagcguguacccccuggcccccgggugcggcgacacgaccggcuccagcgucacccucgggugccuggugaagggcuacuuccccgagagcgugaccgucacguggaacuccgggagccuguccagcuccgugcacaccuuccccgcccuccugcagagcggccuguacaccauguccagcuccgugaccgucccgagcuccacguggcccagccagaccgugaccugcuccguggcgcaccccgccagcuccaccacggucgacaagaagcucgagcccagcggcccgaucuccaccaucaaccccugcccgcccugcaaggagugccacaagugccccgcccccaaccuggagggcgggcccagcguguucaucuucccgcccaacaucaaggacgugcugaugaucucccucacccccaaggugaccugcgucguggucgacgugagcgaggacgaccccgacguccagaucagcugguucgugaacaacguggagguccacacggcccagacccagacccaccgggaggacuacaacuccaccauccgcguggugagcacgcugcccauccagcaccaggacuggauguccgggaaggaguucaagugcaaggucaacaacaaggaccugccgagccccaucgagcggaccaucuccaagaucaagggccucgugcgcgcgccccagguguacauccugcccccgcccgccgagcagcugagccggaaggacgucucccugaccugccucguggugggguucaaccccggcgacaucagcgucgaguggaccuccaacggccacacggaggagaacuacaaggacaccgccccggugcuggacagcgacggguccuacuucaucuacagcaagcucaacaugaagaccuccaagugggagaagaccgacagcuucuccugcaacgugcgccacgagggccugaagaacuacuaccugaagaagacgaucagccggucccccgggaag

SEQ ID NO: 8484 - RNA, 657 nt, Artificial Sequence
  derived and/or modified sequence opt1 from Tenatumomab_LightChain1
gacaucgugaugacccaggccgcccccagcgucccggugacccccggcgaguccgugagcaucuccugccgcagcuccaagagccugcuccacuccaacgggaacacguaccuguacugguuccugcagcggcccggccagagcccccagcuccugaucuaccgcauguccaaccuggcgagcggggucccggaccgguucuccggcagcggguccggcaccgccuucacccuccgcaucagccggguggaggccgaggacgugggcgucuacuacugcaugcagcaccuggaguacccccugaccuucggggccggcacgaagcucgagcugaagcgcgccgacgcggcccccaccguguccaucuucccgcccagcuccgagcagcugaccagcgggggcgccuccguggucugcuuccucaacaacuucuaccccaaggacaucaacgugaaguggaagaucgacgggagcgagcggcagaacggcgugcugaacagcuggaccgaccaggacuccaaggacagcacguacuccaugagcuccacccugacccucaccaaggacgaguacgagcgccacaacagcuacacgugcgaggccacccacaagaccuccaccagccccaucgucaaguccuucaaccggaacgagugc

SEQ ID NO: 8485 - RNA, 1356 nt, Artificial Sequence
  derived and/or modified sequence opt1 from Teneliximab_HeavyChain1
cagauccagcuggugcagagcggccccgagcucaagaagccgggggagaccguccgcaucuccugcaaggccagcggcuacgccuucaccacgaccgggaugcagugggugcaggagaugcccggcaaggggcugaaguggaucggcuggaucaacacccacuccggcgugcccaaguacgucgaggacuucaaggggcgguucgcguucagccuggagaccuccgccaacacggccuaccuccagaucagcaaccugaagaacgaggacaccgccaccuacuucugcgugcgcuccggcaacgggaacuacgaccuggccuacuucgcguacuggggccaggggacccucgugacggucagcgccgccuccaccaagggccccagcguguucccgcuggcccccuccagcaaguccaccagcggcgggaccgcggcccugggcugccucgugaaggacuacuuccccgagcccgucacgguguccuggaacagcggggcccugaccuccggcgugcacaccuucccggccguccugcagagcuccggccucuacagccugagcuccguggugaccguccccagcuccagccuggggacgcagaccuacaucugcaacgugaaccacaagcccuccaacaccaagguggacaagaaggucgagcccaagagcugcgacaagacccacacgugcccgcccugccccgcccccgagcuccugggcgggccguccguguuccuguucccgcccaagcccaaggacacccucaugaucagccggacccccgaggugaccugcgucgugguggacgucucccacgaggaccccgaggugaaguucaacugguacgucgacggcguggaggugcacaacgcgaagacgaagccccgcgaggagcaguacaacagcaccuaccgggucguguccgugcugaccguccugcaccaggacuggcucaacgggaaggaguacaagugcaaggugagcaacaaggcccugcccgccccgaucgagaagaccaucuccaaggccaagggccagccccgcgagccccagguguacacgcugcccccgagccgggacgagcucaccaagaaccaggucucccugaccugccuggugaagggcuucuaccccagcgacaucgccguggagugggaguccaacgggcagcccgagaacaacuacaagaccacgccgcccguccucgacagcgacggcuccuucuuccuguacagcaagcugaccguggacaagagccgcuggcagcaggggaacguguucuccugcagcgucaugcacgaggcgcuccacaaccacuacacccagaagucccugagccugucccccggcaag

SEQ ID NO: 8486 - RNA, 642 nt, Artificial Sequence
  derived and/or modified sequence opt1 from Teneliximab_LightChain1
gacaucgugcugacccagagccccgccacccucuccgucacgccgggcgaccgcgugagccuguccugccgggccagccaguccaucagcgacuaccugcacugguaccagcagaagucccacgagagcccccgccuccugaucaaguacgcgucccacagcaucuccgggauccccagccgguucuccggcagcggguccggcagcgacuucacccuguccaucaacagcguggagcccgaggacgucgggaucuacuacugccagcacggccacuccuucccguggaccuucggcgggggcaccaagcucgagaucaagcgcacgguggccgcccccagcguguucaucuucccgcccagcgacgagcagcugaaguccgggaccgccagcgucgugugccugcucaacaacuucuacccccgggaggccaaggugcaguggaaggucgacaacgcgcugcaguccggcaacagccaggaguccgugaccgagcaggacagcaaggacuccaccuacagccuguccagcacgcucacccuguccaaggccgacuacgagaagcacaagguguacgccugcgaggucacccaccaggggcugagcucccccgugaccaagagcuucaaccgcggcgagugc

SEQ ID NO: 8487 - RNA, 1347 nt, Artificial Sequence
  derived and/or modified sequence opt1 from Teplizumab_HeavyChain1
caggugcagcugguccagagcggcgggggcguggugcagcccgggcgcucccuccggcugagcugcaaggccuccggcuacaccuucacccgcuacacgaugcacuggguccggcaggcccccgggaagggccuggaguggaucggcuacaucaaccccagccgcggguacaccaacuacaaccagaaggugaaggaccgguucaccaucucccgcgacaacagcaagaacaccgcguuccuccagauggacucccugcggcccgaggacacgggcguguacuucugcgcccgcuacuacgacgaccacuacugccuggacuacugggggcagggcacccccgucaccgugagcuccgccagcaccaaggggccguccguguucccccucgcccccagcuccaagagcacguccggcggcaccgccgcgcuggggugccuggucaaggacuacuuccccgagccggugaccgugagcuggaacuccggcgcccucaccagcgggguccacacguuccccgccgugcugcaguccagcggccuguacagccucuccagcguggucaccgugcccuccagcucccugggcacccagaccuacaucugcaacgugaaccacaagcccagcaacacgaaggucgacaagaagguggagccgaaguccugcgacaagacccacacgugcccgcccugccccgcccccgaggcggccgggggccccagcguguuccuguucccgcccaagcccaaggacacccucaugaucucccggacccccgaggugaccugcgucguggucgacgugagccacgaggaccccgaggucaaguucaacugguacguggacgggguggagguccacaacgccaagaccaagccccgcgaggagcaguacaacuccaccuaccggguggugagcguccugacggugcugcaccaggacuggcucaacggcaaggaguacaagugcaagguguccaacaaggcccugccggcccccaucgagaagaccaucagcaaggcgaaggggcagccccgcgagccccaggucuacacccugccgcccucccgggacgagcucaccaagaaccaggugagccugacgugccuggugaagggcuucuaccccuccgacaucgccgucgagugggagagcaacggccagccggagaacaacuacaagaccaccccgcccgugcucgacuccgacgggagcuucuuccuguacagcaagcugaccguggacaagucccgcuggcagcagggcaacgucuucagcugcuccgugaugcacgaggcccuccacaaccacuacacgcagaagucccugagccugagccccgggaag

SEQ ID NO: 8488 - RNA, 639 nt, Artificial Sequence
  derived and/or modified sequence opt1 from Teplizumab_LightChain1
gacauccagaugacccagagccccuccagccuguccgccagcgugggcgaccgcgucaccaucacgugcuccgccagcuccagcguguccuacaugaacugguaccagcagaccccggggaaggcgcccaagcgguggaucuacgacaccagcaagcucgccuccggcgugcccagccgcuucuccgggagcggcuccgggaccgacuacacguucaccaucagcucccugcagcccgaggacaucgccaccuacuacugccagcaguggagcuccaacccguucaccuucggccagggcacgaagcugcagaucacccggaccgucgccgcccccagcguguucaucuucccgcccagcgacgagcagcucaaguccgggaccgcgagcguggucugccugcugaacaacuucuacccccgcgaggccaaggugcaguggaagguggacaacgcccuccaguccggcaacagccaggaguccgucacggagcaggacagcaaggacuccaccuacagccuguccagcacccugacccucuccaaggccgacuacgagaagcacaagguguacgcgugcgaggugacgcaccaggggcugagcucccccgucaccaagagcuucaaccggggcgagugc

SEQ ID NO: 8489 - RNA, 1344 nt, Artificial Sequence
  derived and/or modified sequence opt1 from Teprotumumab_HeavyChain1
cagguggagcuggucgagagcggcgggggcguggugcagcccgggcgcucccagcggcucagcugcgccgccuccggcuucaccuucagcuccuacgggaugcacuggguccgccaggcgccgggcaagggccuggaguggguggccaucaucugguucgacgggagcuccaccuacuacgccgacagcgugcggggccgcuucacgaucucccgggacaacagcaagaacacccuguaccuccagaugaacucccugcgcgccgaggacaccgccgucuacuucugcgcgcgggagcuggggcgccgguacuucgaccucuggggccgcgggacccuggugagcguguccagcgccuccacgaagggccccagcgucuucccccuggcccccuccagcaaguccaccagcggcgggaccgccgcgcucggcugccuggugaaggacuacuucccggagcccgugaccgucagcuggaacuccggggcccugacgagcggcgugcacaccuuccccgccgugcuccaguccagcggccuguacucccugagcuccgucgugaccgugcccagcuccagccucgggacccagacguacaucugcaacgucaaccacaagccguccaacaccaagguggacaagaagguggagcccaagagcugcgacaagacccacacgugcccgcccugcccggcccccgagcugcugggcgggcccuccgucuuccucuucccgcccaagcccaaggacacccugaugaucagccggacccccgaggugaccugcguggucguggacgucucccacgaggaccccgaggugaaguucaacugguacguggacggcgucgaggugcacaacgccaagaccaagccgcgcgaggagcaguacaacagcacguaccggguggucuccgugcugaccgugcuccaccaggacuggcugaacgggaaggaguacaagugcaaggucagcaacaaggcgcugcccgcccccaucgagaagaccaucuccaaggccaagggccagccccgcgagccccagguguacacccucccgcccagccgggacgagcugacgaagaaccaggugagccugaccugccucgucaagggcuucuaccccuccgacaucgccguggagugggagagcaacgggcagcccgagaacaacuacaagaccaccccgcccgugcuggacuccgacggcagcuucuuccuguacuccaagcucacggucgacaagagccgcuggcagcaggggaacguguucuccugcagcgugaugcacgaggcccugcacaaccacuacacccagaagucccugagccucucccccggcaag

SEQ ID NO: 8490 - RNA, 645 nt, Artificial Sequence
  derived and/or modified sequence opt1 from Teprotumumab_LightChain1
gagaucgugcugacccagagccccgccacccucucccugagccccggcgagcgcgccacgcuguccugccgggcgagccaguccgucagcuccuaccucgccugguaccagcagaagcccgggcaggcgccccgccugcugaucuacgacgccagcaagcgggccaccggcauccccgcccgcuucuccgggagcggcuccgggaccgacuucacccucacgaucagcucccuggagccggaggacuucgccguguacuacugccagcagcggagcaaguggccgcccuggaccuucggccagggcaccaagguggaguccaagcgcaccgucgccgcccccagcguguucaucuucccgcccuccgacgagcagcucaagagcgggacggcguccguggucugccugcugaacaacuucuacccccgggaggccaaggugcaguggaagguggacaacgcccugcagagcggcaacagccaggaguccgucaccgagcaggacagcaaggacuccaccuacagccucuccagcacccugacgcuguccaaggccgacuacgagaagcacaagguguacgccugcgaggugacccaccaggggcucagcucccccgucaccaagagcuucaaccgcggcgagugc

SEQ ID NO: 8491 - RNA, 1338 nt, Artificial Sequence
  derived and/or modified sequence opt1 from Tesidolumab_HeavyChain1
gaggugcagcugguccagagcggcgccgaggugaagaagcccggguccagcgugaaggucuccugcaaggccagcggcgggaccuucuccagcuacgcgaucuccugggugcgccaggccccgggccaggggcucgaguggaugggcggcaucgggcccuucuucggcaccgccaacuacgcccagaaguuccaggggcgggugacgaucaccgccgacgagagcaccuccaccgcguacauggagcugagcucccugcgcagcgaggacacggccgucuacuacugcgcccgggacacccccuacuucgacuacuggggccaggggacccucgugaccguguccagcgccuccacgaagggccccagcgucuucccgcuggcgcccuccagcaaguccaccagcggcgggaccgccgcccugggcugccucgugaaggacuacuuccccgagcccgugaccgucagcuggaacuccggggcccugacgagcggcgugcacaccuucccggccgugcugcaguccagcggccucuacucccugagcuccgucgugaccgugcccagcuccagccuggggacccagacguacaucugcaacgucaaccacaagcccuccaacaccaagguggacaagcgcguggagcccaagagcugcgacaagacccacacgugcccgcccugccccgcgcccgaggccgccggcgggccguccgucuuccucuucccgcccaagcccaaggacacccugaugaucagccggacccccgaggugaccugcguggucguggacgucucccacgaggaccccgaggugaaguucaacugguacguggacggcgucgaggugcacaacgccaagaccaagccccgcgaggagcaguacaacagcacguaccggguggucuccgugcugaccgugcuccaccaggacuggcugaacgggaaggaguacaagugcaaggucagcaacaaggcccugcccgcgccgaucgagaagaccaucuccaaggccaagggccagccccgcgagccccagguguacacccucccgcccagccgggaggagaugacgaagaaccaggugagccugaccugccuggucaagggcuucuaccccuccgacaucgccguggagugggagagcaacgggcagcccgagaacaacuacaagaccaccccgcccgugcucgacuccgacggcagcuucuuccuguacuccaagcugacggucgacaagagccgcuggcagcaggggaacguguucuccugcagcgugaugcacgaggcccuccacaaccacuacacccagaagucccugagccugucccccggcaag

SEQ ID NO: 8492 - RNA, 642 nt, Artificial Sequence
  derived and/or modified sequence opt1 from Tesidolumab_LightChain1
agcuacgagcugacccagccccucuccgugagcgucgcccugggccagaccgcccgcaucacgugcuccggggacagcaucccgaacuacuacguguacugguaccagcagaagcccggccaggcgcccgugcuggucaucuacgacgacuccaaccggcccagcgggaucccggagcgcuucuccggcagcaacuccgggaacaccgccacccucaccaucagccgggcccaggccggcgacgaggccgacuacuacugccaguccuucgacagcucccugaacgcggagguguucggcgggggcacgaagcugaccgugcucgggcagcccaaggccgcccccagcgucacccuguucccgcccuccagcgaggagcugcaggccaacaaggcgacccucgugugccugaucuccgacuucuaccccggcgccgugacggucgccuggaaggccgacagcucccccgugaaggccgggguggagaccaccacccccagcaagcagagcaacaacaaguacgcggccuccagcuaccugucccucacgccggagcaguggaagucccaccgcagcuacagcugccaggucacccacgagggcuccaccguggagaagaccguggcccccacggagugcagc

SEQ ID NO: 8493 - RNA, 1344 nt, Artificial Sequence
  derived and/or modified sequence opt1 from Tezepelumab_HeavyChain1
cagaugcagcugguggagagcggcgggggcgucgugcagcccgggcgcucccuccggcugagcugcgccgccuccggcuucaccuuccgcaccuacgggaugcacugggugcggcaggcgccgggcaagggccuggagugggucgccgugaucugguacgacgggagcaacaagcacuacgccgacuccgugaagggccgcuucacgaucacccgggacaacagcaagaacacccucaaccugcagaugaacucccugcgcgccgaggacaccgccgucuacuacugcgcgcgggcgccccagugggagcucgugcacgaggccuucgacaucugggggcagggcacgauggugaccgucagcuccgccagcaccaaggggcccuccguguucccccuggccccgugcagccgcuccaccagcgaguccacggccgcccugggcugccucgugaaggacuacuuccccgagcccgucaccgugagcuggaacuccggcgcccugaccagcggggugcacaccuuccccgccguccugcaguccagcggccucuacagccuguccagcguggugacggucccguccagcaacuucgggacccagaccuacacgugcaacguggaccacaagcccuccaacaccaagguggacaagaccgucgagcggaagugcugcguggagugcccgcccugccccgcgccgcccguggccggccccagcgucuuccuguucccgcccaagcccaaggacacccucaugaucucccgcacccccgaggugacgugcgucgugguggacgucagccacgaggaccccgaggugcaguucaacugguacguggacggcgucgaggugcacaacgccaagaccaagccccgggaggagcaguucaacuccaccuuccgcguggucagcgugcugaccgugguccaccaggacuggcugaacgggaaggaguacaagugcaagguguccaacaagggccuccccgcccccaucgagaagacgaucagcaagaccaaggggcagccgcgggagccccagguguacacccugccgcccucccgcgaggagaugaccaagaaccaggucagccugacgugccucgugaagggcuucuaccccuccgacaucgccguggagugggagagcaacgggcagcccgagaacaacuacaagaccacgcccccgaugcuggacuccgacggcagcuucuuccuguacuccaagcucaccgucgacaagagccgguggcagcagggcaacguguucagcugcuccgugaugcacgaggcgcugcacaaccacuacacccagaagucccugagccucagccccgggaag

SEQ ID NO: 8494 - RNA, 642 nt, Artificial Sequence
  derived and/or modified sequence opt1 from Tezepelumab_LightChain1
agcuacgugcugacccagcccccguccgucagcguggcccccggccagaccgcccgcaucacgugcgggggcaacaaccucggguccaagagcgugcacugguaccagcagaagcccggccaggcgcccguccuggugguguacgacgacuccgaccggccgagcuggauccccgagcgcuucuccgggagcaacuccggcaacaccgccacccugaccaucagccggggcgaggccggggacgaggccgacuacuacugccaggucugggacuccagcuccgaccacgugguguucggcgggggcacgaagcucaccguccuggggcagcccaaggccgcgcccagcgugacccuguucccgcccuccagcgaggagcuccaggccaacaaggccacccuggugugccugaucuccgacuucuaccccggcgccgucacgguggcguggaaggccgacagcucccccgugaaggccggcgucgagaccaccaccccgagcaagcagagcaacaacaaguacgccgccuccagcuaccucucccugacgcccgagcaguggaagucccaccgcagcuacagcugccaggugacccacgagggguccaccguggagaagaccgucgcgcccacggagugcagc

SEQ ID NO: 8495 - RNA, 1338 nt, Artificial Sequence
  derived and/or modified sequence opt1 from ThioMAb-chMA79b-HC(A118C)_HeavyChain
gaggugcagcugcagcagagcggcgccgagcucaugaagcccggggccuccgucaagaucagcugcaaggcgaccggcuacaccuucuccagcuacuggaucgagugggugaagcagcgcccggggcacggccuggaguggaucggggagauccugcccggcggcggggacacgaacuacaacgagaucuucaagggcaaggccaccuucaccgccgacaccuccagcaacacggccuacaugcagcucuccagccugaccuccgaggacagcgccguguacuacugcacccggcgcguccccguguacuucgacuacugggggcagggcaccuccgugacggucagcuccugcagcaccaaggggcccuccguguucccgcuggcgcccagcuccaagagcaccuccggcggcaccgccgcccucgggugccuggugaaggacuacuuccccgagcccgucacggugagcuggaacagcggcgcccugaccuccggggugcacaccuucccggcgguccuccagagcuccggccuguacagccuguccagcguggugaccguccccuccagcucccucggcacgcagaccuacaucugcaacgugaaccacaagcccagcaacaccaagguggacaagaaggucgagcccaaguccugcgacaagacccacacgugcccgcccugccccgcccccgagcugcucgggggcccgagcguguuccucuucccgcccaagcccaaggacacccugaugaucucccggacccccgaggugaccugcgucgugguggacgucagccacgaggaccccgaggugaaguucaacugguacgucgacgggguggaggugcacaacgccaagacgaagccccgcgaggagcaguacaacuccaccuaccgggucgugagcgugcugaccguccuccaccaggacuggcugaacggcaaggaguacaagugcaagguguccaacaaggcccugcccgccccgaucgagaagaccaucagcaaggcgaaggggcagccccgcgagccccagguguacacgcugcccccgucccgggaggagaugaccaagaaccaggucagccugaccugccuggugaagggcuucuaccccagcgacaucgccguggagugggaguccaacggccagcccgagaacaacuacaagaccacgccgcccguccucgacagcgacggguccuucuuccuguacagcaagcugaccguggacaagucccgcuggcagcagggcaacguguucagcugcuccgucaugcacgaggcccuccacaaccacuacacccagaagucccugagccugagccccggg

SEQ ID NO: 8496 - RNA, 1347 nt, Artificial Sequence
  derived and/or modified sequence opt1 from ThioMab-hu10A8.v1-HC(A118C)_HeavyChain
gaggugcagcuggucgagagcggcgggggccucgugcagcccgggggcucccugcgccugagcugcgccgccuccggguucaccuucagcuccuacgcggugagcuggguccggcaggccccgggcaagggccucgaguggguggccaccaucuccagcgggggcucccugacguucuaccuggacagcgugcgcgggcgguucaccaucucccgcgacaacagcaagaacacccucuaccugcagaugaacucccugcgggccgaggacaccgccgucuacuacugcgcgcgccccauccccgacuacuacgcccucgacuacuggggccaggggacgcuggugaccgugagcuccugcagcaccaagggccccuccgucuucccgcuggcccccagcuccaagagcaccagcggcgggacggccgcgcucggcugccuggugaaggacuacuuccccgagcccgugaccgucuccuggaacagcggggcccugaccuccggcgugcacaccuucccggccgugcuccagagcuccggccuguacagccuguccagcgucgugacggugcccuccagcucccucgggacccagaccuacaucugcaacgucaaccacaagcccagcaacaccaagguggacaagaagguggagcccaaguccugcgacaagacgcacacgugcccgcccugccccgcccccgagcugcugggcgggccgagcgucuuccucuucccgcccaagcccaaggacacccugaugaucucccggacccccgaggugaccugcguggucguggacgucagccacgaggaccccgaggugaaguucaacugguacguggacggcgucgaggugcacaacgccaagaccaagccccgcgaggagcaguacaacuccaccuaccggguggucagcgugcugaccgugcuccaccaggacuggcugaacgggaaggaguacaagugcaaggucuccaacaaggcgcugcccgccccgaucgagaagacgaucagcaaggccaagggccagccccgcgagccccagguguacacccucccgcccagccgggaggagaugaccaagaaccaggugucccugaccugccuggucaagggcuucuaccccagcgacaucgccguggagugggaguccaacgggcagcccgagaacaacuacaagacgaccccgcccgugcucgacagcgacggcuccuucuuccuguacagcaagcugaccgucgacaagucccgcuggcagcaggggaacguguucagcugcuccgugaugcacgaggcccuccacaaccacuacacccagaagucccugagccugagccccggcaag

SEQ ID NO: 8497 - RNA, 1347 nt, Artificial Sequence
  derived and/or modified sequence opt1 from ThioMab-hu10A8.v1-HC(V205C)_HeavyChain
gaggugcagcuggucgagagcggcgggggccucgugcagcccgggggcucccugcgccugagcugcgccgccuccggguucaccuucagcuccuacgcggugagcuggguccggcaggccccgggcaagggccucgaguggguggccaccaucuccagcgggggcucccugacguucuaccuggacagcgugcgcgggcgguucaccaucucccgcgacaacagcaagaacacccucuaccugcagaugaacucccugcgggccgaggacaccgccgucuacuacugcgcgcgccccauccccgacuacuacgcccucgacuacuggggccaggggacgcuggugaccgugagcuccgccagcaccaagggccccuccgucuucccgcuggcccccagcuccaagagcaccagcggcgggacggcggcccucggcugccuggugaaggacuacuuccccgagcccgugaccgucuccuggaacagcggggcccugaccuccggcgugcacaccuucccggccgugcuccagagcuccggccuguacagccuguccagcgucgugacggugcccuccagcucccucgggacccagaccuacaucugcaacgucaaccacaagcccagcaacaccaagguggacaagaagguggagcccaaguccugcgacaagacgcacacgugcccgcccugccccgcccccgagcugcugggcgggccgagcgucuuccucuucccgcccaagcccaaggacacccugaugaucucccggacccccgaggugaccugcguggucguggacgucagccacgaggaccccgaggugaaguucaacugguacguggacggcgucgaggugcacaacgcgaagaccaagccccgcgaggagcaguacaacuccaccuaccggguggucagcgugcugaccgugcuccaccaggacuggcugaacgggaaggaguacaagugcaaggucuccaacaaggcccugcccgccccgaucgagaagacgaucagcaaggccaagggccagccccgcgagccccagguguacacccucccgcccagccgggaggagaugaccaagaaccaggugucccugaccugccuggucaagggcuucuaccccagcgacaucgccguggagugggaguccaacgggcagcccgagaacaacuacaagacgaccccgcccgugcucgacagcgacggcuccuucuuccuguacagcaagcugaccgucgacaagucccgcuggcagcaggggaacguguucagcugcuccgugaugcacgaggcgcuccacaaccacuacacccagaagucccugagccugagccccggcaag

SEQ ID NO: 8498 - RNA, 642 nt, Artificial Sequence
  derived and/or modified sequence opt1 from ThioMab-hu10A8.v1-LC(A118C)_LightChain
gacauccagaugacccagagccccuccagccuguccgccagcgugggcgaccgcgucaccaucacgugcaaggccucccaggacgugagcaccgcgguggccugguaccagcagaagccggggaaggcccccaagcuccugaucuacuccgccagcuaccgguacaccggcguccccucccgcuucagcggguccggcagcgggaccgacuucacgcugaccaucuccagccuccagcccgaggacuucgccaccuacuacugccagcagcacuucuccagcccgcggaccuucggccagggcacgaagguggagaucaagcgcaccguggcggcccccuccgucuucaucuucccgcccagcgacgagcagcugaaguccgggaccgccagcguggugugccugcucaacaacuucuacccccgggaggccaagguccaguggaagguggacaacgcgcugcagagcggcaacucccaggagagcgugaccgagcaggacuccaaggacagcacguacucccugagcuccacccucacccugagcaaggccgacuacgagaagcacaaggucuacgccugcgaggugacccaccaggggcuguccagccccgugacgaaguccuucaaccgcggcgagugc

SEQ ID NO: 8499 - RNA, 642 nt, Artificial Sequence
  derived and/or modified sequence opt1 from ThioMab-hu10A8.v1-LC(V205C)_LightChain
gacauccagaugacccagagccccuccagccuguccgccagcgugggcgaccgcgucaccaucacgugcaaggccucccaggacgugagcaccgcgguggccugguaccagcagaagccggggaaggcccccaagcuccugaucuacuccgccagcuaccgguacaccggcguccccucccgcuucagcggguccggcagcgggaccgacuucacgcugaccaucuccagccuccagcccgaggacuucgccaccuacuacugccagcagcacuucuccagcccgcggaccuucggccagggcacgaagguggagaucaagcgcaccguggcggcccccuccgucuucaucuucccgcccagcgacgagcagcugaaguccgggaccgccagcguggugugccugcucaacaacuucuacccccgggaggccaagguccaguggaagguggacaacgcgcugcagagcggcaacucccaggagagcgugaccgagcaggacuccaaggacagcacguacucccugagcuccacccucacccugagcaaggccgacuacgagaagcacaaggucuacgccugcgaggugacccaccaggggcuguccagccccugcacgaaguccuucaaccgcggcgagugc

SEQ ID NO: 8500 - RNA, 1338 nt, Artificial Sequence
  derived and/or modified sequence opt1 from ThioMAb-huMA79b.v17-HC(A118C)_HeavyChain
gaggugcagcuggucgagagcggcgggggccucgugcagcccgggggcucccugcgccugagcugcgccgccuccggguacaccuucagcuccuacuggaucgagugggugcggcaggcgccgggcaagggccucgaguggaucggggagauccugcccggcgggggcgacaccaacuacaacgagaucuucaaggggcgcgccacguucagcgccgacaccuccaagaacaccgccuaccugcagaugaacagccuccgggccgaggacaccgcggucuacuacugcacgcgccgggugcccguguacuucgacuacuggggccagggcacccuggucaccguguccagcugcuccaccaaggggcccagcguguucccgcuggcccccuccagcaaguccacgagcggcgggaccgccgcccucggcugccuggucaaggacuacuuccccgagcccgugaccguguccuggaacagcggcgcgcugaccuccgggguccacacguucccggccgugcuccagagcagcggccuguacucccugagcuccguggucaccgugcccagcuccagccucgggacccagaccuacaucugcaacgugaaccacaagcccuccaacacgaaggucgacaagaagguggagcccaagagcugcgacaagacccacacgugcccgcccugccccgcccccgagcugcugggcgggccguccguguuccucuucccgcccaagcccaaggacacccugaugaucagccgcacccccgaggugaccugcgucguggucgacgugucccacgaggaccccgaggucaaguucaacugguacguggacggcguggagguccacaacgccaagaccaagccccgggaggagcaguacaacagcaccuaccgcgugguguccguccugacggugcuccaccaggacuggcugaacggcaaggaguacaagugcaaggugagcaacaaggcccugcccgcgccgaucgagaagaccaucuccaaggccaaggggcagccccgggagccccaggucuacacccugcccccgagccgcgaggagaugaccaagaaccaggugucccucacgugccuggugaagggcuucuaccccagcgacaucgccgucgagugggaguccaacgggcagcccgagaacaacuacaagaccaccccgcccgugcucgacagcgacggcagcuucuuccuguacuccaagcugaccguggacaagagccgguggcagcaggggaacgucuucuccugcagcgugaugcacgaggcccuccacaaccacuacacgcagaagucccugagccugucccccggc

SEQ ID NO: 8501 - RNA, 654 nt, Artificial Sequence
  derived and/or modified sequence opt1 from ThioMAb-huMA79b.v17-HC(A118C)_LightChain
gacauccagcugacccagagccccuccagccucuccgccagcgugggcgaccgcgucaccaucacgugcaaggccucccagagcguggacuacgacggggacuccuuccugaacugguaccagcagaagccgggcaaggcgcccaagcugcucaucuacgccgccagcaaccuggaguccggggugcccagccgguucuccggcagcggguccggcaccgacuucacccugaccaucagcucccuccagcccgaggacuucgccacguacuacugccagcagagcaacgaggacccgcugaccuucggccaggggaccaaggucgagaucaagcgcaccguggccgcgcccuccguguucaucuucccgcccagcgacgagcagcugaaguccggcacggccagcgucgugugccuccugaacaacuucuacccccgggaggccaaggugcaguggaaggucgacaacgcccugcagagcgggaacucccaggagagcgugaccgagcaggacuccaaggacagcaccuacucccucagcuccacccugacgcugagcaaggcggacuacgagaagcacaagguguacgccugcgaggucacccaccagggccucuccagccccgugaccaaguccuucaaccgcggggagugc

SEQ ID NO: 8502 - RNA, 1338 nt, Artificial Sequence
  derived and/or modified sequence opt1 from ThioMAb-huMA79b.v18-HC(A118C)_HeavyChain
gaggugcagcuggucgagagcggcgggggccucgugcagcccgggggcucccugcgccugagcugcgccgccuccggguacaccuucagcuccuacuggaucgagugggugcggcaggcgccgggcaagggccucgaguggaucggggagauccugcccggcgggggcgacaccaacuacaacgagaucuucaaggggcgcgccacguucagcgccgacaccuccaagaacaccgccuaccugcagaugaacagccuccgggccgaggacaccgcggucuacuacugcacgcgccgggugcccauccgccuggacuacuggggccagggcacccuggugaccgucuccagcugcuccaccaaggggcccagcguguucccgcucgcccccuccagcaaguccacgagcggcgggaccgccgcccugggcugccuggugaaggacuacuuccccgagcccgucaccguguccuggaacagcggcgcgcucaccuccggggugcacacguucccggccguccugcagagcagcggccuguacucccucagcuccguggugaccguccccagcuccagccuggggacccagaccuacaucugcaacgugaaccacaagcccuccaacacgaagguggacaagaaggucgagcccaagagcugcgacaagacccacacgugcccgcccugccccgcccccgagcugcucggcgggccguccguguuccuguucccgcccaagcccaaggacacccugaugaucagccggacccccgaggugaccugcgucgugguggacgucucccacgaggaccccgaggugaaguucaacugguacgucgacggcguggaggugcacaacgccaagaccaagccccgcgaggagcaguacaacagcaccuaccgggucguguccgugcucacgguccugcaccaggacuggcugaacggcaaggaguacaagugcaaggugagcaacaaggcccuccccgcgccgaucgagaagaccaucuccaaggccaaggggcagccccgcgagccccagguguacacccugcccccgagccgggaggagaugaccaagaaccaggucucccugacgugccucgugaagggcuucuaccccagcgacaucgccguggagugggaguccaacgggcagcccgagaacaacuacaagaccaccccgcccguccuggacagcgacggcagcuucuuccuguacuccaagcucaccguggacaagagccgcuggcagcaggggaacguguucuccugcagcgucaugcacgaggcccugcacaaccacuacacgcagaagucccugagccucucccccggc

SEQ ID NO: 8503 - RNA, 654 nt, Artificial Sequence; identical to SEQ ID NO: 8347
  derived and/or modified sequence opt1 from ThioMAb-huMA79b.v28-HC(A118C)_LightChain

SEQ ID NO: 8504 - RNA, 654 nt, Artificial Sequence
  derived and/or modified sequence opt1 from ThioMAb-huMA79b.v28-LC(V205C)_LightChain
gacaucgugcugacccagagccccgccucccucgccgucagccugggccagcgcgcgaccaucuccugcaaggccagccaguccguggacuacgacggggacagcuuccugaacugguaccagcagaagccgggccagccgcccaagcuguucaucuacgccgccuccaaccucgagagcgggauccccgcccgguucuccggcagcggguccggcacggacuucacccugaacauccaccccguggaggaggaggacgcggccaccuacuacugccagcagagcaacgaggacccccucaccuucggcgccgggacggagcuggagcugaagcgcaccgucgccgcgcccuccguguucaucuucccgcccagcgacgagcagcucaaguccggcaccgccagcguggucugccugcugaacaacuucuacccccgggaggccaaggugcaguggaagguggacaacgcccuccaguccgggaacagccaggaguccgucaccgagcaggacagcaaggacagcacguacucccugagcuccacccugacccucagcaaggccgacuacgagaagcacaagguguacgcgugcgaggugacccaccagggccuguccagccccugcacgaaguccuucaaccgcggggagugc

SEQ ID NO: 8505 - RNA, 1332 nt, Artificial Sequence
  derived and/or modified sequence opt1 from Ticiliuab_HeavyChain1
caggugcagcuggucgagagcggcgggggcguggugcagcccgggcgcucccuccggcugagcugcgccgccuccggcuucaccuucagcuccuacgggcacuggguccgccaggcgccgggcaagggccuggaguggguggccgugaucugguacgacgggagcaacaaguacuacgccgacuccgucaagggccgguucaccaucagccgcgacaacuccaagaacacgcucuaccugcagaacagccugcgggccgaggacaccgccguguacuacugcgcgcgcgacccccgcggggccacccucuacuacuacuacuacggcgacgugugggggcagggcaccacggucaccguguccagcgccuccaccaagggccccagcguguucccccuggccccgugcucccggagcaccuccgagagcacggcggcccuggggugccucgucaaggacuacuuccccgagcccgugaccguguccuggaacagcggcgcccugaccagcgggguccacaccuuccccgccgugcugcaguccagcggccucuacucccugagcuccguggucacggugccgagcuccaacuucggcacccagaccuacacgugcaacguggaccacaagcccagcaacaccaaggucgacaagaccguggagcggaagugcugcguggagugcccgcccugccccgccccgcccgucgcggggcccuccguguuccuguucccgcccaagcccaaggacacccucaucagccgcacccccgaggucacgugcgugguggucgacgugucccacgaggaccccgaggugcaguucaacugguacgucgacggcguggaggugcacaacgccaagaccaagccccgggaggagcaguucaacagcaccuuccgcgucguguccgugcugaccgucgugcaccaggacuggcugaacgggaaggaguacaagugcaaggugagcaacaagggccuccccgcccccaucgagaagacgaucuccaagaccaaggggcagccgcgggagccccaggucuacacccugccgcccagccgcgaggagaccaagaaccaggugucccugacgugccucgugaagggcuucuaccccagcgacaucgccgucgagugggaguccaacggccagcccgagaacaacuacaagaccacgcccccgcuggacagcgacgggagcuucuuccuguacuccaagcucaccguggacaagagccgguggcagcagggcaacguguucuccugcagcguccacgaggcccugcacaaccacuacacccagaagucccugagccucucccccgggaag

SEQ ID NO: 8506 - RNA, 639 nt, Artificial Sequence
  derived and/or modified sequence opt1 from Ticiliuab_LightChain1
gacauccagacccagagccccuccagccuguccgccagcgugggcgaccgcgucaccaucacgugccgggccucccagagcaucaacuccuaccucgacugguaccagcagaagccggggaaggcgcccaagcugcugaucuacgccgccagcucccuccagagcggcgugcccucccgcuucagcggguccggcagcgggaccgacuucacccugaccaucuccagccugcagcccgaggacuucgccacguacuacugccagcaguacuacuccaccccguucaccuucggccccggcaccaagguggagaucaagcggacggucgccgcgcccagcguguucaucuucccgcccuccgacgagcagcucaagagcgggaccgccagcguggucugccugcugaacaacuucuacccccgcgaggccaaggugcaguggaagguggacaacgcccuccaguccggcaacagccaggaguccgucaccgagcaggacagcaaggacuccaccuacagccuguccagcacgcugacccucuccaaggcggacuacgagaagcacaagguguacgccugcgaggugacccaccaggggcugagcucccccgucaccaagagcuucaaccggggcgagugc

SEQ ID NO: 8507 - RNA, 1347 nt, Artificial Sequence
  derived and/or modified sequence opt1 from Tigatuzumab_HeavyChain1
gaggugcagcuggucgagagcggcgggggccucgugcagcccgggggcucccugcgccugagcugcgccgccuccggguucaccuucagcuccuacgugaugagcuggguccggcaggcgccgggcaagggccucgaguggguggccaccaucuccagcgggggcuccuacacguacuaccccgacagcgugaaggggcgcuucaccaucucccgggacaacgccaagaacacccuguaccugcagaugaacagccuccgcgccgaggacaccgccgucuacuacugcgcgcggcgcggcgacuccaugaucacgaccgacuacugggggcagggcacccuggugaccgugagcuccgccagcacgaagggccccuccgucuucccccuggccccgagcuccaagagcaccagcgggggcaccgccgcgcucgggugccuggugaaggacuacuuccccgagcccgugaccgucuccuggaacagcggcgcccugacguccggcgugcacaccuuccccgccgugcuccagagcuccgggcuguacagccuguccagcgucgugaccgugccguccagcucccucggcacccagacguacaucugcaacgucaaccacaagcccagcaacaccaagguggacaagcggguggagcccaaguccugcgacaagacccacacgugcccgcccugccccgcccccgagcugcucgggggccccagcgucuuccuguucccgcccaagcccaaggacacccugaugaucucccgcacccccgaggugaccugcguggucguggacgucagccacgaggacccggaggugaaguucaacugguacguggacggggucgaggugcacaacgccaagaccaagccccgggaggagcaguacaacuccacguaccgcguggucagcgugcugaccgugcuccaccaggacuggcugaacggcaaggaguacaagugcaaggucuccaacaaggcgcugcccgcccccaucgagaagaccaucagcaaggccaagggccagccgcgggagccccagguguacacccucccgcccagccgcgaggagaugacgaagaaccaggugucccugaccugccuggucaagggguucuaccccagcgacaucgccguggagugggaguccaacggccagcccgagaacaacuacaagaccacgcccccggugcucgacagcgacggguccuucuuccuguacagcaagcugaccgucgacaagucccgguggcagcagggcaacguguucagcugcuccgugaugcacgaggcccuccacaaccacuacacccagaagucccugagccugagccccgggaag

SEQ ID NO: 8508 - RNA, 1347 nt, Artificial Sequence; identical to SEQ ID NO: 8507
  derived and/or modified sequence opt1 from Tigatuzumab_HeavyChain

SEQ ID NO: 8509 - RNA, 639 nt, Artificial Sequence
  derived and/or modified sequence opt1 from Tigatuzumab_LightChain1
gacauccagaugacccagagccccuccagccuguccgccagcgugggcgaccgcgucaccaucacgugcaaggccucccaggacguggggaccgcgguggccugguaccagcagaagccgggcaaggcccccaagcuccugaucuacugggccagcacccggcacaccgggguccccucccgcuucagcggcuccgggagcggcacggacuucacccugaccaucuccagccuccagcccgaggacuucgccaccuacuacugccagcaguacuccagcuaccggacguucggccaggggaccaagguggagaucaagcgcaccguggcggccccguccgucuucaucuucccgcccagcgacgagcagcugaaguccggcaccgccagcguggugugccugcucaacaacuucuacccccgggaggccaagguccaguggaagguggacaacgcgcugcaguccgggaacagccaggagagcgugacggagcaggacuccaaggacagcaccuacucccugagcuccacccucacccugagcaaggccgacuacgagaagcacaaggucuacgccugcgaggugacgcaccagggccuguccagccccgugaccaaguccuucaaccgcggggagugc

SEQ ID NO: 8510 - RNA, 639 nt, Artificial Sequence; identical to SEQ ID NO: 8509
  derived and/or modified sequence opt1 from Tigatuzumab_LightChain

SEQ ID NO: 8511 - RNA, 1338 nt, Artificial Sequence
  derived and/or modified sequence opt1 from Tildrakizumab_HeavyChain1
caggugcagcugguccagagcggcgccgaggugaagaagcccggggccuccgugaaggucagcugcaaggcguccggcuacaucuucaucaccuacuggaugaccugggugcgccaggccccggggcagggccucgaguggauggggcagaucuuccccgccagcggcuccgccgacuacaacgagaaguucgagggccgggugacgaugaccaccgacaccagcacguccaccgccuacauggagcugcgcagccugcgguccgacgacaccgcggucuacuacugcgcccgcgggggcgggggcuucgccuacugggggcagggcacccucgugacggugagcuccgccagcaccaagggccccuccgucuucccccuggcgccgagcuccaagagcaccuccgggggcaccgccgcccuggggugccucgugaaggacuacuuccccgagcccgugacggucagcuggaacuccggcgcccugaccagcggcgugcacaccuuccccgccgugcugcagagcuccgggcucuacagccuguccagcgucgugaccgugccguccagcucccugggcacgcagaccuacaucugcaacgucaaccacaagcccagcaacaccaagguggacaagaagguggagcccaaguccugcgacaagacccacacgugcccgcccugccccgcgcccgagcuccucgggggccccagcgucuuccuguucccgcccaagcccaaggacacccugaugaucucccggacccccgaggugaccugcguggucguggacgucagccacgaggacccggaggugaaguucaacugguacguggacggggucgaggugcacaacgccaagacgaagccccgcgaggagcaguacaacuccaccuaccggguggucagcgugcugaccgugcugcaccaggacuggcucaacggcaaggaguacaagugcaaggucuccaacaaggcccugcccgcccccaucgagaagaccaucagcaaggccaagggccagccgcgcgagccccagguguacacgcugccgcccucccgggacgagcucaccaagaaccaggugagccugaccugccuggucaagggguucuaccccuccgacaucgcgguggagugggagagcaacggccagcccgagaacaacuacaagaccacgcccccggugcucgacagcgacggguccuucuuccuguacagcaagcugaccgucgacaagucccgcuggcagcagggcaacguguucagcugcuccgugaugcacgaggcccuccacaaccacuacacccagaagucccugagccugagccccgggaag

SEQ ID NO: 8512 - RNA, 642 nt, Artificial Sequence
  derived and/or modified sequence opt1 from Tildrakizumab_LightChain1
gacauccagaugacccagagccccuccagccuguccgccagcgugggcgaccgggucaccaucacgugccggaccuccgagaacaucuacagcuaccucgccugguaccagcagaagccggggaaggcgcccaagcugcugaucuacaacgccaagacccucgccgagggcgugcccucccgcuucagcggguccggcagcgggaccgacuucacgcugaccaucuccagccugcagcccgaggacuucgccaccuacuacugccagcaccacuacggcaucccguucaccuucggccaggggacgaagguggagaucaagcggaccgucgccgcgcccuccguguucaucuucccgcccagcgacgagcagcucaaguccggcaccgccagcguggucugccugcugaacaacuucuacccccgcgaggccaaggugcaguggaagguggacaacgcccuccaguccgggaacagccaggaguccgucaccgagcaggacagcaaggacagcacguacucccugagcuccacccugacccucagcaaggcggacuacgagaagcacaagguguacgccugcgaggugacccaccagggccuguccagccccgucacgaaguccuucaaccgcggggagugc

SEQ ID NO: 8513 - RNA, 1344 nt, Artificial Sequence
  derived and/or modified sequence opt1 from Tisotumab_vedotin_HeavyChain1
gaggugcagcugcucgagagcggcgggggccugguccagcccgggggcucccugcgccucagcugcgccgccuccggguucaccuucagcaacuacgcgauguccugggugcggcaggccccgggcaagggccuggagugggugagcuccaucagcggguccggcgacuacaccuacuacaccgacagcgucaaggggcgcuucaccaucucccgggacaacagcaagaacacccuguaccuccagaugaacucccugcgcgccgaggacaccgccguguacuacugcgcccggagccccuggggcuacuaccuggacuccugggggcagggcacgcucgugaccgucagcuccgcgagcaccaagggccccuccguguucccccuggccccgagcagcaaguccaccagcgggggcacggccgcccuggggugccucgugaaggacuacuuccccgagcccgucaccguguccuggaacagcggcgcgcugaccuccggcgugcacaccuuccccgccguccugcagagcuccgggcucuacagccuguccagcguggugacggucccguccagcucccugggcacccagaccuacaucugcaacgugaaccacaagcccagcaacaccaagguggacaagcgcgucgagcccaaguccugcgacaagacgcacacgugcccgcccugccccgcccccgagcuccucgggggccccagcguguuccuguucccgcccaagcccaaggacacccucaugaucucccggacccccgaggugaccugcgucgugguggacgucagccacgaggacccggaggugaaguucaacugguacgucgacgggguggaggugcacaacgccaagaccaagccccgcgaggagcaguacaacuccaccuaccgggucgugagcgugcugaccguccugcaccaggacuggcucaacggcaaggaguacaagugcaaggugagcaacaaggcccugcccgcgcccaucgagaagacgaucuccaaggccaagggccagccgcgcgagccccagguguacacccugccgcccagccgggaggagaugaccaagaaccaggucucccugaccugccuggugaagggguucuaccccagcgacaucgccguggagugggaguccaacggccagcccgagaacaacuacaagacgacgcccccgguccuggacagcgacggguccuucuuccucuacagcaagcugaccguggacaagucccgcuggcagcagggcaacguguucagcugcuccgucaugcacgaggcccugcacaaccacuacacccagaagucccucagccugagccccgggaag

SEQ ID NO: 8514 - RNA, 642 nt, Artificial Sequence
  derived and/or modified sequence opt1 from Tisotumab_vedotin_LightChain1
gacauccagaugacccagagcccgcccucccugagcgccuccgccggcgaccgcgugaccaucacgugccgggcgagccaggggaucuccagccgccucgccugguaccagcagaagcccgagaaggcccccaagucccugaucuacgccgccagcucccugcagagcggcguccccucccgguucagcggguccggcagcgggaccgacuucacccucaccaucuccagccugcagccggaggacuucgcgacguacuacugccagcaguacaacuccuaccccuacaccuucggccagggcaccaagcuggagaucaagcgcaccguggccgcccccagcguguucaucuucccgcccuccgacgagcagcucaagagcgggacggccagcgucgugugccugcugaacaacuucuacccccgggaggcgaaggugcaguggaaggucgacaacgcccuccaguccggcaacagccaggaguccgugaccgagcaggacagcaaggacuccaccuacagccuguccagcacccugacgcucuccaaggccgacuacgagaagcacaagguguacgccugcgaggucacccaccaggggcugagcucccccgugaccaagagcuucaaccgcggcgagugc

SEQ ID NO: 8515 - RNA, 1341 nt, Artificial Sequence
  derived and/or modified sequence opt1 from Tocilizumab_HeavyChain1
gugcagcugcaggagagcggccccgggcucguccgccccucccagacccugagccugaccugcacgguguccggcuacagcaucaccuccgaccacgccuggagcugggugcggcagccgcccgggcgcggccucgaguggaucggguacaucuccuacagcggcaucaccaccuacaaccccucccucaagagccgggucacgaugcugcgcgacaccuccaagaaccaguucagccugcggcuguccagcgugaccgccgcggacaccgccguguacuacugcgcccgcucccuggcccggacgaccgccauggacuacuggggccaggggagccucgucaccguguccagcgcguccaccaagggcccgagcguguucccccuggcccccagcuccaagagcacguccgggggcaccgccgcccuggggugccucgucaaggacuacuuccccgagccggugaccgugagcuggaacuccggcgcgcugaccagcggcguccacacguuccccgccgugcugcaguccagcgggcucuacucccugagcuccguggucaccgugcccagcuccagccugggcacccagaccuacaucugcaacgugaaccacaagcccuccaacacgaaggucgacaagaagguggagcccaagagcugcgacaagacccacacgugcccgcccugccccgcccccgagcuccucgggggccccuccguguuccuguucccgcccaagcccaaggacacccugaugaucagccgcacccccgaggugaccugcgucguggucgacgugucccacgaggaccccgaggucaaguucaacugguacguggacggcguggagguccacaacgccaagaccaagccccgggaggagcaguacaacagcaccuaccgcguggugagcguccugacggugcugcaccaggacuggcucaacgggaaggaguacaagugcaagguguccaacaaggcccugccggcgcccaucgagaagaccaucagcaaggccaagggccagccccgggagccccaggucuacacccugccgcccucccgcgacgagcucaccaagaaccaggugagccugacgugccuggugaagggguucuaccccuccgacaucgccgucgagugggagagcaacggccagccggagaacaacuacaagaccaccccgcccgugcucgacuccgacgggagcuucuuccuguacuccaagcugaccguggacaagagccgguggcagcagggcaacgucuucuccugcagcgugaugcacgaggcccuccacaaccacuacacgcagaagucccugagccugucccccggc

SEQ ID NO: 8516 - RNA, 642 nt, Artificial Sequence
  derived and/or modified sequence opt1 from Tocilizumab_LightChain1
gacauccagaugacgcagagccccuccagccuguccgccagcgugggcgaccgcgucaccaucacgugccgggccucccaggacaucagcuccuaccucaacugguaccagcagaagccggggaaggcgcccaagcugcugaucuacuacaccagccgccuccacuccggcgugcccagccgguucuccgggagcggcuccgggaccgacuucaccuucacgaucagcucccugcagcccgaggacaucgccaccuacuacugccagcagggcaacacccugccguacaccuucggccaggggacgaagguggagaucaagcgcaccgucgccgcccccagcguguucaucuucccgcccuccgacgagcagcucaagagcggcaccgccuccguggucugccugcugaacaacuucuacccccgggaggcgaaggugcaguggaagguggacaacgcccuccagagcgggaacagccaggaguccgucaccgagcaggacagcaaggacuccacguacagccuguccagcacccugacccucuccaaggccgacuacgagaagcacaagguguacgccugcgaggugacccaccagggccugagcucccccgucaccaagagcuucaaccgcggggagugc

SEQ ID NO: 8517 - RNA, 1353 nt, Artificial Sequence
  derived and/or modified sequence opt1 from Tosatoxumab_HeavyChain1
gaggugcagaugguccagagcggcgccgaggugaagaagcccggggagccccugaagaucuccugcaagggcagcggguacaaguucggcacccacuggaucgggugggugcgccagcggcccggcaagggccucgaguggauggggaucauccaccccgccgacuccgagaccaaguacagccccuccuuccagggccaggucagcuucuccgcggacaagagcuccaacacggccuaccugcacuggagcacccugcgcgccuccgacaccgccauguacuacugcgcccggcgcagcggguccagcuccugguacgcgcucgacuucuggggccaggggaccauggugacggugagcuccgccagcaccaagggcccguccgucuucccccuggcccccagcagcaaguccaccagcggcgggaccgccgcgcugggcugccucgugaaggacuacuuccccgagccggugacggucuccuggaacagcggggcccugaccuccggcgugcacaccuuccccgccgugcugcagagcuccggccucuacagccuguccagcgucgugaccgugcccuccagcucccuggggacgcagaccuacaucugcaacgucaaccacaagcccagcaacaccaagguggacaagcggguggagccgaaguccugcgacaagacccacacgugcccgcccugccccgcccccgagcuccugggcgggcccagcgucuuccuguucccgcccaagcccaaggacacccucaugaucucccgcacccccgaggugaccugcguggucguggacgugagccacgaggaccccgaggucaaguucaacugguacguggacggcgucgaggugcacaacgccaagacgaagccccgggaggagcaguacaacuccaccuaccgcguggucagcgugcugaccgugcugcaccaggacuggcucaacgggaaggaguacaagugcaaggucagcaacaaggcgcugccggcccccaucgagaagaccaucuccaaggccaagggccagccccgggagccccagguguacacgcugccgcccagccgcgaggagaugaccaagaaccaggugucccugaccugccucgucaagggcuucuaccccagcgacaucgccguggagugggaguccaacgggcagccggagaacaacuacaagaccacgccgcccgugcuggacagcgacggcuccuucuuccucuacagcaagcugaccgucgacaagucccgguggcagcaggggaacguguucagcugcuccgugaugcacgaggcccugcacaaccacuacacccagaagucccucagccugagccccggcaag

SEQ ID NO: 8518 - RNA, 651 nt, Artificial Sequence
  derived and/or modified sequence opt1 from Tosatoxumab_LightChain1
cagagcgugcugacccagucccccagcgccuccggcaccccggggcagcgcgucacgaucagcugcuccggcgggagcuccaacaucggcagcaacaccgugaacugguaccagcaguuccccggggccgcgcccaagcuccugaucuacaccaacaaccagcggcccuccggcgugccggaccgcuucagcggcuccaagagcgggaccuccgccagccuggccaucuccggccuccagagcgaggacgaggccgacuacuacugcgccacgugggacgacucccugaacgggcuguacgucuucggcaccgggaccaaggugaccgugcucggccagcccaaggcgaaccccacggucacccuguucccgcccagcuccgaggagcugcaggccaacaaggccacccucgugugccugaucagcgacuucuaccccggcgccgugaccgucgcguggaaggccgacgggagccccgugaaggccggcguggagacgaccaagcccuccaagcagagcaacaacaaguacgccgccuccagcuaccugucccucaccccggagcaguggaagucccaccggagcuacagcugccaggucacccacgagggguccacgguggagaagaccguggcgcccaccgagugcagc

SEQ ID NO: 8519 - RNA, 1341 nt, Artificial Sequence
  derived and/or modified sequence opt1 from Tositumomab_HeavyChain
caggccuaccugcagcagagcggcgccgagcucgugcgccccggggcguccgucaagaugagcugcaaggccuccggcuacaccuucaccagcuacaacaugcacugggugaagcagacgccgcggcaggggcuggaguggaucggcgccaucuaccccgggaacggcgacaccuccuacaaccagaaguucaagggcaaggccacccugaccguggacaagagcuccagcacggccuacaugcagcucuccagccugaccuccgaggacagcgcggucuacuucugcgcccgcgugguguacuacuccaacagcuacugguacuucgacgucugggggaccggcaccacggugaccguguccgggcccagcgucuucccccuggccccguccagcaaguccaccagcggcgggaccgccgcgcucggcugccuggugaaggacuacuuccccgagcccgugacggucagcuggaacuccggcgcccugaccagcggggugcacaccuuccccgccgugcuccaguccagcggccuguacucccugagcuccgucgugaccgugccgagcuccagccucgggacgcagaccuacaucugcaacgucaaccacaagcccuccaacaccaagguggacaagaaggccgagcccaagagcugcgacaagacccacacgugcccgcccugccccgcccccgagcugcugggcggccccuccguguuccucuucccgcccaagcccaaggacacccugaugaucagccggacccccgaggugaccugcgucguggucgacgugucccacgaggacccggaggucaaguucaacugguacguggacgggguggagguccacaacgcgaagacgaagccccgcgaggagcaguacaacagcaccuaccgggugguguccguccugaccgugcuccaccaggacuggcugaacggcaaggaguacaagugcaaggugagcaacaaggcccugcccgcccccaucgagaagaccaucuccaaggccaaggggcagccgcgcgagccccaggucuacacgcucccgcccagccgggacgagcugaccaagaaccaggugagccugaccugccucgugaagggcuucuaccccuccgacaucgccgucgagugggagagcaacgggcagcccgagaacaacuacaagaccacgcccccggugcuggacuccgacggcagcuucuuccuguacuccaagcucaccguggacaagagccgcuggcagcagggcaacgucuucuccugcagcgugaugcacgaggcgcugcacaaccacuacacccagaagucccugagccucucccccgggaag

SEQ ID NO: 8520 - RNA, 630 nt, Artificial Sequence
  derived and/or modified sequence opt1 from Tositumomab_LightChain
cagaucgugcugagccagucccccgccauccucagcgccuccccgggcgagaaggucaccaugaccugccgcgcgagcuccagcguguccuacaugcacugguaccagcagaagcccgggagcucccccaagcccuggaucuacgccccgagcaaccuggccuccggcgugcccgcccgguucagcggguccggcagcgggacguccuacagccugaccaucucccgcgucgaggccgaggacgcggccaccuacuacugccagcaguggagcuucaacccgcccaccuucggcgccggcacgaagcucgagcugaagcggaccguggccgcgcccuccguguucaucuucccgcccagcgacgagcagcucaagagcgggaccgccuccgucgugugccugcugaacaacuucuacccccgcgaggccaaggugcaguggaaggucgacaacgcccugcagagcggcaacucccaggagagcgugaccgagcaggacuccaaggacagcacguacucccucagcuccacccugacccugagcaaggccgacuacgagaagcacaagguguacgcgugcgaggucacccaccaggggcucuccagccccgugacgaaguccuucaaccgg

SEQ ID NO: 8521 - RNA, 1338 nt, Artificial Sequence
  derived and/or modified sequence opt1 from Tovetumab_HeavyChain1
caggugcagcuggucgagagcggcgggggccucgugaagcccgggggcucccugcgccugagcugcgccgccuccggguucaccuucagcgacuacuacaugaacuggauccggcaggcgccgggcaagggccucgaguggguguccuacaucagcuccagcggguccaucaucuacuacgccgacagcgucaagggccgcuucaccaucucccgggacaacgccaagaacagccuguaccugcagaugaacucccuccgcgccgaggacacggccguguacuacugcgcgcgggaggggcgcaucgccgcccggggcauggacgugugggggcagggcaccaccgucaccgugagcuccgccagcacgaagggccccuccguguucccccuggcgcccugcagccgcuccaccagcgagagcaccgccgcccuggggugccucgucaaggacuacuucccggagcccgugaccguguccuggaacagcggcgcccugacguccgggguccacaccuuccccgccgugcugcagagcuccggccucuacagccuguccagcguggucaccgugcccuccagcaacuucggcacccagacguacacgugcaacguggaccacaagccguccaacaccaaggucgacaagaccguggagcggaagugcugcguggagugcccgcccugccccgcgccgcccgucgccgggcccagcguguuccuguucccgcccaagcccaaggacacccucaugaucucccgcacccccgaggugaccugcgucguggucgacgugagccacgaggaccccgaggugcaguucaacugguacgucgacggcguggaggugcacaacgccaagaccaagccccgggaggagcaguucaacuccacguuccgcgucgugagcgugcugaccgucgugcaccaggacuggcugaacgggaaggaguacaagugcaagguguccaacaagggccuccccgcccccaucgagaagaccaucagcaagaccaaggggcagccccgggagccgcaggucuacacgcugccgcccucccgcgaggagaugaccaagaaccaggugagccugaccugccucgugaagggcuucuaccccagcgacaucgccgucgagugggaguccaacggccagcccgagaacaacuacaagaccacgccgcccaugcuggacagcgacggguccuucuuccuguacagcaagcucaccguggacaagucccgguggcagcagggcaacguguucagcugcuccgucaugcacgaggcgcugcacaaccacuacacccagaagucccugagccucagccccgggaag

SEQ ID NO: 8522 - RNA, 645 nt, Artificial Sequence
  derived and/or modified sequence opt1 from Tovetumab_LightChain1
gacauccagaugacccagagccccuccagccuguccgccagcgugggcgaccgggucuccaucacgugccggcccagccaguccuucagccgcuacaucaacugguaccagcagaagcccgggaaggcccccaagcuccugauccacgcggccuccagccuggugggcggggugcccucccgguucagcggcuccgggagcggcaccgacuucacccucaccaucuccagccugcagccggaggacuucgccaccuacuacugccagcagacguacuccaacccgcccaucaccuucggccaggggacccgccuggagaugaagcggaccgucgccgcccccagcguguucaucuucccgcccuccgacgagcagcucaagagcggcacggcgagcguggucugccugcugaacaacuucuacccccgcgaggccaaggugcaguggaagguggacaacgcccuccaguccgggaacagccaggaguccgucaccgagcaggacagcaaggacuccaccuacagccuguccagcacccugacgcucuccaaggccgacuacgagaagcacaagguguacgcgugcgaggugacccaccagggccugagcucccccgucaccaagagcuucaaccgcggggagugc

SEQ ID NO: 8523 - RNA, 1347 nt, Artificial Sequence
  derived and/or modified sequence opt1 from Tralokinumab_HeavyChain1
caggugcagcugguccagagcggcgccgaggugaagaagcccggggccuccgugaaggucagcugcaaggcguccggcuacaccuucaccaacuacgggcucagcugggugcgccaggccccgggccaggggcuggaguggaugggcuggaucuccgccaacaacggcgacacgaacuacgggcaggaguuccagggccgggugaccaugaccaccgacacgagcaccuccaccgccuacauggagcugcgcagccuccgguccgacgacaccgccgucuacuacugcgcgcgcgacagcuccagcuccugggcccggugguucuucgaccugugggggcgcggcacgcuggugaccgugagcuccgccagcaccaaggggcccuccgucuucccccucgcccccugcagccgguccaccagcgagagcacggcggcccugggcugccuggugaaggacuacuucccggagcccgugaccgucuccuggaacagcggcgcccucaccuccggggugcacaccuuccccgccgugcugcagagcuccggccuguacagccucuccagcgucgugacggugcccuccagcucccuggggaccaagaccuacacgugcaacgucgaccacaagccgagcaacaccaagguggacaagcgcguggaguccaaguacggcccgcccugccccagcugccccgcccccgaguuccugggcgggcccuccgucuuccucuucccgcccaagcccaaggacacccugaugaucagccggacccccgaggugaccugcguggucguggacgucucccaggaggaccccgaggugcaguucaacugguacguggacggcgucgaggugcacaacgcgaagacgaagccgcgcgaggagcaguucaacagcaccuaccggguggucuccgugcugaccgugcuccaccaggacuggcugaacgggaaggaguacaagugcaaggucagcaacaagggccugcccagcuccaucgagaagaccaucagcaaggccaaggggcagccccgcgagccccagguguacacgcucccgcccucccaggaggagaugaccaagaaccaggugagccugaccugccuggucaagggcuucuaccccuccgacaucgccguggagugggagagcaacggccagcccgagaacaacuacaagaccacgccgcccgugcucgacuccgacgggagcuucuuccuguacucccggcugaccgucgacaagagccgcuggcaggagggcaacguguucuccugcagcgugaugcacgaggcccuccacaaccacuacacccagaagucccugagccugucccucgggaag

SEQ ID NO: 8524 - RNA, 642 nt, Artificial Sequence
  derived and/or modified sequence opt1 from Tralokinumab_LightChain1
agcuacgugcugacccagcccccguccgucagcguggcccccggcaagaccgcccgcaucacgugcgggggcaacaucaucggguccaagcucgugcacugguaccagcagaagcccggccaggcgcccguccuggugaucuacgacgacggggaccggccgagcggcauccccgagcgcuucuccggcagcaacuccgggaacaccgccacccugaccaucagccggguggaggccggcgacgaggccgacuacuacugccaggucugggacacgggguccgaccccgugguguucggcgggggcaccaagcucaccguccugggccagcccaaggccgcgccgagcgugacccuguucccgcccuccagcgaggagcuccaggccaacaaggccacgcuggugugccugaucuccgacuucuaccccggggccgucaccguggcguggaaggccgacagcucccccgugaaggccggcgucgagaccaccacgcccagcaagcaguccaacaacaaguacgccgccagcuccuaccucagccugacccccgagcaguggaagucccaccgcagcuacagcugccaggugacccacgagggguccaccguggagaagacggucgcgcccaccgagugcagc

SEQ ID NO: 8525 - RNA, 1332 nt, Artificial Sequence
  derived and/or modified sequence opt1 from Trastuzuab_HeavyChain1
gaggugcagcuggucgagagcggcgggggccucgugcagcccgggggcucccugcgccugagcugcgccgccuccggguucaacaucaaggacaccuacauccacugggugcggcaggcgccgggcaagggccucgagugggucgcccgcaucuaccccaccaacggguacacgcgguacgccgacagcgugaagggccgcuucaccaucuccgccgacaccagcaagaacaccgccuaccugcagaacucccugcgggcggaggacacggccguguacuacugcagccgcuggggcggggacggguucuacgccgacuacuggggccagggcacccucgucaccguguccagcgccuccaccaaggggcccagcguguucccccuggcgccguccagcaaguccacgagcggcgggaccgccgcccugggcugccucgucaaggacuacuuccccgagcccgugaccguguccuggaacagcggcgcccugaccuccgggguccacacguuccccgccgugcugcagagcagcggccucuacucccugagcuccguggucaccgugccgagcuccagccuggggacccagaccuacaucugcaacgugaaccacaagcccuccaacacgaaggucgacaagaagguggagcccaagagcugcgacaagacccacacgugcccgcccugccccgcgcccgagcuccugggcgggcccuccguguuccuguucccgcccaagcccaaggacacccucaucagccggacccccgaggugaccugcgucguggucgacgugucccacgaggacccggaggucaaguucaacugguacguggacggcguggagguccacaacgccaagaccaagccccgcgaggagcaguacaacagcaccuaccgggugguguccguccugacggugcugcaccaggacuggcucaacggcaaggaguacaagugcaaggugagcaacaaggcccugcccgcccccaucgagaagaccaucuccaaggccaaggggcagccgcgcgagccccaggucuacacccugccgcccagccgggaggagaccaagaaccaggugucccucacgugccuggugaagggcuucuaccccagcgacaucgcggucgagugggaguccaacgggcagcccgagaacaacuacaagaccacgcccccggugcuggacagcgacggcagcuucuuccucuacuccaagcugaccguggacaagagccgcuggcagcaggggaacgucuucuccugcagcgugcacgaggcccugcacaaccacuacacccagaagucccucagccugucccccggc

SEQ ID NO: 8526 - RNA, 639 nt, Artificial Sequence
  derived and/or modified sequence opt1 from Trastuzuab_LightChain1
gacauccagacccagagccccuccagccuguccgccagcgugggcgaccgcgucaccaucacgugccgggccucccaggacgugaacaccgcgguggccugguaccagcagaagccggggaaggcccccaagcuccugaucuacagcgccuccuuccuguacagcggcguccccucccgcuucagcgggucccggagcggcaccgacuucacccucacgaucuccagccugcagcccgaggacuucgccaccuacuacugccagcagcacuacaccaccccgcccacguucgggcagggcaccaagguggagaucaagcgcaccguggcggcccccuccgucuucaucuucccgcccagcgacgagcagcugaaguccggcaccgccagcguggugugccuccugaacaacuucuacccccgggaggccaagguccaguggaagguggacaacgcgcugcaguccgggaacagccaggagagcgugacggagcaggacuccaaggacagcaccuacucccucagcuccacccugacccugagcaaggccgacuacgagaagcacaaggucuacgccugcgaggugacgcaccagggccucuccagccccgugaccaaguccuucaaccgcggggagugc

SEQ ID NO: 8527 - RNA, 1347 nt, Artificial Sequence
  derived and/or modified sequence opt1 from Trastuzumab_emtansine_HeavyChain1
gaggugcagcuggucgagagcggcgggggccucgugcagcccgggggcucccugcgccugagcugcgccgccuccggguucaacaucaaggacaccuacauccacugggugcggcaggcgccgggcaagggccucgagugggucgcccgcaucuaccccaccaacggguacacgcgguacgccgacagcgugaagggccgcuucaccaucuccgccgacaccagcaagaacaccgccuaccugcagaugaacucccugcgggcggaggacacggccguguacuacugcagccgcuggggcggggacggguucuacgccauggacuacuggggccagggcacccucgucaccguguccagcgccuccaccaaggggcccagcguguucccccuggcgccguccagcaaguccacgagcggcgggaccgccgcccugggcugccucgucaaggacuacuuccccgagcccgugaccguguccuggaacagcggcgcccugaccuccgggguccacacguuccccgccgugcugcagagcagcggccucuacucccugagcuccguggucaccgugccgagcuccagccuggggacccagaccuacaucugcaacgugaaccacaagcccuccaacacgaaggucgacaagaagguggagcccaagagcugcgacaagacccacacgugcccgcccugccccgcgcccgagcuccugggcgggcccuccguguuccuguucccgcccaagcccaaggacacccucaugaucagccggacccccgaggugaccugcgucguggucgacgugucccacgaggacccggaggucaaguucaacugguacguggacggcguggagguccacaacgccaagaccaagccccgcgaggagcaguacaacagcaccuaccgggugguguccguccugacggugcugcaccaggacuggcucaacggcaaggaguacaagugcaaggugagcaacaaggcccugcccgcccccaucgagaagaccaucuccaaggccaaggggcagccgcgcgagccccaggucuacacccugccgcccagccgggaggagaugaccaagaaccaggugucccucacgugccuggugaagggcuucuaccccagcgacaucgcggucgagugggaguccaacgggcagcccgagaacaacuacaagaccacgcccccggugcuggacagcgacggcagcuucuuccucuacuccaagcugaccguggacaagagccgcuggcagcaggggaacgucuucuccugcagcgugaugcacgaggcccugcacaaccacuacacccagaagucccucagccugucccccggc

SEQ ID NO: 8528 - RNA, 642 nt, Artificial Sequence; identical to SEQ ID NO: 8384
  derived and/or modified sequence opt1 from Trastuzumab_emtansine_LightChain1

SEQ ID NO: 8529 - RNA, 1347 nt, Artificial Sequence; identical to SEQ ID NO: 8527
  derived and/or modified sequence opt1 from Trastuzumab_HeavyChain1

SEQ ID NO: 8530 - RNA, 1353 nt, Artificial Sequence
  derived and/or modified sequence opt1 from Trastuzumab_HeavyChain
gaggugcagcuggucgagagcggcgggggccucgugcagcccgggggcucccugcgccugagcugcgccgccuccggguucaacaucaaggacaccuacauccacugggugcggcaggcgccgggcaagggccucgagugggucgcccgcaucuaccccaccaacggguacacgcgguacgccgacagcgugaagggccgcuucaccaucuccgccgacaccagcaagaacaccgccuaccugcagaugaacucccugcgggcggaggacacggccguguacuacugcagccgcuggggcggggacggguucuacgccauggacuacuggggccagggcacccucgucaccguguccagcgccuccaccaaggggcccagcguguucccccuggcgccguccagcaaguccacgagcggcgggaccgccgcccugggcugccucgucaaggacuacuuccccgagcccgugaccguguccuggaacagcggcgcccugaccuccgggguccacacguuccccgccgugcugcagagcagcggccucuacucccugagcuccguggucaccgugccgagcuccagccuggggacccagaccuacaucugcaacgugaaccacaagcccuccaacacgaaggucgacaagaagguggagccgcccaagagcugcgacaagacccacacgugcccgcccugccccgcgcccgagcuccugggcgggcccuccguguuccuguucccgcccaagcccaaggacacccucaugaucagccggacccccgaggugaccugcgucguggucgacgugucccacgaggaccccgaggucaaguucaacugguacguggacggcguggagguccacaacgccaagaccaagccccgcgaggagcaguacaacagcaccuaccgggugguguccguccugacggugcugcaccaggacuggcucaacggcaaggaguacaagugcaaggugagcaacaaggcccugcccgccccgaucgagaagaccaucuccaaggccaaggggcagccccgcgagccccaggucuacacccugcccccgagccgggacgagcucaccaagaaccaggugucccugacgugccuggugaagggcuucuaccccagcgacaucgcggucgagugggaguccaacgggcagcccgagaacaacuacaagaccaccccgcccgugcucgacagcgacggcagcuucuuccuguacuccaagcugaccguggacaagagccgcuggcagcaggggaacgucuucuccugcagcgugaugcacgaggcccuccacaaccacuacacgcagaagucccugagccugucccccggcaag

SEQ ID NO: 8531 - RNA, 660 nt, Artificial Sequence
  derived and/or modified sequence opt1 from Trastuzumab_HeavyChain_variant_1n8z_B
gaggugcagcuggucgagagcggcgggggccucgugcagcccgggggcucccugcgccugagcugcgccgccuccggguucaacaucaaggacaccuacauccacugggugcggcaggcgccgggcaagggccucgagugggucgcccgcaucuaccccaccaacggguacacgcgguacgccgacagcgugaagggccgcuucaccaucuccgccgacaccagcaagaacaccgccuaccugcagaugaacucccugcgggcggaggacacggccguguacuacugcagccgcuggggcggggacggguucuacgccauggacuacuggggccagggcacccucgucaccguguccagcgccuccaccaaggggcccagcguguucccccuggcgccguccagcaaguccacgagcggcgggaccgccgcccugggcugccucgucaaggacuacuuccccgagcccgugaccguguccuggaacagcggcgcccugaccuccgggguccacacguuccccgccgugcugcagagcagcggccucuacucccugagcuccguggucaccgugccgagcuccagccuggggacccagaccuacaucugcaacgugaaccacaagcccuccaacacgaaggucgacaagaagguggagccc

SEQ ID NO: 8532 - RNA, 45 nt, Artificial Sequence
  derived and/or modified sequence opt1 from Trastuzumab_HeavyChain_variant_7637_H
gagcccaagagcugcgacaagacccacaccugcccgcccugcccc

SEQ ID NO: 8533 - RNA, 642 nt, Artificial Sequence; identical to SEQ ID NO: 8384
  derived and/or modified sequence opt1 from Trastuzumab_LightChain1

SEQ ID NO: 8534 - RNA, 642 nt, Artificial Sequence; identical to SEQ ID NO: 8384
  derived and/or modified sequence opt1 from Trastuzumab_LightChain_variant_1n8z_A

SEQ ID NO: 8535 - RNA, 642 nt, Artificial Sequence; identical to SEQ ID NO: 8384
  derived and/or modified sequence opt1 from Trastuzumab_LightChain_variant_7637_L

SEQ ID NO: 8536 - RNA, 1344 nt, Artificial Sequence
  derived and/or modified sequence opt1 from TRC-105_HeavyChain1
gaggugaagcuggaggagagcggcgggggccucguccagcccgggggcuccaugaagcugagcugcgccgccuccggguucaccuucagcgacgcguggauggacugggugcgccaguccccggagaagggccuggaguggguggccgagauccggagcaaggccuccaaccacgccaccuacuacgccgagagcgucaagggccgcuucacgaucucccgggacgacagcaaguccagcguguaccuccagaugaacucccugcgcgcggaggacaccgggaucuacuacugcacccgguggcgccgguucuucgacagcuggggccaggggaccacgcugaccguguccagcgccuccaccaagggccccagcgucuucccccucgcccccuccagcaagagcaccuccgggggcacggccgcgcugggcugccuggugaaggacuacuucccggagcccgugaccgucagcuggaacuccggggcccucaccagcggcgugcacaccuuccccgccgugcugcaguccagcgggcuguacucccucagcuccgucgugacggugcccagcuccagccugggcacccagaccuacaucugcaacgucaaccacaagccguccaacaccaagguggacaagaagguggagcccaagagcugcgacaagacgcacacgugcccgcccugcccggcccccgagcugcucggcgggcccuccgucuuccuguucccgcccaagcccaaggacacccugaugaucagccgcacccccgaggugaccugcguggucguggacgugucccacgaggaccccgaggucaaguucaacugguacguggacggcgucgaggugcacaacgccaagaccaagccgcgggaggagcaguacaacagcaccuaccgcguggucuccgugcucaccgugcugcaccaggacuggcugaacgggaaggaguacaagugcaaggucagcaacaaggcgcuccccgcccccaucgagaagacgaucagcaaggccaagggccagccccgggagccccagguguacacccugccgcccucccgcgacgagcugaccaagaaccaggugagccugaccugccucgucaagggguucuaccccuccgacaucgccguggagugggagagcaacggccagcccgagaacaacuacaagacgaccccgcccgugcuggacuccgacggcagcuucuuccucuacuccaagcugaccgucgacaagagccgguggcagcaggggaacguguucuccugcagcgugaugcacgaggcccugcacaaccacuacacccagaagucccucagccugucccccggcaag

SEQ ID NO: 8537 - RNA, 639 nt, Artificial Sequence
  derived and/or modified sequence opt1 from TRC-105_LightChain1
cagaucgugcugagccagucccccgccauccucagcgccuccccgggcgagaaggucaccaugaccugccgcgcgagcuccagcguguccuacaugcacugguaccagcagaagcccgggagcucccccaagcccuggaucuacgccacgagcaaccuggccuccggcgugccgguccgguucagcggguccggcagcgggaccuccuacagccugaccaucucccgcguggaggccgaggacgccgcgaccuacuacugccagcaguggagcuccaacccccucacguucggcgccggcaccaagcuggagcugaagcggaccguggccgcccccagcgucuucaucuucccgcccagcgacgagcagcucaaguccgggaccgcgagcguggugugccugcugaacaacuucuacccccgcgaggccaagguccaguggaagguggacaacgcccuccaguccggcaacagccaggaguccgugacggagcaggacagcaaggacuccaccuacagccuguccagcacccugacccucuccaaggccgacuacgagaagcacaaggucuacgccugcgaggugacgcaccaggggcugagcucccccgugaccaagagcuucaaccggggcgagugc

SEQ ID NO: 8538 - RNA, 1362 nt, Artificial Sequence
  derived and/or modified sequence opt1 from Tregalizumab_HeavyChain1
gaggagcagcugguggagagcggcgggggccucgucaagcccgggggcucccugcgccugagcugcgccgccuccggguucagcuucuccgacugccggauguacuggcuccgccaggcgccgggcaagggccuggaguggaucggggugaucagcgugaaguccgagaacuacggcgccaacuacgccgagagcguccgggggcgcuucaccaucucccgggacgacagcaagaacaccguguaccugcagaugaacucccucaagacggaggacaccgccguguacuacugcagcgccuccuacuaccgcuacgacgucggcgcgugguucgccuacugggggcagggcacccuggugaccgugagcuccgccagcacgaagggccccuccgucuucccccuggcccccagcuccaagagcaccagcgggggcaccgcggcccucgggugccuggugaaggacuacuucccggagcccgugaccgucuccuggaacagcggcgcccugacguccggcgugcacaccuuccccgccgugcuccagagcuccgggcuguacagccuguccagcgucgugaccgugcccuccagcucccucggcacccagacguacaucugcaacgucaaccacaagccgagcaacaccaagguggacaagaagguggagcccaaguccugcgacaagacccacacgugcccgcccugcccggcccccgagcugcucgggggccccagcgucuuccuguucccgcccaagcccaaggacacccugaugaucucccggacccccgaggugaccugcguggucguggacgucagccacgaggaccccgaggugaaguucaacugguacguggacggggucgaggugcacaacgcgaagaccaagccgcgcgaggagcaguacaacuccacguaccggguggucagcgugcugaccgugcuccaccaggacuggcugaacggcaaggaguacaagugcaaggucuccaacaaggcccugcccgcccccaucgagaagaccaucagcaaggccaagggccagccccgcgagccccagguguacacccucccgcccagccgggacgagcugacgaagaaccaggugucccugaccugccucgucaagggguucuaccccagcgacaucgccguggagugggaguccaacggccagcccgagaacaacuacaagaccaccccgcccgugcuggacagcgacggguccuucuuccuguacagcaagcucacggucgacaagucccgcuggcagcagggcaacguguucagcugcuccgugaugcacgaggcgcugcacaaccacuacacccagaagucccugagccucagccccgggaag

SEQ ID NO: 8539 - RNA, 654 nt, Artificial Sequence
  derived and/or modified sequence opt1 from Tregalizumab_LightChain1
gacaucgugaugacccagagccccgacucccuggccgucagccucggcgagcgcgccaccaucaacugccgggcguccaagagcguguccacgagcggguacuccuacaucuacugguaccagcagaagccgggccagccgcccaagcugcugaucuaccucgccagcauccuggaguccggggugcccgaccgcuucagcggcuccgggagcggcaccgacuucacccugaccaucuccagccuccaggccgaggacgucgccguguacuacugccagcacucccgggagcugcccuggacguucggccaggggaccaagguggagaucaagcgcaccgucgccgcgcccagcguguucaucuucccgcccuccgacgagcagcucaagagcggcaccgccuccguggucugccugcugaacaacuucuacccccgggaggccaaggugcaguggaagguggacaacgcccugcagagcgggaacagccaggaguccgucacggagcaggacagcaaggacuccaccuacagccucuccagcacccugacccuguccaaggcggacuacgagaagcacaagguguacgccugcgaggugacgcaccagggccucagcucccccgucaccaagagcuucaaccgcggggagugc

SEQ ID NO: 8540 - RNA, 1353 nt, Artificial Sequence
  derived and/or modified sequence opt1 from Tremelimumab_HeavyChain1
caggugcagcuggucgagagcggcgggggcguggugcagcccgggcgcucccuccggcugagcugcgccgccuccggcuucaccuucagcuccuacgggaugcacuggguccgccaggcgccgggcaagggccuggaguggguggccgugaucugguacgacgggagcaacaaguacuacgccgacuccgucaagggccgguucaccaucagccgcgacaacuccaagaacacgcucuaccugcagaugaacagccugcgggccgaggacaccgccguguacuacugcgcgcgcgacccccgcggggccacccucuacuacuacuacuacggcauggacgugugggggcagggcaccacggucaccguguccagcgccuccaccaagggccccagcguguucccccuggccccgugcucccggagcaccuccgagagcacggcggcccuggggugccucgucaaggacuacuuccccgagcccgugaccguguccuggaacagcggcgcccugaccagcgggguccacaccuuccccgccgugcugcaguccagcggccucuacucccugagcuccguggucacggugccgagcuccaacuucggcacccagaccuacacgugcaacguggaccacaagcccagcaacaccaaggucgacaagaccguggagcggaagugcugcguggagugcccgcccugccccgccccgcccgucgcggggcccuccguguuccuguucccgcccaagcccaaggacacccucaugaucagccgcacccccgaggucacgugcgugguggucgacgugucccacgaggaccccgaggugcaguucaacugguacgucgacggcguggaggugcacaacgccaagaccaagccccgggaggagcaguucaacagcaccuuccgcgucguguccgugcugaccgucgugcaccaggacuggcugaacgggaaggaguacaagugcaaggugagcaacaagggccuccccgcccccaucgagaagacgaucuccaagaccaaggggcagccgcgggagccccaggucuacacccugccgcccagccgcgaggagaugaccaagaaccaggugucccugacgugccucgugaagggcuucuaccccagcgacaucgccgucgagugggaguccaacggccagcccgagaacaacuacaagaccacgcccccgaugcuggacagcgacgggagcuucuuccuguacuccaagcucaccguggacaagagccgguggcagcagggcaacguguucuccugcagcgucaugcacgaggcccugcacaaccacuacacccagaagucccugagccucucccccgggaag

SEQ ID NO: 8541 - RNA, 642 nt, Artificial Sequence
  derived and/or modified sequence opt1 from Tremelimumab_LightChain1
gacauccagaugacccagagccccuccagccuguccgccagcgugggcgaccgcgucaccaucacgugccgggccucccagagcaucaacuccuaccucgacugguaccagcagaagccggggaaggcgcccaagcugcugaucuacgccgccagcucccuccagagcggcgugcccucccgcuucagcggguccggcagcgggaccgacuucacccugaccaucuccagccugcagcccgaggacuucgccacguacuacugccagcaguacuacuccaccccguucaccuucggccccggcaccaagguggagaucaagcggacggucgccgcgcccagcguguucaucuucccgcccuccgacgagcagcucaagagcgggaccgccagcguggucugccugcugaacaacuucuacccccgcgaggccaaggugcaguggaagguggacaacgcccuccaguccggcaacagccaggaguccgucaccgagcaggacagcaaggacuccaccuacagccuguccagcacgcugacccucuccaaggcggacuacgagaagcacaagguguacgccugcgaggugacccaccaggggcugagcucccccgucaccaagagcuucaaccggggcgagugc

SEQ ID NO: 8542 - RNA, 1341 nt, Artificial Sequence
  derived and/or modified sequence opt1 from Trevogrumab_HeavyChain1
gaggugcagguccuggagagcggcggggaccucgugcagcccggcgggucccugcgccugagcugcgccgccuccggcuucaccuucagcgcguacgccaugaccugggugcggcaggcccccgggaagggccucgagugggucuccgccaucagcggcuccgggggcagcgccuacuacgcggacuccgugaaggggcgcuucacgaucagccgggacaacuccaagaacaccguguaccugcagaugaacagccugcgcgccgaggacaccgccgucuacuacugcgccaaggacggcgcguggaagauguccgggcucgacguguggggccagggcaccacggugaucgucagcuccgccagcaccaaggggcccuccguguucccccuggcccccugcagccgguccaccagcgagagcaccgccgcccugggcugccucgugaaggacuacuucccggagcccgucacgguguccuggaacagcggggcgcugaccuccggcgugcacaccuuccccgccguccugcagagcuccggccucuacagccuguccagcguggugaccguccccuccagcucccuggggacgaagaccuacacgugcaacguggaccacaagccgagcaacaccaagguggacaagcgcgucgaguccaaguacggcccgcccugcccgcccugccccgcccccgaguuccucgggggccccagcguguuccuguucccgcccaagcccaaggacacccugaugaucucccggacccccgaggugaccugcgucguggucgacgugagccaggaggacccggaggugcaguucaacugguacgucgacgggguggaggugcacaacgccaagaccaagccccgcgaggagcaguucaacuccacguaccgggucgugagcgugcucaccguccugcaccaggacuggcugaacggcaaggaguacaagugcaagguguccaacaagggccuccccagcagcaucgagaagaccaucuccaaggccaaggggcagccccgcgagccccagguguacacccugccgcccagccaggaggagaugacgaagaaccaggucucccugaccugccucgugaagggcuucuaccccagcgacaucgcgguggagugggaguccaacgggcagcccgagaacaacuacaagaccaccccgcccguccuggacagcgacggcuccuucuuccuguacagccggcucacgguggacaagucccgcuggcaggaggggaacguguucagcugcuccgucaugcacgaggcccugcacaaccacuacacccagaagucccugagccucagccugggcaag

SEQ ID NO: 8543 - RNA, 642 nt, Artificial Sequence
  derived and/or modified sequence opt1 from Trevogrumab_LightChain1
gacauccagaugacccagagccccgccucccugagcgccuccgugggcgaccgggucaccaucacgugccgggcgagccaggacaucuccgacuaccucgccugguaccagcagaagccggggaagaucccccgccugcugaucuacaccaccagcacccuccaguccggcgugcccagccgguuccgcggguccggcagcgggacggacuucacccugaccaucuccagccugcagcccgaggacguggccaccuacuacugccagaaguacgacuccgccccgcucacguucggcggcgggaccaaggucgagaucaagcggaccguggccgcgcccagcguguucaucuucccgcccuccgacgagcagcucaagagcggcaccgccuccgucgugugccugcugaacaacuucuacccccgcgaggccaaggugcaguggaaggucgacaacgcccugcagagcgggaacucccaggagagcgugacggagcaggacagcaaggacuccaccuacagccuguccagcacccucacccuguccaaggcggacuacgagaagcacaagguguacgccugcgaggucacgcaccagggccugagcucccccgugaccaagagcuucaaccgcggggagugc

SEQ ID NO: 8544 - RNA, 1737 nt, Artificial Sequence
  derived and/or modified sequence opt1 from Tucotuzumab_celmoleukin_HeavyChain1
cagauccagcuggugcagagcggcgccgaggucaagaagcccggggagaccgugaagaucuccugcaaggccagcggcuacaccuucacgaacuacgggaugaacugggugaagcagaccccgggcaaggggcucaaguggaugggcuggaucaacaccuacaccggcgagcccacguacgcggacgacuucaaggggcgcuucgccuucucccuggagaccagcaccuccaccgccuuccugcagaucaacaaccuccggagcgaggacacggccaccuacuucugcguccgcuucaucuccaagggcgacuacugggggcagggcaccagcgugaccguguccagcgccuccacgaaggggcccagcgucuucccccuggcgccguccagcaaguccaccagcggcggcaccgccgcccuggggugccucgugaaggacuacuuccccgagcccgugaccgucuccuggaacagcggcgcccugacguccggggugcacaccuuccccgcggugcugcagagcagcggccucuacucccugagcuccgucgugaccgugccgagcuccagccugggcacccagacguacaucugcaacgucaaccacaagcccuccaacaccaagguggacaagcggguggagcccaagagcugcgacaagacccacacgugcccgcccugccccgcccccgagcuccucgggggccccuccgucuuccuguucccgcccaagcccaaggacacccucaugaucagccgcacccccgaggugaccugcguggucguggacgugucccacgaggacccggaggucaaguucaacugguacguggacggggucgaggugcacaacgccaagaccaagccccgggaggagcaguacaacagcacguaccgcguggucuccgugcugaccgugcugcaccaggacuggcucaacggcaaggaguacaagugcaaggucagcaacaaggcccugcccgcccccaucgagaagaccaucuccaaggcgaaggggcagccgcgggagccccagguguacacccugccgcccagccgcgaggagaugacgaagaaccaggugucccugaccugccuggucaagggcuucuaccccagcgacaucgccguggagugggaguccaacggccagcccgagaacaacuacaagaccacgcccccggugcuggacagcgacgggagcuucuuccucuacuccaagcugaccgucgacaagagccgguggcagcagggcaacguguucuccugcagcgugaugcacgaggcccugcacaaccacuacacccagaagucccucagccugucccccgggaaggcccccaccagcuccagcaccaagaagacccagcugcagcucgagcaccuccugcuggaccugcagaugauccugaacggcaucaacaacuacaagaaccccaagcucacgcgcaugcugaccuucaaguucuacaugccgaagaaggccaccgagcugaagcaccuccagugccuggaggaggagcugaagccccucgaggagguccugaaccuggcgcaguccaagaacuuccaccuccggccccgcgaccugaucagcaacaucaacgugaucgugcuggagcucaagggguccgagaccacguucaugugcgaguacgccgacgagaccgccaccaucgucgaguuccugaaccgguggaucaccuucugccagagcaucaucuccacgcugacc

SEQ ID NO: 8545 - RNA, 639 nt, Artificial Sequence
  derived and/or modified sequence opt1 from Tucotuzumab_celmoleukin_LightChain1
gagaucgugcugacccagagccccgccacccucucccugagcccgggcgagcgcgucacgcugaccugcuccgccagcuccagcguguccuacaugcucugguaccagcagaagcccgggagcucccccaagcccuggaucuucgacaccagcaaccuggcguccggcuucccggcccgguucagcggguccggcagcgggaccuccuacagccugaucaucuccagcauggaggccgaggacgccgccacguacuacugccaccagcgcuccggcuaccccuacaccuucggcgggggcaccaagcucgagaucaagcggaccguggcggcccccagcgucuucaucuucccgcccagcgacgagcagcugaaguccgggacggccagcguggugugccugcucaacaacuucuacccccgcgaggccaagguccaguggaagguggacaacgcgcugcaguccggcaacagccaggaguccgugaccgagcaggacagcaaggacuccaccuacagccuguccagcacccucacgcuguccaaggccgacuacgagaagcacaaggucuacgccugcgaggugacccaccaggggcugagcucccccgugaccaagagcuucaaccggggcgagugc

SEQ ID NO: 8546 - RNA, 1344 nt, Artificial Sequence
  derived and/or modified sequence opt1 from Ublituximab_HeavyChain1
caggccuaccugcagcagagcggcgccgagcucgugcgccccggggcguccgucaagaugagcugcaaggccuccggcuacaccuucaccagcuacaacaugcacugggugaagcagacgccgcggcaggggcuggaguggaucggcgggaucuaccccggcaacggcgacaccuccuacaaccagaaguucaaggggaaggccacccugaccgugggcaagagcuccagcacggccuacaugcagcucuccagccugaccuccgaggacagcgccgucuacuucugcgcgcgcuacgacuacaacuacgccauggacuacugggggcagggcaccuccgugaccgugagcuccgccagcacgaaggggcccuccgucuucccccuggccccgagcuccaagagcaccagcggcggcaccgcggcccucgggugccuggugaaggacuacuuccccgagcccgugaccgucuccuggaacagcggcgcccugacguccggggugcacaccuuccccgccgugcuccagagcuccggccuguacagccuguccagcgucgugaccgugccguccagcucccucggcacccagacguacaucugcaacgucaaccacaagcccagcaacaccaagguggacaagaagguggagcccaaguccugcgacaagacccacacgugcccgcccugccccgcccccgagcugcucgggggccccagcgucuuccuguucccgcccaagcccaaggacacccugaugaucucccggacccccgaggugaccugcguggucguggacgugagccacgaggacccggaggucaaguucaacugguacguggacggggucgaggugcacaacgcgaagaccaagccccgcgaggagcaguacaacuccacguaccggguggucagcgugcugaccgugcuccaccaggacuggcugaacggcaaggaguacaagugcaaggucuccaacaaggcccugcccgcccccaucgagaagaccaucagcaaggccaaggggcagccgcgcgagccccagguguacacccucccgcccagccgggacgagcugacgaagaaccaggugucccugaccugccucgucaagggcuucuaccccagcgacaucgccguggagugggaguccaacggccagcccgagaacaacuacaagaccacgcccccggugcuggacagcgacggguccuucuuccuguacagcaagcucaccgucgacaagucccgcuggcagcagggcaacguguucagcugcuccgugaugcacgaggcgcugcacaaccacuacacccagaagucccugagccucagccccgggaag

SEQ ID NO: 8547 - RNA, 639 nt, Artificial Sequence
  derived and/or modified sequence opt1 from Ublituximab_LightChain1
cagaucgugcugagccagucccccgccauccucagcgccucccccggcgagaaggucaccaugaccugccgcgcgagcuccagcguguccuacaugcacugguaccagcagaagcccgggagcucccccaagcccuggaucuacgccacgagcaaccuggccuccggcgugccggcccgguucagcggguccggcagcgggaccuccuacagcuucaccaucucccgcgucgaggccgaggacgcggccaccuacuacugccagcaguggacguucaacccgcccaccuucggcggcgggacccggcuggagaucaagcgcaccguggccgcccccagcguguucaucuucccgcccuccgacgagcagcucaagagcggcacggcgagcgucgugugccugcugaacaacuucuacccccgggaggccaaggugcaguggaaggucgacaacgcccuccaguccgggaacagccaggaguccgugaccgagcaggacagcaaggacuccaccuacagccuguccagcacccugacgcucuccaaggccgacuacgagaagcacaagguguacgccugcgaggucacccaccagggccugagcucccccgugaccaagagcuucaaccgcggggagugc

SEQ ID NO: 8548 - RNA, 1353 nt, Artificial Sequence
  derived and/or modified sequence opt1 from Ulocuplumab_HeavyChain1
gaggugcagcuggucgagagcggcgggggccucgugcagcccgggggcucccugcgccugagcugcgccgccgcgggguucaccuucuccagcuacuccaugaacugggugcggcaggccccgggcaagggccucgagugggucagcuacaucuccagccgcucccggaccaucuacuacgccgacagcgugaaggggcgcuucacgaucucccgggacaacgccaagaacagccuguaccugcagaugaacucccuccgcgacgaggacaccgccguguacuacugcgcgcgggacuacggcgggcagccgcccuacuacuacuacuacggcauggacgucugggggcagggcaccaccgugacggugagcuccgccagcaccaagggccccuccgucuucccccuggcccccugcagccgcuccaccagcgagagcaccgccgcgcuggggugccucgugaaggacuacuuccccgagcccgugacggucuccuggaacagcggcgcccugaccuccggggugcacaccuucccggccgugcugcagagcuccggccucuacagccuguccagcgucgugaccgugcccuccagcucccugggcacgaagaccuacacgugcaacgucgaccacaagcccagcaacaccaagguggacaagcggguggaguccaaguacgggcccccgugcccgcccugccccgcccccgaguuccucggcgggcccagcgucuuccuguucccgcccaagcccaaggacacccugaugaucucccgcacccccgaggugaccugcguggucguggacgucagccaggaggaccccgaggugcaguucaacugguacguggacggcgucgaggugcacaacgccaagaccaagccccgggaggagcaguucaacuccacguaccgcguggucagcgugcucaccgugcugcaccaggacuggcugaacgggaaggaguacaagugcaaggucuccaacaagggccucccgagcagcaucgagaagaccaucuccaaggcgaagggccagccccgggagccccagguguacacccugcccccgagccaggaggagaugacgaagaaccaggugucccugaccugccucgucaagggguucuaccccagcgacaucgccguggagugggaguccaacggccagcccgagaacaacuacaagaccaccccgcccgugcuggacagcgacggguccuucuuccuguacagccgccucacggucgacaagucccgguggcaggagggcaacguguucagcugcuccgugaugcacgaggcccugcacaaccacuacacccagaagucccugagccucagccugggg

SEQ ID NO: 8549 - RNA, 642 nt, Artificial Sequence
  derived and/or modified sequence opt1 from Ulocuplumab_LightChain1
gacauccagaugacccagagccccuccagccuguccgccagcgugggcgaccgcgucaccaucacgugccgggccucccaggggaucagcuccuggcucgcgugguaccagcagaagccggagaaggcccccaagagccugaucuacgccgccuccagccugcaguccggcgugcccagccgcuucuccgggagcggcuccgggaccgacuucacccucaccaucagcucccugcagcccgaggacuucgugacguacuacugccagcaguacaacagcuacccgcggaccuucggccagggcaccaaggucgagaucaagcgcaccguggccgcgcccuccguguucaucuucccgcccagcgacgagcagcucaagagcgggacggccuccgucgugugccugcugaacaacuucuacccccgggaggccaaggugcaguggaaggucgacaacgcccugcagagcggcaacucccaggagagcgugaccgagcaggacuccaaggacagcaccuacucccucagcuccacccugacgcugagcaaggcggacuacgagaagcacaagguguacgccugcgaggucacccaccaggggcucuccagccccgugaccaaguccuucaaccgcggcgagugc

SEQ ID NO: 8550 - RNA, 1344 nt, Artificial Sequence
  derived and/or modified sequence opt1 from Urelumab_HeavyChain1
caggugcagcugcagcaguggggcgccgggcuccugaagcccagcgagacccugucccugaccugcgccgucuacggcgggagcuucuccggcuacuacuggagcuggauccgccaguccccggagaaggggcucgaguggaucggcgagaucaaccacggcggguacgugacguacaaccccagccuggagucccgggugaccaucagcgucgacaccuccaagaaccaguucagccucaagcuguccagcgugaccgcggccgacacggccguguacuacugcgcccgcgacuacggccccgggaacuacgacugguacuucgaccuguggggccgggggacccucgucaccguguccagcgccuccaccaagggccccagcguguucccgcuggcgcccugcucccgcagcacguccgagagcaccgccgcccugggcugccucgucaaggacuacuuccccgagcccgugaccgugagcuggaacuccggggcccugaccagcggcguccacacguucccggcggugcugcaguccagcgggcucuacucccugagcuccguggucaccgugcccagcuccagccugggcaccaagaccuacacgugcaacguggaccacaagcccuccaacaccaaggucgacaagcggguggagagcaaguacgggcccccgugcccgcccugccccgcccccgaguuccucggcggccccuccguguuccuguucccgcccaagcccaaggacacccugaugaucagccgcacccccgaggucacgugcgugguggucgacgugucccaggaggaccccgagguccaguucaacugguacguggacgggguggagguccacaacgccaagaccaagccccgggaggagcaguucaacagcaccuaccgcgugguguccguccucaccgugcugcaccaggacuggcugaacggcaaggaguacaagugcaaggugagcaacaaggggcucccguccagcaucgagaagacgaucagcaaggccaagggccagccccgggagccccaggucuacacccugcccccgucccaggaggagaugaccaagaaccaggugagccugaccugccucgugaagggcuucuaccccuccgacaucgccgucgagugggagagcaacgggcagcccgagaacaacuacaagacgaccccgcccgugcuggacuccgacggcagcuucuuccuguacucccgccucaccguggacaagagccgguggcaggaggggaacgucuucuccugcagcgugaugcacgaggcgcugcacaaccacuacacccagaagucccugagccucucccugggcaag

SEQ ID NO: 8551 - RNA, 648 nt, Artificial Sequence
  derived and/or modified sequence opt1 from Urelumab_LightChain1
gagaucgugcugacccagagccccgccacccucucccugagccccggcgagcgcgccacgcuguccugccgggcgagccaguccgucagcuccuaccucgccugguaccagcagaagcccgggcaggcgccccgccugcugaucuacgacgccagcaaccgggccaccggcauccccgcccgcuucuccgggagcggcuccgggaccgacuucacccucacgaucagcucccuggagccggaggacuucgccguguacuacugccagcagcggagcaacuggccgcccgcccugaccuucugcggcggcaccaagguggagaucaagcgcaccgucgccgcgcccuccguguucaucuucccgcccagcgacgagcagcucaaguccgggacggccagcguggucugccugcugaacaacuucuacccccgggaggccaaggugcaguggaagguggacaacgcccuccaguccggcaacagccaggagagcgucaccgagcaggacuccaaggacagcaccuacucccugagcuccacccugacgcucagcaaggccgacuacgagaagcacaagguguacgcgugcgaggugacccaccaggggcuguccagccccgucaccaaguccuucaaccgcggcgagugc

SEQ ID NO: 8552 - RNA, 1347 nt, Artificial Sequence
  derived and/or modified sequence opt1 from Urtoxazumab_HeavyChain1
gaggugcagcuggucgagagcggcgggggccucgugcagcccgggggcucccugcgccugagcugcgccgccuccggguucaccuucagcuccuacggcaugagcugggugcggcaggcgccgggcaaggggcucgagugggucgccaccaucuccacgggcgggagcuacaccuacuaccccgacuccgugaagggccgcuucaccaucagccgggacaacgccaagaacacccuguaccugcagaugaacucccuccgcgccgaggacacggccguguacuacugcgcgcggcgcggggacgccuggggcaaccuggacuacuggggccaggggacccuggucaccgugagcuccgccagcaccaagggccccuccguguucccccucgccccgagcuccaagagcacguccgggggcaccgcggcccugggcugccuggucaaggacuacuuccccgagcccgugaccgugagcuggaacagcggggcccucaccuccggcguccacacguuccccgccgugcugcagagcuccgggcuguacagccucuccagcguggucaccgugccguccagcucccugggcacccagaccuacaucugcaacgugaaccacaagcccagcaacacgaaggucgacaagaagguggagcccaaguccugcgacaagacccacacgugcccgcccugccccgcccccgagcugcucgggggccccagcguguuccuguucccgcccaagcccaaggacacccugaugaucucccggacccccgaggugaccugcgucguggucgacgugagccacgaggacccggaggucaaguucaacugguacguggacggcguggagguccacaacgcgaagaccaagccccgcgaggagcaguacaacuccaccuaccggguggugagcguccucacggugcugcaccaggacuggcugaacgggaaggaguacaagugcaagguguccaacaaggcccuccccgcccccaucgagaagaccaucagcaaggccaagggccagccgcgcgagccccaggucuacacccugccgcccucccgggacgagcugaccaagaaccaggugagccucacgugccuggugaagggguucuaccccagcgacaucgccgucgagugggaguccaacggccagcccgagaacaacuacaagaccacgcccccggugcuggacagcgacggguccuucuuccucuacagcaagcugaccguggacaagucccgcuggcagcagggcaacgucuucagcugcuccgugaugcacgaggcgcugcacaaccacuacacccagaagucccucagccugagccccggcaag

SEQ ID NO: 8553 - RNA, 642 nt, Artificial Sequence
  derived and/or modified sequence opt1 from Urtoxazumab_LightChain1
gagaucgugcugacccagagccccgccacccucuccgucagcccgggcgagcgcgccacgcuguccugccgggcgagccagaccaucuccaacaaccugcacugguaccagcagaagcccgggcaggcgccccgccuccugaucaagagcgccucccagagcaucuccggcauccccgcccgguucagcggguccggcagcgggaccgacuucacccugacgaucuccagccucgaguccgaggacuucgccguguacuacugccagcagagcuacuccuggccgcugaccuucggccagggcaccaagguggagaucaagcgcaccgucgccgcccccagcguguucaucuucccgcccuccgacgagcagcucaagagcgggacggccagcguggucugccugcugaacaacuucuacccccgggaggccaaggugcaguggaagguggacaacgcgcugcaguccggcaacagccaggaguccgucaccgagcaggacagcaaggacuccaccuacagccucuccagcacccugacgcuguccaaggccgacuacgagaagcacaagguguacgccugcgaggugacccaccaggggcucagcucccccgucaccaagagcuucaaccgcggcgagugc

SEQ ID NO: 8554 - RNA, 1347 nt, Artificial Sequence
  derived and/or modified sequence opt1 from Ustekinumab_HeavyChain1
gaggugcagcugguccagagcggcgccgaggugaagaagcccggggagucccucaagaucagcugcaagggcuccggguacagcuucaccaccuacuggcugggcugggugcgccagaugcccgggaagggccuggacuggaucggcaucaugucccccgucgacagcgacauccgguacucccccagcuuccagggccaggugacgauguccguggacaagagcaucaccaccgccuaccuccaguggaacucccugaaggcgagcgacaccgccauguacuacugcgcccgccggcgccccgggcagggguacuucgacuucuggggccaggggacgcuggucaccguguccagcuccagcaccaagggcccguccguguucccccucgcccccagcuccaagagcaccagcggcgggacggccgcgcugggcugccuggucaaggacuacuuccccgagccggugaccguguccuggaacagcggggcccucaccuccggcguccacaccuuccccgccgugcugcagagcuccggccuguacagccucuccagcguggucacggugcccuccagcucccuggggacccagaccuacaucugcaacgugaaccacaagcccagcaacaccaaggucgacaagcggguggagccgaaguccugcgacaagacgcacacgugcccgcccugccccgcccccgagcugcucggcgggcccagcguguuccuguucccgcccaagcccaaggacacccugaugaucucccgcacccccgaggugaccugcgucguggucgacgugagccacgaggaccccgaggucaaguucaacugguacguggacggcguggagguccacaacgcgaagaccaagccccgggaggagcaguacaacuccaccuaccgcguggugagcguccucaccgugcugcaccaggacuggcugaacgggaaggaguacaagugcaagguguccaacaaggcccucccggcccccaucgagaagacgaucagcaaggccaagggccagccccgggagccccaggucuacacccugccgcccagccgcgacgagcugaccaagaaccaggugucccugaccugccucgugaagggcuucuaccccagcgacaucgccgucgagugggaguccaacgggcagccggagaacaacuacaagacgaccccgcccgugcuggacagcgacggcuccuucuuccucuacagcaagcugaccguggacaagucccgguggcagcaggggaacgucuucagcugcuccgugaugcacgaggcgcugcacaaccacuacacccagaagucccucagccugagccccggcaag

SEQ ID NO: 8555 - RNA, 642 nt, Artificial Sequence
  derived and/or modified sequence opt1 from Ustekinumab_LightChain1
gacauccagaugacccagagccccuccagccuguccgccagcgugggcgaccgcgucaccaucacgugccgggccucccaggggaucagcuccuggcucgcgugguaccagcagaagccggagaaggcccccaagagccugaucuacgccgccuccagccugcaguccggcgugcccagccgcuucuccgggagcggcuccgggaccgacuucacccucaccaucagcucccugcagcccgaggacuucgccacguacuacugccagcaguacaacaucuacccguacaccuucggccagggcaccaagcuggagaucaagcggaccguggcggcccccagcgucuucaucuucccgcccuccgacgagcagcucaagagcgggacggccagcguggugugccugcugaacaacuucuacccccgcgaggccaagguccaguggaagguggacaacgcgcuccaguccggcaacagccaggaguccgugaccgagcaggacagcaaggacuccaccuacagccuguccagcacccugacgcucuccaaggccgacuacgagaagcacaaggucuacgccugcgaggugacccaccaggggcugagcucccccgugaccaagagcuucaaccggggcgagugc

SEQ ID NO: 8556 - RNA, 1341 nt, Artificial Sequence
  derived and/or modified sequence opt1 from Vadastuximab_talirine_HeavyChain1
caggugcagcugguccagagcggcgccgaggugaagaagcccggggccuccgugaaggucagcugcaaggcguccggcuacaccuucaccaacuacgacaucaacugggugcgccaggccccggggcagggccucgaguggaucggguggaucuaccccggcgacggcagcaccaaguacaacgagaaguucaaggccaaggccacccugaccgccgacaccuccacgagcaccgcguacauggagcugcggucccuccgcagcgacgacaccgccguguacuacugcgccuccggguacgaggacgccauggacuacuggggccaggggaccacggucaccgugagcuccgcgagcaccaagggccccuccguguucccccuggccccgagcuccaagagcaccuccgggggcacggccgcccugggcugccucgucaaggacuacuuccccgagcccgugaccgugagcuggaacuccggggcccugaccagcggcguccacaccuuccccgcggugcugcagagcuccgggcucuacagccuguccagcguggucacggugccguccagcucccugggcacccagaccuacaucugcaacgugaaccacaagcccagcaacaccaaggucgacaagaagguggagcccaaguccugcgacaagacgcacacgugcccgcccugccccgcccccgagcuccugggcgggcccugcguguuccuguucccgcccaagcccaaggacacccucaugaucagccggacccccgaggugaccugcgucguggucgacgugucccacgaggacccggaggucaaguucaacugguacguggacggcguggagguccacaacgccaagaccaagccccgcgaggagcaguacaacagcaccuaccgggugguguccguccugaccgugcugcaccaggacuggcucaacgggaaggaguacaagugcaaggugagcaacaaggcccugcccgcccccaucgagaagacgaucuccaaggcgaagggccagccgcgcgagccccaggucuacacccugccgcccagccgggacgagcucaccaagaaccaggugucccugaccugccuggugaagggguucuaccccagcgacaucgccgucgagugggaguccaacggccagcccgagaacaacuacaagacgacgcccccggugcucgacagcgacggcagcuucuuccuguacuccaagcugaccguggacaagagccgcuggcagcaggggaacgucuucuccugcagcgugaugcacgaggcccuccacaaccacuacacccagaagucccugagccugucccccggcaag

SEQ ID NO: 8557 - RNA, 642 nt, Artificial Sequence
  derived and/or modified sequence opt1 from Vadastuximab_talirine_LightChain1
gacauccagaugacccagagccccuccagccuguccgccagcgugggcgaccgcgucaccaucaacugcaaggccucccaggacaucaacagcuaccucuccugguuccagcagaagccggggaaggcgcccaagacgcugaucuaccgggccaaccgccugguggacggcgugcccagccgguucuccgggagcggcuccgggcaggacuacacccucaccaucagcucccugcagcccgaggacuucgccaccuacuacugccugcaguacgacgaguucccgcucacguucggcggcgggaccaaggucgagaucaagcgcaccguggccgcccccagcguguucaucuucccgcccuccgacgagcagcucaagagcggcaccgcguccgucgugugccugcugaacaacuucuacccccgggaggccaaggugcaguggaaggucgacaacgcccugcagagcgggaacucccaggagagcgugacggagcaggacagcaaggacuccaccuacagccuguccagcacccucacccuguccaaggccgacuacgagaagcacaagguguacgcgugcgaggucacgcaccagggccugagcucccccgugaccaagagcuucaaccgcggggagugc

SEQ ID NO: 8558 - RNA, 1362 nt, Artificial Sequence
  derived and/or modified sequence opt1 from Vandortuzumab_vedotin_HeavyChain1
gaggugcagcuggucgagagcggcgggggccucgugcagcccgggggcucccugcgccugagcugcgccguguccggguacagcaucaccuccgacuacgccuggaacuggguccggcaggcgccgggcaagggccucgagugggugggguacaucagcaacuccggcagcaccuccuacaaccccagccugaagucccgcuucaccaucagccgggacaccuccaagaacacccuguaccuccagaugaacagccugcgcgccgaggacaccgccguguacuacugcgcccgggagcgcaacuacgacuacgacgacuacuacuacgccauggacuacugggggcagggcacgcuggucaccguguccagcgcguccaccaaggggcccagcguguucccccucgccccguccagcaagagcaccuccggcggcacggccgcccuggggugccuggucaaggacuacuuccccgagcccgugaccgugagcuggaacuccggcgcgcucaccagcgggguccacaccuuccccgccgugcugcaguccagcggccuguacucccucagcuccguggucacggugccgagcuccagccugggcacccagaccuacaucugcaacgugaaccacaagcccuccaacaccaaggucgacaagaagguggagcccaagagcugcgacaagacgcacacgugcccgcccugccccgcccccgagcugcucgggggccccuccguguuccuguucccgcccaagcccaaggacacccugaugaucagccggacccccgaggugaccugcgucguggucgacgugucccacgaggacccggaggucaaguucaacugguacguggacgggguggagguccacaacgccaagaccaagccccgcgaggagcaguacaacagcaccuaccgggugguguccguccucaccgugcugcaccaggacuggcugaacggcaaggaguacaagugcaaggugagcaacaaggcccuccccgcgcccaucgagaagacgaucagcaaggccaaggggcagccgcgcgagccccaggucuacacccugccgcccucccgggaggagaugaccaagaaccaggugagccugaccugccucgugaagggcuucuaccccuccgacaucgccgucgagugggagagcaacggccagcccgagaacaacuacaagacgacgcccccggugcuggacuccgacgggagcuucuuccuguacuccaagcucaccguggacaagagccgcuggcagcagggcaacgucuucuccugcagcgugaugcacgaggcccugcacaaccacuacacccagaagucccugagccucucccccgggaag

SEQ ID NO: 8559 - RNA, 660 nt, Artificial Sequence
  derived and/or modified sequence opt1 from Vandortuzumab_vedotin_LightChain1
gacauccagaugacccagagccccuccagccuguccgccagcgugggcgaccgcgucaccaucacgugcaaguccagccagucccuccuguaccggagcaaccagaagaacuaccuggccugguaccagcagaagccggggaaggcgcccaagcuccugaucuacugggccuccacccgcgagagcggcgugcccucccgguucagcggguccggcagcgggaccgacuucacccugacgaucuccagccuccagcccgaggacuucgccaccuacuacugccagcaguacuacaacuacccgcgcaccuucggccagggcaccaagguggagaucaagcggacggucgccgcccccuccguguucaucuucccgcccagcgacgagcagcugaaguccgggaccgcgagcguggucugccugcucaacaacuucuacccccgcgaggccaaggugcaguggaagguggacaacgcccugcagagcggcaacucccaggagagcgucaccgagcaggacuccaaggacagcaccuacucccugagcuccacgcucacccugagcaaggccgacuacgagaagcacaagguguacgcgugcgaggugacccaccaggggcuguccagccccgucaccaaguccuucaaccggggcgagugc

SEQ ID NO: 8560 - RNA, 1329 nt, Artificial Sequence
  derived and/or modified sequence opt1 from Vantictumab_HeavyChain1
gaggugcagcuggucgagagcggcgggggccucgugcagcccgggggcucccugcgccugagcugcgccgccuccggguucaccuucagccacuacacccucuccugggugcggcaggcgccgggcaagggccuggagugggucagcgugaucuccggggacggcagcuacacguacuacgccgacuccgugaaggggcgcuucaccaucagcuccgacaacagcaagaacacccuguaccuccagaugaacucccugcgggccgaggacaccgccgucuacuacugcgcccgcaacuucaucaaguacguguucgcgaacuggggccaggggacgcuggugaccgucagcuccgccagcaccaagggccccuccguguucccccucgcccccugcagccgguccaccagcgagagcacggccgcgcugggcugccuggugaaggacuacuucccggagcccgucaccguguccuggaacagcggggcccucaccuccggcgugcacaccuuccccgccguccugcagagcuccgggcuguacagccucuccagcguggugacgguccccuccagcaacuucggcacccagaccuacacgugcaacguggaccacaagccguccaacaccaagguggacaagaccgucgagcgcaagugcugcguggagugcccgcccugccccgccccgcccguggccggccccagcgucuuccuguucccgcccaagcccaaggacacccugaugaucucccggacccccgaggugacgugcgucgugguggacgucagccacgaggaccccgaggugcaguucaacugguacguggacggggucgaggugcacaacgcgaagaccaagccgcgcgaggagcaguucaacuccaccuuccggguggucagcgugcucaccgugguccaccaggacuggcugaacggcaaggaguacaagugcaagguguccaacaaggggcugcccgcccccaucgagaagacgaucagcaagaccaagggccagccccgcgagccccagguguacacccucccgcccucccgggaggagaugaccaagaaccaggucagccugacgugccuggugaagggguucuaccccagcgacaucgccguggagugggaguccaacggccagcccgagaacaacuacaagaccaccccgcccaugcucgacagcgacggcuccuucuuccuguacagcaagcugaccgucgacaagucccgcuggcagcaggggaacguguucagcugcuccgugaugcacgaggcccuccacaaccacuacacgcagaagucccugagccugagccccggc

SEQ ID NO: 8561 - RNA, 639 nt, Artificial Sequence
  derived and/or modified sequence opt1 from Vantictumab_LightChain1
gacaucgagcugacccagcccccgagcguguccgucgcccccggccagaccgcccgcaucagcugcuccggggacaacaucggcagcuucuacgugcacugguaccagcagaagcccgggcaggcgcccgugcucgucaucuacgacaaguccaaccggccgagcggcauccccgagcgcuucuccgggagcaacuccggcaacacggccacccugaccaucagcggcacccaggccgaggacgaggccgacuacuacugccaguccuacgccaacacgcugagccucguguucgggggcgggaccaagcugaccgugcugggccagcccaaggcggcccccuccgucacccucuucccgcccagcuccgaggagcugcaggccaacaaggccacgcuggugugccucaucagcgacuucuaccccggggcggugaccgucgccuggaaggccgacuccagccccgugaaggccggcguggagaccaccacgccguccaagcagagcaacaacaaguacgccgcgagcuccuaccugagccugacccccgagcaguggaagucccaccggagcuacuccugccaggucacccacgagggcagcaccguggagaagacgguggcccccaccgagugcucc

SEQ ID NO: 8562 - RNA, 1389 nt, Artificial Sequence
  derived and/or modified sequence opt1 from Vanucizumab_HeavyChain1
caggugcagcugguccagagcggcgccgaggugaagaagcccggggccuccgugaaggucagcugcaaggcguccggcuacaccuucaccggguacuacaugcacugggugcgccaggccccgggccaggggcucgaguggaugggcuggaucaaccccaacagcggcgggacgaacuacgcccagaaguuccagggccgggugaccaugacccgcgacaccuccaucagcacggccuacauggagcugucccggcugcgcagcgacgacaccgccgucuacuacugcgcgcggucccccaaccccuacuacuacgacagcuccggguacuacuacccgggcgccuucgacaucugggggcagggcaccauggugaccgugagcuccgccagcgucgccgcgcccuccguguucaucuucccgcccagcgacgagcagcucaaguccggcacggccagcguggucugccugcugaacaacuucuacccgcgcgaggccaaggugcaguggaagguggacaacgcccuccaguccgggaacagccaggagagcgucaccgagcaggacuccaaggacagcaccuacucccugagcuccacccugacgcucagcaaggccgacuacgagaagcacaagguguacgcgugcgaggugacccaccagggccuguccagccccgucaccaaguccuucaaccgcggggagugcgacaagacccacacgugcccgcccugccccgcccccgagcugcucggcggccccagcguguuccuguucccgcccaagcccaaggacacccugaugaucucccggacccccgaggugaccugcgucgugguggacgucagccacgaggaccccgaggugaaguucaacugguacgucgacgggguggaggugcacaacgccaagacgaagccgcgggaggagcaguacaacuccaccuaccgcgucgugagcgugcucaccguccugcaccaggacuggcugaacggcaaggaguacaagugcaagguguccaacaaggcccuccccgcccccaucgagaagaccaucagcaaggcgaaggggcagccccgggagccccaggugugcacgcugccgcccucccgcgacgagcugaccaagaaccaggucagccucuccugcgccgugaagggcuucuaccccagcgacaucgccguggagugggagagcaacgggcagcccgagaacaacuacaagaccaccccgcccguccuggacuccgacggcagcuucuuccugguguccaagcucacgguggacaagagccgguggcagcagggcaacgucuucuccugcagcgugaugcacgaggcccugcacaaccacuacacccagaagucccugagccucucccccgggaag

SEQ ID NO: 8563 - RNA, 1359 nt, Artificial Sequence
  derived and/or modified sequence opt1 from Vanucizumab_HeavyChain2
gaggugcagcuggucgagagcggcgggggccucgugcagcccgggggcucccugcgccugagcugcgccgccuccggguacaccuucaccaacuacggcaugaacugggugcggcaggcgccgggcaaggggcucgagugggucggcuggaucaacacguacaccggggagcccaccuacgccgccgacuucaagcgccgguucaccuucagccuggacacguccaagagcaccgccuaccugcagaugaacucccuccgcgccgaggacaccgcgguguacuacugcgccaaguacccccacuacuacggcagcucccacugguacuucgacgugugggggcagggcacccuggucacggugagcuccgccagcaccaagggccccuccguguucccgcuggcccccagcuccaagagcaccuccgggggcaccgcggcccucgggugccuggucaaggacuacuuccccgagcccgugacggugagcuggaacuccggcgcccugaccagcggcguccacaccuucccggccgugcuccagagcuccgggcuguacagccuguccagcguggucaccgugcccuccagcucccucggcacgcagaccuacaucugcaacgugaaccacaagcccagcaacaccaaggucgacaagaagguggagcccaaguccugcgacaagacccacacgugcccgcccugccccgcccccgagcugcucgggggcccgagcguguuccucuucccgcccaagcccaaggacacccugaugaucucccggacccccgaggugaccugcgucguggucgacgugagccacgaggaccccgaggucaaguucaacugguacguggacgggguggagguccacaacgcgaagacgaagccccgcgaggagcaguacaacuccaccuaccggguggugagcguccugaccgugcuccaccaggacuggcugaacggcaaggaguacaagugcaagguguccaacaaggcccugcccgccccgaucgagaagaccaucagcaaggccaagggccagccccgcgagccccaggucuacacgcugcccccgugccgggacgagcugaccaagaaccaggugucccuguggugccucgugaagggguucuaccccagcgacaucgccgucgagugggaguccaacggccagcccgagaacaacuacaagaccaccccgcccgugcuggacagcgacgggagcuucuuccuguacuccaagcucacgguggacaagagccgcuggcagcagggcaacgucuucuccugcagcgugaugcacgaggcgcugcacaaccacuacacccagaagucccugagccucucccccgggaag

SEQ ID NO: 8564 - RNA, 639 nt, Artificial Sequence
  derived and/or modified sequence opt1 from Vanucizumab_LightChain1
cagcccggccugacccagccgcccagcguguccgucgcccccgggcagaccgcccgcaucacgugcggcgggaacaacaucggcagcaaguccgugcacugguaccagcagaagcccgggcaggcgccggugcucgucguguacgacgacagcgaccggcccuccggcauccccgagcgcuucagcggcuccaacagcgggaacaccgccacccugaccaucucccggguggaggccggcgacgaggccgacuacuacugccaggucugggacagcuccagcgaccacuacguguucgggacgggcaccaaggugaccguccuguccagcgccuccaccaaggggcccagcguguucccgcucgcgcccuccagcaaguccacgagcggcggcaccgccgcccuggggugccuggugaaggacuacuuccccgagcccgucaccgugagcuggaacuccggcgcccucaccagcggggugcacacguucccggcgguccugcaguccagcggccuguacucccucagcuccguggugaccguccccagcuccagccugggcacccagaccuacaucugcaacgugaaccacaagcccuccaacacgaagguggacaagaaggucgagcccaagagcugc

SEQ ID NO: 8565 - RNA, 642 nt, Artificial Sequence; identical to SEQ ID NO: 7726
  derived and/or modified sequence opt1 from Vanucizumab_LightChain2

SEQ ID NO: 8566 - RNA, 1356 nt, Artificial Sequence
  derived and/or modified sequence opt1 from Varlilumab_HeavyChain1
caggugcagcuggucgagagcggcgggggcguggugcagcccgggcgcucccuccggcugagcugcgccgccuccggcuucaccuucagcuccuacgacaugcacuggguccgccaggcgccggggaagggccuggaguggguggccgugaucugguacgacggcagcaacaaguacuacgccgacuccgucaaggggcgguucaccaucagccgcgacaacuccaagaacacgcucuaccugcagaugaacagccugcgggccgaggacaccgccguguacuacugcgcgcgcggcuccgggaacuggggcuucuucgacuacugggggcagggcacccucgugaccgucagcuccgccagcacgaagggccccuccguguucccccuggcccccagcuccaagagcaccuccgggggcaccgccgcgcuggggugccucgugaaggacuacuucccggagcccgucaccgugagcuggaacagcggcgcccugacguccggcgugcacaccuuccccgccguccugcagagcuccgggcucuacagccuguccagcguggugaccguccccuccagcucccugggcacccagacguacaucugcaacgugaaccacaagccgagcaacaccaagguggacaagaaggucgagcccaaguccugcgacaagacccacacgugcccgcccugcccggcccccgagcuccucgggggccccagcguguuccuguucccgcccaagcccaaggacacccugaugaucucccggacccccgaggugaccugcgucguggucgacgugagccacgaggaccccgaggugaaguucaacugguacgucgacgggguggaggugcacaacgccaagaccaagccgcgcgaggagcaguacaacuccacguaccgggucgugagcgugcugaccguccugcaccaggacuggcucaacggcaaggaguacaagugcaagguguccaacaaggcgcugcccgcccccaucgagaagaccaucagcaaggccaagggccagccccgcgagccccagguguacacccugccgcccucccgggacgagcucacgaagaaccaggucagccugaccugccuggugaagggguucuaccccagcgacaucgccguggagugggaguccaacggccagcccgagaacaacuacaagaccaccccgcccguccucgacagcgacggguccuucuuccuguacagcaagcugacgguggacaagucccgcuggcagcagggcaacguguucagcugcuccgucaugcacgaggcccuccacaaccacuacacccagaagucccugagccugagccccgggaagggcuccagc

SEQ ID NO: 8567 - RNA, 642 nt, Artificial Sequence
  derived and/or modified sequence opt1 from Varlilumab_LightChain1
gacauccagaugacccagagccccuccagccuguccgccagcgugggcgaccgcgucaccaucacgugccgggccucccaggggaucagccgcuggcucgcgugguaccagcagaagccggagaaggcccccaagucccugaucuacgccgccagcucccugcagagcggcgugcccucccgguucagcggguccggcagcgggaccgacuucacccucaccaucuccagccugcagcccgaggacuucgccacguacuacugccagcaguacaacaccuacccgcgcaccuucggccagggcaccaagguggagaucaagcggacggucgcggcccccuccguguucaucuucccgcccagcgacgagcagcugaaguccgggaccgccagcguggucugccuccugaacaacuucuacccccgcgaggccaaggugcaguggaagguggacaacgcgcugcagagcggcaacucccaggagagcgucaccgagcaggacuccaaggacagcaccuacucccucagcuccacgcugacccugagcaaggccgacuacgagaagcacaagguguacgccugcgaggugacccaccaggggcucuccagccccgucaccaaguccuucaaccggggcgagugc

SEQ ID NO: 8568 - RNA, 1338 nt, Artificial Sequence
  derived and/or modified sequence opt1 from Vatelizumab_HeavyChain1
caggugcagcugcaggagagcggccccgggcucgucaagccguccgagacccugagccugaccugcacgguguccggcuucagccucaccaacuacgggauccacuggauccgccagccgcccggcaaggggcuggaguggcugggcgugaucugggcccggggcuucaccaacuacaacuccgcccucaugagccgccugaccaucuccaaggacaacagcaagaaccaggucucccugaagcucagcuccgugacggcggccgacaccgccguguacuacugcgcccgggccaacgacggggucuacuacgcgauggacuacuggggccaggggacccuggugaccgugagcuccgccagcacgaagggccccuccgucuucccccuggcccccugcagccgcuccaccagcgaguccaccgccgcgcucgggugccuggugaaggacuacuuccccgagcccgugaccgucagcuggaacagcggcgcccugacguccggcgugcacaccuucccggccgugcuccagagcuccgggcuguacagccuguccagcgucgugaccgugcccuccagcucccucggcaccaagacguacacgugcaacgucgaccacaagcccagcaacaccaagguggacaagcggguggaguccaaguacgggcccccgugccccagcugccccgcccccgaguuccugggcggcccguccgucuuccuguucccgcccaagcccaaggacacccucaugaucagccgcacccccgaggugaccugcguggucguggacgucucccaggaggaccccgaggugcaguucaacugguacguggacggggucgaggugcacaacgccaagaccaagccccgggaggagcaguucaacagcaccuaccgcguggucuccgugcugacggugcugcaccaggacuggcucaacggcaaggaguacaagugcaaggucagcaacaaggggcugcccuccagcaucgagaagaccaucagcaaggcgaagggccagccgcgggagccccagguguacacccugccgcccucccaggaggagaugaccaagaaccaggugagccucacgugccuggucaagggguucuaccccuccgacaucgccguggagugggagagcaacggccagcccgagaacaacuacaagaccacgcccccggugcuggacuccgacggcagcuucuuccucuacucccgccugaccgucgacaagagccgguggcaggaggggaacguguucuccugcagcgugaugcacgaggcccugcacaaccacuacacccagaagucccucagccugucccugggcaag

SEQ ID NO: 8569 - RNA, 639 nt, Artificial Sequence
  derived and/or modified sequence opt1 from Vatelizumab_LightChain1
gacuucgugaugacccagagccccgccuuccuguccgucaccccgggcgagaaggugacgaucacgugcagcgcccaguccagcgugaacuacauccacugguaccagcagaagcccgaccaggcgcccaagaagcucaucuacgacaccuccaagcuggccagcgggguccccucccgguucagcggcuccgggagcggcaccgacuacaccuucaccaucuccagccuggaggccgaggacgccgccaccuacuacugccagcaguggaccacgaacccgcucaccuucgggcagggcaccaagguggagaucaagcggaccguggcggcccccuccgucuucaucuucccgcccagcgacgagcagcugaaguccggcacggccagcguggugugccugcucaacaacuucuacccccgcgaggccaagguccaguggaagguggacaacgcgcugcaguccgggaacagccaggaguccgugaccgagcaggacagcaaggacagcaccuacucccugagcuccacccucacgcugagcaaggccgacuacgagaagcacaaggucuacgccugcgaggugacccaccagggccuguccagccccgugaccaaguccuucaaccgcggggagugc

SEQ ID NO: 8570 - RNA, 1353 nt, Artificial Sequence
  derived and/or modified sequence opt1 from Vedolizumab_HeavyChain1
caggugcagcugguccagagcggcgccgaggugaagaagcccggggccuccgugaaggucagcugcaagggcuccggguacaccuucaccagcuacuggaugcacugggugcgccaggcgccgggccagcggcucgaguggaucggggagaucgaccccuccgagagcaacacgaacuacaaccagaaguucaagggccgcgugacccugaccgucgacaucuccgccagcaccgccuacauggagcuguccagccuccgguccgaggacacggccguguacuacugcgcccgcggcggguacgacggcugggacuacgcgaucgacuacugggggcagggcacccuggugaccgucagcuccgccagcaccaaggggcccuccguguucccccuggccccgagcuccaagagcacguccggcggcaccgccgcgcucgggugccuggugaaggacuacuuccccgagcccgucaccgugagcuggaacagcggcgcccugaccuccggggugcacacguuccccgccguccuccagagcuccggccuguacagccuguccagcguggugaccgucccguccagcucccucggcacccagaccuacaucugcaacgugaaccacaagcccagcaacacgaagguggacaagaaggucgagcccaaguccugcgacaagacccacacgugcccgcccugccccgcccccgagcuggccggggcgcccagcguguuccuguucccgcccaagcccaaggacacccucaugaucucccggacccccgaggugaccugcgucguggucgacgugagccacgaggacccggaggugaaguucaacugguacgucgacggcguggaggugcacaacgccaagaccaagccccgcgaggagcaguacaacuccaccuaccgggucgugagcgugcugacgguccugcaccaggacuggcucaacgggaaggaguacaagugcaagguguccaacaaggcccugcccgcccccaucgagaagaccaucagcaaggccaagggccagccgcgcgagccccagguguacacccugccgcccucccgggacgagcucaccaagaaccaggucagccugacgugccuggugaagggguucuaccccagcgacaucgcgguggagugggaguccaacggccagcccgagaacaacuacaagaccacgcccccgguccucgacagcgacggcuccuucuuccuguacagcaagcugaccguggacaagucccgcuggcagcaggggaacguguucagcugcuccgucaugcacgaggcccuccacaaccacuacacccagaagucccugagccugagccccggcaag

SEQ ID NO: 8571 - RNA, 657 nt, Artificial Sequence
  derived and/or modified sequence opt1 from Vedolizumab_LightChain1
gacguggucaugacccagagcccccugucccucccggugacccccggcgagcccgccagcaucuccugccgcagcucccagagccuggccaaguccuacgggaacacguaccugagcugguaccuccagaagcccggccaguccccgcagcugcugaucuacgggaucagcaaccgguucuccggcgugcccgaccgcuucagcggguccggcagcggcaccgacuucacccucaagaucucccgggucgaggcggaggacguggggguguacuacugccugcagggcacccaccagcccuacacguucgggcagggcaccaaggucgagaucaagcgcaccguggccgcccccagcguguucaucuucccgcccuccgacgagcagcucaagagcgggaccgccuccgucgugugccugcugaacaacuucuacccccgggaggccaaggugcaguggaaggucgacaacgcgcugcagagcggcaacagccaggaguccgugacggagcaggacagcaaggacuccaccuacagccucuccagcacccugacccuguccaaggccgacuacgagaagcacaagguguacgccugcgaggucacgcaccagggccucagcucccccgugaccaagagcuucaaccgcggggagugc

SEQ ID NO: 8572 - RNA, 1353 nt, Artificial Sequence
  derived and/or modified sequence opt1 from Veltuzumab_HeavyChain1
caggugcagcugcagcagagcggcgccgaggucaagaagcccggguccagcgugaagguguccugcaaggccagcggcuacaccuucaccuccuacaacaugcacugggucaagcaggcgccggggcagggccucgaguggaucggggccaucuaccccggcaugggcgacaccagcuacaaccagaaguucaaggggaaggccacccugaccgccgacgaguccaccaacacggccuacauggagcugagcucccuccgcagcgaggacaccgcguucuacuacugcgcccgguccaccuacuacggcggggacugguacuucgacguguggggccaggggaccacggugaccgucagcuccgccagcaccaagggccccuccguguucccccuggccccgagcuccaagagcaccuccggcgggacggcggcccugggcugccucgugaaggacuacuuccccgagcccgucaccgugagcuggaacagcggggcccugaccuccggcgugcacaccuuccccgccguccugcagagcuccggccucuacagccuguccagcguggugacggucccguccagcucccuggggacccagaccuacaucugcaacgugaaccacaagcccagcaacaccaagguggacaagcgcgucgagcccaaguccugcgacaagacgcacacgugcccgcccugccccgcccccgagcuccugggcgggcccagcguguuccuguucccgcccaagcccaaggacacccucaugaucucccggacccccgaggugaccugcgucgugguggacgucagccacgaggacccggaggugaaguucaacugguacgucgacggcguggaggugcacaacgcgaagaccaagccccgcgaggagcaguacaacuccaccuaccgggucgugagcgugcugaccguccugcaccaggacuggcucaacgggaaggaguacaagugcaagguguccaacaaggcccugcccgcccccaucgagaagacgaucagcaaggccaagggccagccgcgcgagccccagguguacacccugccgcccucccgggaggagaugaccaagaaccaggucagccugaccugccucgugaagggcuucuaccccagcgacaucgccguggagugggaguccaacgggcagcccgagaacaacuacaagacgacgcccccgguccuggacagcgacggcuccuucuuccucuacagcaagcugaccguggacaagucccgcuggcagcaggggaacguguucagcugcuccgucaugcacgaggcgcugcacaaccacuacacccagaagucccucagccugagccccggcaag

SEQ ID NO: 8573 - RNA, 639 nt, Artificial Sequence
  derived and/or modified sequence opt1 from Veltuzumab_LightChain1
gacauccagcugacccagagccccuccagccucuccgccagcgugggcgaccgggucaccaugacgugccgggccuccagcuccgugagcuacauccacugguuccagcagaagcccgggaaggcgcccaagcccuggaucuacgccaccuccaaccuggccagcggcgugcccguccgcuucuccgggagcggcuccgggaccgacuacaccuucacgaucagcucccugcagccggaggacaucgccaccuacuacugccagcaguggaccagcaacccgcccaccuucggcggcgggacgaagcucgagaucaagcggaccguggccgcgcccuccguguucaucuucccgcccagcgacgagcagcugaaguccggcaccgccagcgucgugugccugcucaacaacuucuacccccgcgaggccaaggugcaguggaaggucgacaacgcccugcagagcgggaacucccaggagagcgugaccgagcaggacuccaaggacagcacguacucccugagcuccacccucacccugagcaaggcggacuacgagaagcacaagguguacgccugcgaggucacccaccagggccuguccagccccgugacgaaguccuucaaccgcggggagugc

SEQ ID NO: 8574 - RNA, 1359 nt, Artificial Sequence
  derived and/or modified sequence opt1 from Vesencumab_HeavyChain1
gaggugcagcuggucgagagcggcgggggccucgugcagcccgggggcucccugcgccugagcugcgccgccuccggguucaccuucagcuccuacgcgaugagcugggugcggcaggccccgggcaagggccucgagugggucucccagaucagccccgccgggggcuacaccaacuacgccgacuccgugaaggggcgcuucacgaucagcgccgacaccuccaagaacaccgcguaccugcagaugaacagccugcgggccgaggacaccgccguguacuacugcgcccgcggcgagcuccccuacuaccggauguccaaggucauggacgugugggggcagggcacgcuggugaccgucagcuccgcgagcaccaagggccccuccguguucccgcuggcccccagcuccaagagcaccagcgggggcacggccgcccucgggugccuggugaaggacuacuuccccgagcccgucaccguguccuggaacagcggcgcccugaccuccggcgugcacaccuucccggcgguccuccagagcuccgggcuguacagccuguccagcguggugacgguccccuccagcucccucggcacccagaccuacaucugcaacgugaaccacaagcccagcaacaccaagguggacaagaaggucgagcccaaguccugcgacaagacgcacacgugcccgcccugccccgcccccgagcugcucgggggcccgagcguguuccucuucccgcccaagcccaaggacacccugaugaucucccgcacccccgaggugaccugcgucguggucgacgugagccacgaggaccccgaggugaaguucaacugguacgucgacgggguggaggugcacaacgccaagaccaagccccgggaggagcaguacaacuccaccuaccgcgucgugagcgugcugaccguccuccaccaggacuggcugaacggcaaggaguacaagugcaagguguccaacaaggcccugcccgccccgaucgagaagacgaucagcaaggcgaagggccagccccgggagccccagguguacacccugcccccgagccgcgaggagaugaccaagaaccaggucucccugaccugccuggugaagggguucuaccccagcgacaucgccguggagugggaguccaacggccagcccgagaacaacuacaagacgaccccgcccguccucgacagcgacggguccuucuuccuguacagcaagcugaccguggacaagucccgguggcagcagggcaacguguucagcugcuccgucaugcacgaggcccuccacaaccacuacacccagaagucccugagccugagccccgggaag

SEQ ID NO: 8575 - RNA, 642 nt, Artificial Sequence
  derived and/or modified sequence opt1 from Vesencumab_LightChain1
gacauccagaugacccagagccccuccagccuguccgccagcgugggcgaccgcgucaccaucacgugccgggccucccaguacuucagcuccuaccucgcgugguaccagcagaagccggggaaggcccccaagcugcugaucuacggcgccagcucccgcgccagcggggugcccucccgguucagcggcuccgggagcggcaccgacuucacccucaccaucuccagccugcagcccgaggacuucgccacguacuacugccagcaguaccugggcuccccgcccaccuucgggcagggcaccaagguggagaucaagcgcaccgucgcggcccccagcguguucaucuucccgcccuccgacgagcagcucaagagcgggacggccagcguggucugccugcugaacaacuucuacccccgggaggccaaggugcaguggaagguggacaacgcgcuccaguccggcaacagccaggaguccgucaccgagcaggacagcaaggacuccaccuacagccuguccagcacccugacgcucuccaaggccgacuacgagaagcacaagguguacgccugcgaggugacccaccaggggcugagcucccccgucaccaagagcuucaaccgcggcgagugc

SEQ ID NO: 8576 - RNA, 1338 nt, Artificial Sequence
  derived and/or modified sequence opt1 from Visilizumab_HeavyChain1
caggugcagcugguccagagcggcgccgaggugaagaagcccggggccuccgugaaggucagcugcaaggcguccggcuacaccuucaucagcuacaccaugcacugggugcgccaggccccggggcagggccucgaguggaugggguacaucaacccccgguccggcuacacgcacuacaaccagaagcugaaggacaaggccacccugaccgccgacaagagcgccuccaccgcguacauggagcucagcucccugcgcagcgaggacacggccguguacuacugcgcccgguccgccuacuacgacuacgacggcuucgcguacugggggcagggcacccuggucaccgugagcuccgccagcaccaaggggcccuccguguucccccucgccccgugcagccgcuccacgagcgaguccaccgccgcccugggcugccuggucaaggacuacuuccccgagcccgugaccgugagcuggaacagcggggcgcucaccuccggcguccacacguuccccgccgugcugcagagcuccggccuguacagccucuccagcguggucaccgugccguccagcaacuucgggacccagaccuacacgugcaacguggaccacaagcccuccaacaccaaggucgacaagaccguggagcggaagugcugcguggagugcccgcccugccccgccccgcccgccgccgcgcccagcgucuuccuguucccgcccaagcccaaggacacccugaugaucucccgcacgcccgaggugaccugcguggucguggacgucagccacgaggaccccgaggugcaguucaacugguacguggacggcgucgaggugcacaacgccaagaccaagccccgggaggagcaguucaacuccaccuuccgcguggucagcgugcucacggugguccaccaggacuggcugaacgggaaggaguacaagugcaagguguccaacaagggccugcccgcccccaucgagaagaccaucagcaagaccaagggccagccgcgggagccccagguguacacccucccgcccucccgcgaggagaugacgaagaaccaggucagccugaccugccuggugaagggguucuaccccuccgacaucgccguggagugggagagcaacggccagcccgagaacaacuacaagaccacgcccccgaugcucgacagcgacggguccuucuuccuguacagcaagcugaccgucgacaagucccgguggcagcagggcaacguguucagcugcuccgugaugcacgaggcccuccacaaccacuacacccagaagucccugagccugagccccuccaag

SEQ ID NO: 8577 - RNA, 639 nt, Artificial Sequence
  derived and/or modified sequence opt1 from Visilizumab_LightChain1
gacauccagaugacccagagccccuccagccuguccgccagcgugggcgaccgggucaccaucacgugcuccgccagcuccagcguguccuacaugaacugguaccagcagaagccggggaaggcgcccaagcggcucaucuacgacaccagcaagcuggccuccggcgugcccagccgcuucuccgggagcggcuccgggaccgacuucacccugacgaucagcucccuccagcccgaggacuucgccaccuacuacugccagcaguggagcuccaacccgcccaccuucggcggcgggaccaaggucgagaucaagcggacgguggccgcccccagcguguucaucuucccgcccagcgacgagcagcugaaguccggcaccgcgagcgucgugugccugcucaacaacuucuacccccgcgaggccaaggugcaguggaaggucgacaacgcccugcaguccgggaacagccaggaguccgugaccgagcaggacagcaaggacuccaccuacagccuguccagcacgcucacccuguccaaggccgacuacgagaagcacaagguguacgcgugcgaggucacccaccagggccugagcucccccgugaccaagagcuucaaccgcggggagugc

SEQ ID NO: 8578 - RNA, 1353 nt, Artificial Sequence
  derived and/or modified sequence opt1 from Volociximab_HeavyChain
caggugcagcugaaggagagcggccccgggcucgucgccccgucccagagccuguccaucacgugcaccaucagcggcuucucccugaccgacuacggggugcacugggugcgccagccgcccggcaaggggcucgaguggcuggucgugaucuggagcgacggcuccagcaccuacaacuccgcccucaagagccggaugaccauccgcaaggacaacuccaagagccagguguuccugaucaugaacucccugcagaccgacgacagcgcgauguacuacugcgcccggcacggcacguacuacgggaugaccaccaccggcgacgcccuggacuacugggggcagggcacguccgucaccgugagcuccgccagcaccaaggggcccuccguguucccccucgcccccugcagccgcagcaccuccgagagcacggcggcccugggcugccuggucaaggacuacuuccccgagcccgugaccguguccuggaacagcggcgcccucaccuccgggguccacaccuucccggccgugcugcagagcuccggccuguacagccucuccagcguggucacggugcccuccagcucccuggggaccaagaccuacacgugcaacguggaccacaagcccagcaacaccaaggucgacaagcggguggaguccaaguacgggcccccgugccccagcugccccgcgcccgaguuccugggcggcccguccguguuccucuucccgcccaagcccaaggacacccugaugaucagccgcacccccgaggugaccugcgucguggucgacgugucccaggaggaccccgagguccaguucaacugguacguggacggcguggagguccacaacgccaagacgaagccccgggaggagcaguucaacagcaccuaccgcguggugagcguccugaccgugcuccaccaggacuggcugaacgggaaggaguacaagugcaagguguccaacaagggccugcccagcuccaucgagaagaccaucagcaaggccaaggggcagccgcgggagccccaggucuacacgcucccgcccucccaggaggagaugaccaagaaccaggugagccugaccugccuggugaagggcuucuaccccuccgacaucgccgucgagugggagagcaacggccagcccgagaacaacuacaagaccacgcccccggugcucgacuccgacgggagcuucuuccuguacucccgccugaccguggacaagagccgguggcaggagggcaacgucuucuccugcagcgugaugcacgaggcccuccacaaccacuacacccagaagucccugagccugucccucgggaag

SEQ ID NO: 8579 - RNA, 645 nt, Artificial Sequence
  derived and/or modified sequence opt1 from Volociximab_LightChain
cagaucgugcugacccagagccccgccaucauguccgccagccucggcgagcgggucaccaugacgugcaccgcguccagcuccgugagcuccaacuaccugcacugguaccagcagaagccggggagcgcccccaaccuguggaucuacuccaccagcaaccucgccuccggcgugcccgcccgguucagcggguccggcagcgggaccuccuacagccugacgaucuccagcauggaggccgaggacgcggccaccuacuacugccaccaguaccugcgcuccccgcccaccuucggcggcgggaccaagcucgagaucaagcggacggucgccgcccccagcguguucaucuucccgcccagcgacgagcagcugaaguccggcaccgcgagcguggucugccugcucaacaacuucuacccccgcgaggccaaggugcaguggaagguggacaacgcccugcaguccgggaacagccaggaguccgucaccgagcaggacagcaaggacuccaccuacagccuguccagcacgcucacccuguccaaggccgacuacgagaagcacaagguguacgccugcgaggugacccaccagggccugagcucccccgucaccaagagcuucaaccgcggggagugc

SEQ ID NO: 8580 - RNA, 1344 nt, Artificial Sequence
  derived and/or modified sequence opt1 from Vorsetuzumab_HeavyChain1
caggugcagcugguccagagcggcgccgaggugaagaagcccggggccuccgugaaggucagcugcaaggcguccggcuacaccuucaccaacuacgggaugaacugggugcgccaggccccgggccaggggcucaaguggaugggcuggaucaacacguacaccggcgagcccaccuacgccgacgccuucaaggggcgggugaccaugacgcgcgacaccagcaucuccaccgccuacauggagcugagccggcugcgcuccgacgacaccgcggucuacuacugcgcccgggacuacggcgacuacgggauggacuacuggggccaggggacgaccgugaccgugagcuccgccagcaccaagggccccuccgucuucccccucgccccgagcuccaagagcacguccggcgggaccgcggcccugggcugccuggugaaggacuacuuccccgagcccgugaccgucagcuggaacuccggggcccucaccagcggcgugcacacguuccccgccgugcugcaguccagcggccuguacagccucuccagcgucgugaccgugccguccagcucccuggggacccagaccuacaucugcaacgucaaccacaagcccagcaacacgaagguggacaagaagguggagcccaaguccugcgacaagacccacacgugcccgcccugccccgcccccgagcugcucggcgggcccagcgucuuccuguucccgcccaagcccaaggacacccugaugaucucccgcacccccgaggugaccugcguggucguggacgucagccacgaggacccggaggugaaguucaacugguacguggacggcgucgaggugcacaacgcgaagaccaagccccgggaggagcaguacaacuccaccuaccgcguggucagcgugcucacggugcugcaccaggacuggcugaacgggaaggaguacaagugcaaggucuccaacaaggcccuccccgcccccaucgagaagaccaucagcaaggccaagggccagccgcgggagccccagguguacacccugccgcccucccgcgacgagcugaccaagaaccaggugagccucacgugccuggucaagggcuucuaccccuccgacaucgccguggagugggagagcaacgggcagcccgagaacaacuacaagaccacgcccccggugcuggacuccgacggcagcuucuuccucuacagcaagcugaccgucgacaagucccgguggcagcaggggaacguguucagcugcuccgugaugcacgaggcgcugcacaaccacuacacccagaagucccucagccugagccccggcaag

SEQ ID NO: 8581 - RNA, 654 nt, Artificial Sequence
  derived and/or modified sequence opt1 from Vorsetuzumab_LightChain1
gacaucgugaugacccagagccccgacucccuggccgucagccucggcgagcgcgccaccaucaacugccgggcguccaagagcguguccacgagcggguacuccuucaugcacugguaccagcagaagccgggccagccgcccaagcugcugaucuaccucgccagcaaccuggaguccggggugcccgaccgcuucagcggcuccgggagcggcaccgacuucacccugaccaucuccagccuccaggccgaggacgucgccguguacuacugccagcacucccgggaggugcccuggacguucggccaggggaccaaggucgagaucaagcgcaccguggccgcgcccagcguguucaucuucccgcccuccgacgagcagcucaagagcggcaccgccuccgucgugugccugcugaacaacuucuacccccgggaggccaaggugcaguggaaggucgacaacgcccugcagagcgggaacagccaggaguccgugacggagcaggacagcaaggacuccaccuacagccuguccagcacccucacccuguccaaggcggacuacgagaagcacaagguguacgccugcgaggucacgcaccagggccugagcucccccgugaccaagagcuucaaccgcggggagugc

SEQ ID NO: 8582 - RNA, 1344 nt, Artificial Sequence; identical to SEQ ID NO: 8580
  derived and/or modified sequence opt1 from Vorsetuzumab_mafodotin_HeavyChain1

SEQ ID NO: 8583 - RNA, 654 nt, Artificial Sequence; identical to SEQ ID NO: 8581
  derived and/or modified sequence opt1 from Vorsetuzumab_mafodotin_LightChain1

SEQ ID NO: 8584 - RNA, 1347 nt, Artificial Sequence; identical to SEQ ID NO: 7806
  derived and/or modified sequence opt1 from Yttrium_(90Y)_clivatuzumab_tetraxetan_HeavyChain1

SEQ ID NO: 8585 - RNA, 645 nt, Artificial Sequence; identical to SEQ ID NO: 7807
  derived and/or modified sequence opt1 from Yttrium_(90Y)_clivatuzumab_tetraxetan_LightChain1

SEQ ID NO: 8586 - RNA, 1338 nt, Artificial Sequence
  derived and/or modified sequence opt1 from Yttrium_Y_90_epratuzumab_tetraxetan_HeavyChain1
caggugcagcugguccagagcggcgccgaggugaagaagcccggguccagcgugaaggucuccugcaaggccagcggcuacaccuucaccuccuacuggcuccacugggugcgccaggcgccggggcagggccuggaguggaucggguacaucaacccccggaacgacuacacggaguacaaccagaacuucaaggacaaggccaccaucaccgccgacgagagcaccaacacggccuacauggagcuguccagccuccgcuccgaggacaccgccuucuacuucugcgcgcggcgcgacaucaccaccuucuacuggggccagggcacgaccgugaccgucagcuccgccagcaccaaggggcccuccguguucccccuggccccgagcuccaagagcacguccggcgggaccgccgcgcugggcugccucgugaaggacuacuuccccgagcccgucaccgugagcuggaacuccggggcccugaccagcggcgugcacacguuccccgccguccugcagagcuccggccucuacagccuguccagcguggugaccgucccguccagcucccuggggacccagaccuacaucugcaacgugaaccacaagcccagcaacacgaagguggacaagcgggucgagcccaaguccugcgacaagacccacacgugcccgcccugccccgcccccgagcuccugggcgggcccagcguguuccuguucccgcccaagcccaaggacacccucaugaucucccgcacccccgaggugaccugcgucgugguggacgucagccacgaggacccggaggugaaguucaacugguacgucgacggcguggaggugcacaacgccaagaccaagccccgggaggagcaguacaacuccaccuaccgcgucgugagcgugcugacgguccugcaccaggacuggcucaacggcaaggaguacaagugcaagguguccaacaaggcgcugcccgcccccaucgagaagaccaucagcaaggccaaggggcagccgcgggagccccagguguacacccugccgcccucccgcgaggagaugaccaagaaccaggucagccucacgugccuggugaagggcuucuaccccuccgacaucgccguggagugggagagcaacgggcagcccgagaacaacuacaagaccacgcccccgguccuggacagcgacggcuccuucuuccucuacagcaagcugaccguggacaagucccgguggcagcaggggaacguguucagcugcuccgucaugcacgaggcccugcacaaccacuacacccagaagucccucagccugagccccggcaag

SEQ ID NO: 8587 - RNA, 657 nt, Artificial Sequence
  derived and/or modified sequence opt1 from Yttrium_Y_90_epratuzumab_tetraxetan_LightChain1
gacauccagcugacccagagccccuccagccucuccgccagcgugggcgaccgggucaccauguccugcaagagcucccagagcgugcuguacuccgccaaccacaagaacuaccuggcgugguaccagcagaagccggggaaggcccccaagcuccugaucuacugggccagcacgcgggaguccggcgugcccagccgcuucuccgggagcggcuccgggaccgacuucaccuucaccaucagcucccugcagcccgaggacaucgccacguacuacugccaccaguaccucagcuccuggaccuucggcggcgggaccaagguccagaucaagcggaccguggccgcgccgagcguguucaucuucccgcccagcgacgagcagcugaaguccggcacggccagcgucgugugccugcucaacaacuucuacccccgcgaggccaaggugcaguggaaggucgacaacgcccugcaguccgggaacagccaggaguccgugaccgagcaggacagcaaggacuccaccuacagccuguccagcacccucacgcuguccaaggcggacuacgagaagcacaagguguacgccugcgaggucacccaccagggccugagcucccccgugaccaagagcuucaaccgcggggagugc

SEQ ID NO: 8588 - RNA, 1326 nt, Artificial Sequence
  derived and/or modified sequence opt1 from Yttrium_Y_90_epratuzumab_HeavyChain1
caggugcagcugguccagagcggcgccgaggugaagaagcccggguccagcgugaaggucuccugcaaggccagcggcuacaccuucaccuccuacuggcuccacugggugcgccaggcgccggggcagggccuggaguggaucggguacaucaacccccggaacgacuacacggaguacaaccagaacuucaaggacaaggccaccaucaccgccgacgagagcaccaacacggccuacgagcuguccagccuccgcuccgaggacaccgccuucuacuucugcgcgcggcgcgacaucaccaccuucuacuggggccagggcacgaccgugaccgucagcuccgccagcaccaaggggcccuccguguucccccuggccccgagcuccaagagcacguccggcgggaccgccgcgcugggcugccucgugaaggacuacuuccccgagcccgucaccgugagcuggaacuccggggcccugaccagcggcgugcacacguuccccgccguccugcagagcuccggccucuacagccuguccagcguggugaccgucccguccagcucccuggggacccagaccuacaucugcaacgugaaccacaagcccagcaacacgaagguggacaagcgggucgagcccaaguccugcgacaagacccacacgugcccgcccugccccgcccccgagcuccugggcgggcccagcguguuccuguucccgcccaagcccaaggacacccucaucucccgcacccccgaggugaccugcgucgugguggacgucagccacgaggacccggaggugaaguucaacugguacgucgacggcguggaggugcacaacgccaagaccaagccccgggaggagcaguacaacuccaccuaccgcgucgugagcgugcugacgguccugcaccaggacuggcucaacggcaaggaguacaagugcaagguguccaacaaggcgcugcccgcccccaucgagaagaccaucagcaaggccaaggggcagccgcgggagccccagguguacacccugccgcccucccgcgaggagaccaagaaccaggucagccucacgugccuggugaagggcuucuaccccuccgacaucgccguggagugggagagcaacgggcagcccgagaacaacuacaagaccacgcccccgguccuggacagcgacggcuccuucuuccucuacagcaagcugaccguggacaagucccgguggcagcaggggaacguguucagcugcuccguccacgaggcccugcacaaccacuacacccagaagucccucagccugagccccggcaag

SEQ ID NO: 8589 - RNA, 654 nt, Artificial Sequence
  derived and/or modified sequence opt1 from Yttrium_Y_90_epratuzumab_LightChain1
gacauccagcugacccagagccccuccagccucuccgccagcgugggcgaccgggucaccuccugcaagagcucccagagcgugcuguacuccgccaaccacaagaacuaccuggcgugguaccagcagaagccggggaaggcccccaagcuccugaucuacugggccagcacgcgggaguccggcgugcccagccgcuucuccgggagcggcuccgggaccgacuucaccuucaccaucagcucccugcagcccgaggacaucgccacguacuacugccaccaguaccucagcuccuggaccuucggcggcgggaccaagguccagaucaagcggaccguggccgcgccgagcguguucaucuucccgcccagcgacgagcagcugaaguccggcacggccagcgucgugugccugcucaacaacuucuacccccgcgaggccaaggugcaguggaaggucgacaacgcccugcaguccgggaacagccaggaguccgugaccgagcaggacagcaaggacuccaccuacagccuguccagcacccucacgcuguccaaggcggacuacgagaagcacaagguguacgccugcgaggucacccaccagggccugagcucccccgugaccaagagcuucaaccgcggggagugc

SEQ ID NO: 8590 - RNA, 1365 nt, Artificial Sequence
  derived and/or modified sequence opt1 from Zalutumumab_HeavyChain1
caggugcagcuggucgagagcggcgggggcguggugcagcccgggcgcucccuccggcugagcugcgccgccuccggcuucaccuucagcaccuacgggaugcacuggguccgccaggcgccgggcaagggccuggaguggguggccgugaucugggacgacggguccuacaaguacuacggcgacagcgucaaggggcgguucacgaucucccgcgacaacagcaagaacacccucuaccugcagaugaacucccugcgggccgaggacaccgccguguacuacugcgcccgcgacggcaucaccauggugcgcggggucaugaaggacuacuucgacuacuggggccagggcacgcucgugaccgugagcuccgcgagcaccaaggggcccuccgucuucccccuggcccccagcuccaagagcaccuccggcgggacggccgcccugggcugccucgugaaggacuacuucccggagcccgugaccgucagcuggaacuccggcgcgcugaccagcggggugcacaccuuccccgccgugcugcagagcuccggccucuacagccuguccagcgucgugacggugcccuccagcucccuggggacccagaccuacaucugcaacgucaaccacaagccgagcaacaccaagguggacaagcggguggagcccaaguccugcgacaagacgcacacgugcccgcccugcccggcccccgagcuccugggcgggcccagcgucuuccuguucccgcccaagcccaaggacacccucaugaucucccggacccccgaggugaccugcgucgugguggacgucagccacgaggaccccgaggugaaguucaacugguacguggacggcgucgaggugcacaacgccaagaccaagccgcgcgaggagcaguacaacuccaccuaccggguggucagcgugcugaccgugcugcaccaggacuggcucaacggcaaggaguacaagugcaaggucuccaacaaggcccugcccgcgcccaucgagaagacgaucagcaaggccaaggggcagccccgcgagccccagguguacacccugccgcccucccgggaggagaugaccaagaaccaggugagccugaccugccucgucaagggcuucuaccccuccgacaucgccguggagugggagagcaacgggcagcccgagaacaacuacaagacgaccccgcccgugcuggacagcgacggcuccuucuuccucuacagcaagcugaccgucgacaagucccgcuggcagcaggggaacguguucagcugcuccgugaugcacgaggcccugcacaaccacuacacccagaagucccucagccugagccccggcaag

SEQ ID NO: 8591 - RNA, 642 nt, Artificial Sequence
  derived and/or modified sequence opt1 from Zalutumumab_LightChain1
gccauccagcugacccagagccccuccagccucuccgccagcgugggcgaccgcgucaccaucacgugccgggcgucccaggacaucagcuccgcccuggugugguaccagcagaagccggggaaggcccccaagcugcucaucuacgacgccagcucccuggagagcggcgugcccucccgcuucagcggguccgagagcggcaccgacuucacccugaccaucuccagccuccagcccgaggacuucgccacguacuacugccagcaguucaacuccuacccgcugaccuucgggggcggcaccaaggucgagaucaagcggaccguggcggcccccagcguguucaucuucccgcccuccgacgagcagcucaagagcgggacggccagcgucgugugccugcugaacaacuucuacccccgcgaggccaaggugcaguggaaggucgacaacgcgcugcaguccggcaacagccaggaguccgugaccgagcaggacagcaaggacuccaccuacagccucuccagcacccugacgcuguccaaggccgacuacgagaagcacaagguguacgccugcgaggucacccaccaggggcucagcucccccgugaccaagagcuucaaccggggcgagugc

SEQ ID NO: 8592 - RNA, 1332 nt, Artificial Sequence
  derived and/or modified sequence opt1 from Zanolimumab_H0_HeavyChain
caggugcagcugcagcaguggggcgccgggcuccugaagcccagcgagacccugucccugaccugcgccgucuacggcgggagcuucuccggcuacuacuggagcuggauccgccagccgcccgggaagggccuggaguggaucggcgagaucaaccacuccgggagcacgaacuacaaccccucccucaagagccgggugaccaucuccguggacaccagcaagaaccaguucucccucaagcugagcuccgucaccgcggccgacacggccguguacuacugcgcccgcgugaucaacugguucgaccccuggggccaggggacccuggucaccgugagcuccgccagcaccaagggccccuccguguucccccucgcgcccagcuccaagagcacgagcgggggcaccgccgcccugggcugccuggucaaggacuacuuccccgagccggugaccguguccuggaacagcggggcccucaccuccggcguccacacguuccccgcggugcugcagagcuccgggcuguacagccucuccagcuggaccgugcccuccagcucccugggcacccagaccuacaucugcaacgucaacuucaucaagcccagcaacacgaagguggacaagaagguggagccgaaguccugcgacaagacccacacgugcccgcccugccccgcccccgagcugcucggcgggcccagcgucuuccuguucccgcccaagcccaaggacacccugaugaucucccggacccccgaggugaccugcgugugggacgucagccacgaggaccccgaggugaaguucaacugguacguggacggcgucgaggugcacaacgccaagaccaagccccgcgaggagcaguacaacuccaccuaccgggucgugagcgugcucacgguccugcaccaggacuggcugaacgggaaggaguacaagugcaagguguccaacaaggcccucccggcccccaucgagaagaccaucagcaaggcgaagggccagccccgcgagccccagguguacacccugccgcccagccgggaggagaugaccaagaaccaggucucccugacgugccucgugaagggguucuaccccagcgacaucgccguggagugggaguccaacggccagccggagaacaacuacaagaccaccccgcccguccuggacagcgacggcuccuucuuccuguacagcaagcucaccguggacaagucccgcuggcagcaggggaacguguucagcugcuccgucaugcacgaggcccugcacaaccacuacacgcagaagucccugagccucagccccggcaag

SEQ ID NO: 8593 - RNA, 642 nt, Artificial Sequence
  derived and/or modified sequence opt1 from Zanolimumab_L0_LightChain
gacauccagaugacccagagccccuccagcguguccgccagcgucggcgaccgggugaccaucacgugccgggccucccaggacaucagcuccuggcuggcgguggucuaccagcacaagccggggaaggcccccaagcuccugaucuacgccgccagcucccugcagagcggcgugcccucccgcuucagcggguccggcagcgggaccgacuucacccucaccaucuccagccugcagcccgaggacuucgccacguacuacugccagcaggcgaacuccuucccguacaccuucggcggcgggaccaagcuggagaucaagcggaccguggccgcccccagcgucuucaucuucccgcccuccgacgagcagcucaagagcggcacggccagcguggugugccugcugaacaacuucuacccccgcgaggcgaagguccaguggaagguggacaacgcccuccaguccgggaacagccaggaguccgugaccgagcaggacagcaaggacuccaccuacagccuguccagcacccugacgcucuccaaggccgacuacgagaagcacaaggucuacgccugcgaggugacccaccagggccugagcucccccgugaccaaguucaaccgcggggagugc

SEQ ID NO: 8594 - RNA, 1344 nt, Artificial Sequence; identical to SEQ ID NO: 8213
  derived and/or modified sequence opt1 from Zatuximab_HeavyChain1

SEQ ID NO: 8595 - RNA, 657 nt, Artificial Sequence; identical to SEQ ID NO: 8214
  derived and/or modified sequence opt1 from Zatuximab_LightChain1

SEQ ID NO: 8596 - RNA, 1356 nt, Artificial Sequence
  derived and/or modified sequence opt1 from Actoxumab_HeavyChain
caggugcagcuggucgagagcggcgggggcguggugcagcccgggcgcucccuccggcugagcugcgccgccuccggcuucagcuucuccaacuacgggaugcacuggguccgccaggcgccgggcaagggccuggaguggguggcccucaucugguacgacgggagcaacgaggacuacaccgacuccgugaagggccgguucaccaucagccgcgacaacuccaagaacacgcuguaccugcagaugaacagccuccgggccgaggacaccgccgucuacuacugcgcccgcugggggauggugcggggcgugaucgacgucuucgacaucugggggcagggcaccguggugaccgucuccagcgcguccacgaagggccccagcguguucccccuggcccccuccagcaaguccaccagcgggggcaccgccgcccuggggugccucgugaaggacuacuucccggagcccgucaccguguccuggaacagcggcgcgcugacgagcggcgugcacaccuuccccgccguccugcaguccagcgggcucuacucccugagcuccguggugaccguccccagcuccagccugggcacccagacguacaucugcaacgugaaccacaagccguccaacaccaagguggacaagcgcgucgagcccaagagcugcgacaagacccacacgugcccgcccugcccggcccccgagcuccucgggggccccuccguguuccuguucccgcccaagcccaaggacacccucaugaucagccggacccccgaggugaccugcgucguggucgacgugucccacgaggaccccgaggugaaguucaacugguacgucgacgggguggaggugcacaacgccaagaccaagccgcgcgaggagcaguacaacagcacguaccgggucguguccgugcugaccguccugcaccaggacuggcucaacggcaaggaguacaagugcaaggugagcaacaaggcccugcccgcgcccaucgagaagaccaucuccaaggccaagggccagccccgcgagccccagguguacacccugccgcccagccgggaggagaugacgaagaaccaggucucccugaccugccuggugaagggguucuaccccagcgacaucgccguggagugggagagcaacggccagcccgagaacaacuacaagaccaccccgcccguccuggacuccgacgggagcuucuuccucuacuccaagcugacgguggacaagagccgcuggcagcagggcaacguguucuccugcagcgucaugcacgaggcccugcacaaccacuacacccagaagucccucagccugucccccgggaag

SEQ ID NO: 8597 - RNA, 642 nt, Artificial Sequence
  derived and/or modified sequence opt1 from Actoxumab_LightChain
gacauccagaugacccagagccccuccagcguguccgccagcgucggcgaccgggugaccaucacgugccgggccucccaggggaucagcuccuggcuggcgugguaccagcacaagccgggcaaggcccccaagcuccugaucuacgccgccagcucccugcagagcggggugcccucccgcuucagcggcuccgggagcggcaccgacuucacccucaccaucuccagccugcagcccgaggacuucgccacguacuacugccagcaggcgaacuccuucccguggaccuucggccaggggaccaaggucgagaucaagcggaccguggccgcccccagcguguucaucuucccgcccuccgacgagcagcucaagagcggcacggccagcgucgugugccugcugaacaacuucuacccccgcgaggcgaaggugcaguggaaggucgacaacgcccugcaguccgggaacagccaggaguccgugaccgagcaggacagcaaggacuccaccuacagccucuccagcacccugacgcuguccaaggccgacuacgagaagcacaagguguacgccugcgaggucacccaccagggccucagcucccccgugaccaagagcuucaaccgcggggagugc

SEQ ID NO: 8598 - RNA, 1326 nt, Artificial Sequence
  derived and/or modified sequence opt1 from Andecaliximab_HeavyChain
caggugcagcugcaggagagcggccccgggcucgucaagccguccgagacccugagccugaccugcacgguguccggcuucagccuccuguccuacggggugcacuggguccgccagccgcccggcaaggggcuggaguggcucggcgugaucuggaccggcgggaccaccaacuacaacagcgcccugaugucccgguucacgaucagcaaggacgacuccaagaacaccguguaccugaagaugaacagccucaagaccgaggacaccgccaucuacuacugcgcgcgcuacuacuacggcauggacuacugggggcagggcacgcuggucaccguguccagcgccuccaccaaggggcccagcguguucccccuggcccccugcucccggagcaccuccgagagcacggccgcccucggcugccuggucaaggacuacuuccccgagcccgugaccguguccuggaacagcggcgcgcugaccagcgggguccacaccuucccggccgugcuccaguccagcggccuguacucccugagcuccguggucacggugcccagcuccagccucgggaccaagaccuacacgugcaacguggaccacaagcccuccaacaccaaggucgacaagcgcguggagagcaaguacgggcccccgugcccgcccugccccgcccccgaguuccugggcggccccuccguguuccuguucccgcccaagcccaaggacacccucaugaucagccggacccccgaggugaccugcgucguggucgacgugucccaggaggaccccgagguccaguucaacugguacguggacggcguggagguccacaacgccaagacgaagccccgcgaggagcaguucaacagcaccuaccgggugguguccguccugaccgugcugcaccaggacuggcucaacgggaaggaguacaagugcaaggugagcaacaagggccugccguccagcaucgagaagaccaucuccaaggcgaaggggcagccccgcgagccccaggucuacacgcugcccccgagccaggaggagaugaccaagaaccaggugagccugaccugccucgugaagggcuucuaccccuccgacaucgccgucgagugggagagcaacggccagcccgagaacaacuacaagaccacgccgcccgugcuggacuccgacgggagcuucuuccucuacucccggcugaccguggacaagagccgcuggcaggagggcaacgucuucuccugcagcgugaugcacgaggcccugcacaaccacuacacccagaagucccucagccugucccuggggaag

SEQ ID NO: 8599 - RNA, 642 nt, Artificial Sequence
  derived and/or modified sequence opt1 from Andecaliximab_LightChain
gacauccagaugacgcagagccccuccagccuguccgccagcgugggcgaccgcgucaccaucacgugcaaggccucccaggacgugcggaacaccguggcgugguaccagcagaagccggggaaggcccccaagcuccugaucuacagcuccagcuaccgcaacaccggcguccccgaccgguucuccgggagcggcuccgggaccgacuucacgcugaccaucagcucccuccaggccgaggacguggccguguacuacugccagcagcacuacaucacccccuacaccuucggcggcgggacgaaggucgagaucaagcgcaccguggccgcgccgagcguguucaucuucccgcccuccgacgagcagcucaagagcggcaccgccuccgucgugugccugcugaacaacuucuacccccgggaggccaaggugcaguggaaggucgacaacgcccugcagagcgggaacucccaggagagcgugaccgagcaggacagcaaggacuccacguacagccuguccagcacccucacccuguccaaggcggacuacgagaagcacaagguguacgccugcgaggucacccaccagggccugagcucccccgugaccaagagcuucaaccgcggggagugc

SEQ ID NO: 8600 - RNA, 1353 nt, Artificial Sequence
  derived and/or modified sequence opt1 from Aprutumab_HeavyChain
gaggugcagcugcucgagagcggcgggggccugguccagcccgggggcucccugcgccucagcugcgccgccuccggguucaccuucagcuccuacgcgaugagcugggugcggcaggccccgggcaagggccuggaguggguguccgccaucagcggguccggcaccagcaccuacuacgccgacuccgucaaggggcgcuucaccaucagccgggacaacuccaagaacacccuguaccuccagaugaacagccugcgcgccgaggacaccgcgguguacuacugcgcccgggugcgcuacaacuggaaccacggcgacugguucgaccccugggggcagggcacgcuggucaccguguccagcgccuccaccaagggccccagcguguucccccucgccccguccagcaagagcaccuccgggggcacggcggcccuggggugccuggucaaggacuacuuccccgagcccgugaccgugagcuggaacuccggcgcccucaccagcggcguccacaccuuccccgccgugcugcaguccagcgggcuguacucccucagcuccguggucacggugccgagcuccagccugggcacccagaccuacaucugcaacgugaaccacaagcccuccaacaccaaggucgacaagaagguggagcccaagagcugcgacaagacgcacacgugcccgcccugccccgcccccgagcugcucgggggccccuccguguuccuguucccgcccaagcccaaggacacccugaugaucagccggacccccgaggugaccugcgucguggucgacgugucccacgaggacccggaggucaaguucaacugguacguggacgggguggagguccacaacgcgaagaccaagccccgcgaggagcaguacaacagcaccuaccgggugguguccguccucaccgugcugcaccaggacuggcugaacggcaaggaguacaagugcaaggugagcaacaaggcccuccccgcccccaucgagaagacgaucagcaaggccaagggccagccgcgcgagccccaggucuacacccugccgcccucccgggacgagcugaccaagaaccaggugagccugaccugccucgugaagggguucuaccccuccgacaucgccgucgagugggagagcaacggccagcccgagaacaacuacaagacgacgcccccggugcuggacuccgacgggagcuucuuccucuacuccaagcugaccguggacaagagccgcuggcagcagggcaacgucuucuccugcagcgugaugcacgaggcgcugcacaaccacuacacccagaagucccucagccugucccccggg

SEQ ID NO: 8601 - RNA, 648 nt, Artificial Sequence
  derived and/or modified sequence opt1 from Aprutumab_LightChain
cagagcgugcugacccagcccccguccgccagcggcacccccgggcagcgcgucacgaucuccugcagcggcuccagcuccaacaucgggaacaacuacgugagcugguaccagcagcuccccggcaccgcccccaagcugcugaucuacgagaacuacaaccggccggcgggggugcccgaccgcuucuccggcagcaaguccggcaccagcgccucccucgccaucagcgggcugcgguccgaggacgaggccgacuacuacugcagcuccugggacgacagccugaacuacugggucuucggcgggggcaccaagcucacggugcuggggcagcccaaggccgcgcccuccgugacccuguucccgcccagcagcgaggagcuccaggccaacaaggccacccuggucugccugaucuccgacuucuaccccggcgccgugaccguggcguggaaggccgacagcucccccgucaaggccggcguggagacgaccaccccgagcaagcaguccaacaacaaguacgccgccagcuccuaccucagccugacccccgagcaguggaagucccaccgcagcuacuccugccaggugacgcacgaggggagcaccgucgagaagaccguggcgcccaccgagugcucc

SEQ ID NO: 8602 - RNA, 1341 nt, Artificial Sequence
  derived and/or modified sequence opt1 from Azintuxizumab_HeavyChain
gaggugcagcuggucgagagcggcgggggccucgugcagcccgggggcucccugcgccugagcugcgccgccuccggguucaccuucagcgacuacuacauggcgugggugcggcaggccccgggcaagggccucgagugggucgccuccaucaacuacgacgggagcuccaccuacuacguggacagcgugaagggccgcuucacgaucucccgggacaacgccaagaacagccuguaccugcagaugaacucccuccgcgccgaggacaccgcggucuacuacugcgcccgggaccgcggguacuacuucgacuacuggggccaggggaccaccgugacggugagcuccgccagcaccaagggccccuccgucuucccccuggcccccagcuccaagagcaccuccggcgggaccgcggcccugggcugccucgugaaggacuacuucccggagcccgugacggucagcuggaacagcggggcccugaccuccggcgugcacaccuuccccgccgugcugcagagcuccggccucuacagccuguccagcgucgugaccgugcccuccagcucccuggggacgcagaccuacaucugcaacgucaaccacaagccgagcaacaccaagguggacaagaagguggagcccaaguccugcgacaagacccacacgugcccgcccugcccggcccccgagcuccugggcgggcccagcgucuuccuguucccgcccaagcccaaggacacccucaugaucucccggacccccgaggugaccugcguggucguggacgucagccacgaggaccccgaggugaaguucaacugguacguggacggcgucgaggugcacaacgcgaagacgaagccgcgcgaggagcaguacaacuccaccuaccggguggucagcgugcugaccgugcugcaccaggacuggcucaacgggaaggaguacaagugcaaggucuccaacaaggcccugcccgcccccaucgagaagaccaucagcaaggccaagggccagccccgcgagccccagguguacacgcugccgcccucccgggaggagaugaccaagaaccaggugagccugaccugccucgucaagggcuucuaccccagcgacaucgccguggagugggaguccaacgggcagcccgagaacaacuacaagaccacgccgcccgugcuggacagcgacggcuccuucuuccucuacagcaagcugaccgucgacaagucccgcuggcagcaggggaacguguucagcugcuccgugaugcacgaggcgcugcacaaccacuacacccagaagucccucagccugagccccggcaag

SEQ ID NO: 8603 - RNA, 660 nt, Artificial Sequence
  derived and/or modified sequence opt1 from Azintuxizumab_LightChain
gacguggucaugacccagacgccccugagccucuccgugacccccggccagcccgccagcaucuccugccgcagcucccagagccuggugcacuccaacgggaacaccuaccugcacugguaccuccagaagcccggccagagcccccagcugcugaucuacaaggucuccaaccgguucagcggggugccggaccgcuucuccggcagcggguccggcaccgacuucacccucaagaucagccggguggaggccgaggacgucggcguguacuucugcucccagagcacgcacgugccgcccuucaccuucgggggcgggaccaaggucgagaucaagcgcaccguggcggcccccuccguguucaucuucccgcccagcgacgagcagcugaaguccggcacggccagcgucgugugccugcucaacaacuucuacccccgggaggccaaggugcaguggaaggucgacaacgcccugcagagcgggaacucccaggagagcgugaccgagcaggacuccaaggacagcaccuacucccugagcuccacccucacgcugagcaaggcggacuacgagaagcacaagguguacgccugcgaggucacccaccagggccuguccagccccgugaccaaguccuucaaccgcggcgagugc

SEQ ID NO: 8604 - RNA, 366 nt, Artificial Sequence
  derived and/or modified sequence opt1 from Blinatumomab_HeavyChain1
caggugcagcugcagcagagcggcgccgagcucguccgccccggguccagcgugaagaucuccugcaaggccagcggcuacgcguucuccagcuacuggaugaacugggugaagcagcggccggggcagggccuggaguggaucgggcagaucuggcccggcgacggcgacaccaacuacaacgggaaguucaagggcaaggccacccugacggccgacgaguccagcuccaccgccuacaugcagcucagcucccuggccagcgaggacuccgcggucuacuucugcgcccgccgggagaccaccacgguggggcgcuacuacuacgccauggacuacuggggccaggggaccaccgugaccguc

SEQ ID NO: 8605 - RNA, 363 nt, Artificial Sequence
  derived and/or modified sequence opt1 from Blinatumomab_HeavyChain2
gacaucaagcugcagcagagcggcgccgagcucgcccgccccggggcguccgugaagaugagcugcaagaccuccggcuacaccuucacgcgguacaccaugcacugggucaagcagcgcccggggcagggccuggaguggaucggguacaucaaccccagccggggcuacaccaacuacaaccagaaguucaaggacaaggccacccugacgaccgacaaguccagcuccaccgccuacaugcagcucagcucccugaccagcgaggacuccgccguguacuacugcgcccgcuacuacgacgaccacuacugccuggacuacuggggccaggggacgacccucaccgugagcuccgucgag

SEQ ID NO: 8606 - RNA, 1494 nt, Artificial Sequence
  derived and/or modified sequence opt1 from Blinatumomab_LightChain_HeavyChain_HeavyChain_LightChain
gacauccagcugacccagagccccgccucccucgccgugagccugggccagcgcgcgaccaucuccugcaaggccagccaguccgucgacuacgacggggacagcuaccugaacugguaccagcagaucccgggccagccgcccaagcuccugaucuacgacgccuccaaccuggugagcgggaucccgccccgguucuccggcagcggguccggcacggacuucacccucaacauccaccccguggagaaggucgacgccgccaccuaccacugccagcagagcaccgaggaccccuggacguucggcgggggcaccaagcuggagaucaagggcggcgggggcuccggcgggggcgggagcggcggcgggggcucccaggugcagcugcagcagagcggggcggagcucgugcgccccggcuccagcgucaagaucuccugcaaggccagcggguacgccuucagcuccuacuggaugaacugggugaagcagcggcccggccagggccuggaguggaucgggcagaucuggcccggcgacggggacaccaacuacaacggcaaguucaaggggaaggccacccugacggcggacgagagcuccagcaccgccuacaugcagcucuccagccuggccuccgaggacagcgccguguacuucugcgcccgccgggagaccaccacggucggccgcuacuacuacgcgauggacuacuggggccaggggaccaccgugaccguguccagcggcgggggcggguccgacaucaagcugcagcagagcggcgccgagcucgcccggcccggcgccuccgucaagaugagcugcaagacguccggguacaccuucacccgcuacaccaugcacugggugaagcagcggcccggccaggggcuggaguggaucggcuacaucaacccgagccgcggcuacacgaacuacaaccagaaguucaaggacaaggccacccugaccaccgacaaguccagcuccacggcguacaugcagcucagcagccugaccuccgaggacagcgccguguacuacugcgcccgguacuacgacgaccacuacugccuggacuacugggggcagggcaccacccucacggucuccagcguggagggcggguccggcgggagcggcggguccggcgggagcggcgggguggacgacauccagcugacccagucccccgccaucaugagcgccucccccggggagaaggucaccaugaccugccgcgcgagcuccagcguguccuacaugaacugguaccagcagaaguccggcacgagccccaagcgguggaucuacgacaccagcaagguggccagcggggucccguaccgcuucuccggcagcggguccggcaccagcuacucccugaccaucagcuccauggaggccgaggacgccgccacguacuacugccagcaguggagcuccaacccccucaccuucggggcgggcaccaagcuggagcugaag

SEQ ID NO: 8607 - RNA, 333 nt, Artificial Sequence
  derived and/or modified sequence opt1 from Blinatumomab_LightChain1
gacauccagcugacccagagccccgccucccucgccgugagccugggccagcgcgcgaccaucuccugcaaggccagccaguccgucgacuacgacggggacagcuaccugaacugguaccagcagauccccggccagccgcccaagcuccugaucuacgacgccuccaaccuggugagcgggaucccgccccgguucuccggcagcggguccggcacggacuucacccucaacauccaccccguggagaaggucgacgccgccaccuaccacugccagcagagcaccgaggaccccuggacguucggcgggggcaccaagcuggagaucaag

SEQ ID NO: 8608 - RNA, 324 nt, Artificial Sequence
  derived and/or modified sequence opt1 from Blinatumomab_LightChain2
guggacgacauccagcugacccagagccccgccaucauguccgccagcccgggcgagaaggucaccaugacgugccgcgcguccagcuccgugagcuacaugaacugguaccagcagaaguccgggaccagccccaagcgguggaucuacgacaccuccaagguggccagcggcguccccuaccgcuucuccgggagcggcuccgggaccagcuacucccucacgaucagcuccauggaggccgaggacgccgccaccuacuacugccagcaguggagcuccaacccccugaccuucggcgcgggcaccaagcuggagcucaag

SEQ ID NO: 8609 - RNA, 1350 nt, Artificial Sequence
  derived and/or modified sequence opt1 from Brazikumab_HeavyChain
caggugcagcuggucgagagcggcgggggcguggugcagcccgggcgcucccuccggcugagcugcgccgccuccggcuucaccuucagcuccuacgggaugcacuggguccgccaggcgccgggcaagggccuggaguggguggccgugaucugguacgacgggagcaacgaguacuacgccgacuccgucaagggccgguucaccaucagccgcgacaacuccaagaacacccucuaccugcagaugaacagccugcgggccgaggacaccgccguguacuacugcgcgcgcgaccggggguacaccuccagcugguaccccgacgccuucgacaucuggggccaggggaccauggugacggucuccagcgccuccaccaagggccccagcguguucccccucgccccgugcucccgcagcaccuccgagagcaccgcggcccugggcugccuggugaaggacuacuuccccgagcccgucacggugagcuggaacuccggggcccucaccagcggcgugcacaccuuccccgccguccugcaguccagcgggcuguacucccucagcuccguggugaccgucccgagcuccaacuucggcacgcagaccuacacgugcaacguggaccacaagcccagcaacaccaagguggacaagaccgucgagcggaagugcugcguggagugcccgcccugccccgccccgcccguggcgggccccuccgucuuccuguucccgcccaagcccaaggacacccugaugaucagccgcacccccgaggugaccugcgucgugguggacgucucccacgaggaccccgaggugcaguucaacugguacguggacggggucgaggugcacaacgccaagacgaagccccgggaggagcaguucaacagcaccuuccgcguggucuccgugcucaccgugguccaccaggacuggcugaacggcaaggaguacaagugcaaggugagcaacaaggggcugcccgcccccaucgagaagaccaucuccaagacgaagggccagccgcgggagccccagguguacacccucccgcccagccgcgaggagaugaccaagaaccaggucucccugaccugccuggugaagggguucuaccccagcgacaucgccguggagugggagagcaacggccagcccgagaacaacuacaagacgacgcccccgaugcucgacuccgacggcagcuucuuccuguacuccaagcugaccgucgacaagagccgguggcagcaggggaacguguucuccugcagcgugaugcacgaggcccuccacaaccacuacacccagaagucccugagccugucccccggcaag

SEQ ID NO: 8610 - RNA, 651 nt, Artificial Sequence
  derived and/or modified sequence opt1 from Brazikumab_LightChain
cagagcgugcugacccagcccccguccgucagcggcgcccccgggcagcgcgugaccaucuccugcacgggcagcuccagcaacaccggggccggcuacgacgugcacugguaccagcagguccccgggaccgcgcccaagcuccugaucuacggcuccggcaaccggccgagcggggugcccgaccgcuucuccggcagcaaguccgggaccagcgccucccuggccaucacgggccuccaggccgaggacgaggccgacuacuacugccagagcuacgacuccagccuguccggguggguguucggcggcgggacccggcugaccguccucggccagcccaaggcggcccccagcgugacccuguucccgcccuccagcgaggagcugcaggccaacaaggccacgcucgugugccugaucagcgacuucuaccccggggcggucaccguggccuggaaggccgacuccagccccgugaaggccggcgucgagaccaccacgccguccaagcagagcaacaacaaguacgccgcguccagcuaccugucccucacccccgagcaguggaagucccaccgcagcuacagcugccaggugacccacgagggcuccaccguggagaagacggucgcccccaccgagugcagc

SEQ ID NO: 8611 - RNA, 363 nt, Artificial Sequence
  derived and/or modified sequence opt1 from Brolucizumab_HeavyChain
agcgaggugcagcuggucgaguccggcgggggccucgugcagcccgggggcagccugcgccuguccugcaccgccagcggguucucccucaccgacuacuacuacaugacgugggugcggcaggccccgggcaagggccuggagugggucggguucaucgaccccgacgacgaccccuacuacgcgaccugggccaagggccgcuucaccaucagccgggacaacuccaagaacacccuguaccuccagaugaacagccugcgcgccgaggacacggccguguacuacugcgccgggggcgaccacaacuccggguggggccuggacaucuggggccaggggacccucgugaccgucagcucc

SEQ ID NO: 8612 - RNA, 333 nt, Artificial Sequence
  derived and/or modified sequence opt1 from Brolucizumab_LightChain
auggagaucgugaugacccagagccccuccacccugagcgccuccgucggcgaccgcgugaucaucacgugccaggccagcgagaucauccacuccuggcucgcgugguaccagcagaagccggggaaggcccccaagcugcugaucuaccucgccagcacccuggccuccggcgugcccagccgguucuccgggagcggcuccggggccgaguucacccugaccaucagcucccuccagcccgacgacuucgcgacguacuacugccagaacgucuaccuggccagcaccaacggcgccaacuucggccaggggaccaagcugaccgugcuc

SEQ ID NO: 8613 - RNA, 1347 nt, Artificial Sequence
  derived and/or modified sequence opt1 from Cabiralizumab_HeavyChain
caggugcagcugguccagagcggcgccgaggugaagaagcccggguccagcgugaaggucuccugcaaggccagcggcuacaccuucaccgacaacuacaugaucugggugcgccaggcgccggggcagggccucgaguggaugggggacaucaaccccuacaacggcggcacgaccuucaaccagaaguucaaggggcgggugaccaucaccgccgacaaguccacgagcaccgccuacauggagcuguccagccugcgcuccgaggacaccgccgucuacuacugcgcccgggagagccccuacuucuccaaccucuacgugauggacuacuggggccaggggacccuggugacggucagcuccgcgagcaccaagggccccuccguguucccgcuggcccccugcagccgcuccaccagcgaguccaccgccgcccucgggugccuggugaaggacuacuuccccgagcccgucacggugagcuggaacagcggcgcgcugaccuccggcgugcacaccuucccggccguccuccagagcuccgggcuguacagccuguccagcguggugaccguccccuccagcucccucggcacgaagaccuacacgugcaacguggaccacaagcccagcaacaccaagguggacaagcgggucgaguccaaguacgggcccccgugcccgcccugccccgcccccgaguuccugggcggccccagcguguuccuguucccgcccaagcccaaggacacccucaugaucucccgcacccccgaggugaccugcgucguggucgacgugagccaggaggaccccgaggugcaguucaacugguacgucgacgggguggaggugcacaacgccaagaccaagccccgggaggagcaguucaacuccacguaccgcgucgugagcgugcugaccguccugcaccaggacuggcucaacggcaaggaguacaagugcaagguguccaacaaggggcugccgagcuccaucgagaagaccaucagcaaggccaagggccagccccgggagccccagguguacacccugcccccgagccaggaggagaugacgaagaaccaggucucccugaccugccucgugaagggguucuaccccagcgacaucgcgguggagugggaguccaacggccagcccgagaacaacuacaagaccaccccgcccguccuggacagcgacggcuccuucuuccucuacagccgccugacgguggacaagucccgguggcaggaggggaacguguucagcugcuccgucaugcacgaggcccugcacaaccacuacacccagaagucccucagccugagccugggcaag

SEQ ID NO: 8614 - RNA, 654 nt, Artificial Sequence
  derived and/or modified sequence opt1 from Cabiralizumab_LightChain
gagaucgugcugacccagagccccgccacccucucccugagcccgggcgagcgcgccacgcuguccugcaaggcgagccaguccgucgacuacgacggggacaacuacaugaacugguaccagcagaagcccggccaggcgccccggcuccugaucuacgccgccagcaaccuggaguccgggauccccgcccgcuucagcggcuccgggagcggcaccgacuucacccucaccaucuccagccuggagccggaggacuucgccguguacuacugccaccuguccaacgaggaccucagcacguucggcgggggcaccaagguggagaucaagcggaccgucgccgcccccuccguguucaucuucccgcccagcgacgagcagcugaaguccgggaccgccagcguggucugccugcucaacaacuucuacccccgcgaggcgaaggugcaguggaagguggacaacgcccugcaguccggcaacagccaggagagcgucacggagcaggacuccaaggacagcaccuacucccugagcuccacccucacccugagcaaggccgacuacgagaagcacaagguguacgccugcgaggugacgcaccaggggcuguccagccccgucaccaaguccuucaaccggggcgagugc

SEQ ID NO: 8615 - RNA, 1329 nt, Artificial Sequence
  derived and/or modified sequence opt1 from Camrelizumab_HeavyChain
gaggugcagcuggucgagagcggcgggggccucgugcagcccgggggcucccugcgccugagcugcgccgccuccggguucaccuucagcuccuacaugaugagcugggugcggcaggcgccgggcaagggccucgagugggucgccaccaucuccgggggcggggccaacacguacuaccccgacagcgugaagggccgcuucaccaucucccgggacaacgccaagaacagccuguaccugcagaugaacucccuccgcgccgaggacaccgcgguguacuacugcgcccggcagcuguacuacuucgacuacugggggcagggcaccacggucaccgugagcuccgccagcaccaagggccccuccguguucccccuggccccgugcagccgcuccaccagcgaguccacggcggcccucgggugccuggucaaggacuacuuccccgagcccgugaccgugagcuggaacagcggcgcccugaccuccgggguccacaccuuccccgccgugcuccagagcuccggccuguacagccuguccagcguggucacggugccguccagcucccucggcaccaagaccuacacgugcaacguggaccacaagcccagcaacaccaaggucgacaagcggguggaguccaaguacgggccgcccugcccgcccugccccgcccccgaguuccugggcgggcccagcguguuccuguucccgcccaagcccaaggacacccucaugaucucccgcacccccgaggugaccugcgucguggucgacgugagccaggaggaccccgagguccaguucaacugguacguggacggcguggagguccacaacgcgaagacgaagccccgggaggagcaguucaacuccaccuaccgcguggugagcguccugaccgugcugcaccaggacuggcucaacgggaaggaguacaagugcaagguguccaacaagggccugcccagcuccaucgagaagaccaucagcaaggccaagggccagccgcgggagccccaggucuacacgcugccgcccagccaggaggagaugaccaagaaccaggugucccugaccugccucgugaagggguucuaccccagcgacaucgccgucgagugggaguccaacggccagcccgagaacaacuacaagaccacgcccccggugcuggacagcgacggguccuucuuccucuacagccgccugaccguggacaagucccgguggcaggagggcaacgucuucagcugcuccgugaugcacgaggcccugcacaaccacuacacccagaagucccucagccugagccuggggaag

SEQ ID NO: 8616 - RNA, 642 nt, Artificial Sequence
  derived and/or modified sequence opt1 from Camrelizumab_LightChain
gacauccagaugacccagagccccuccagccuguccgccagcgugggcgaccgcgucaccaucacgugccucgccucccagaccaucgggaccuggcugaccugguaccagcagaagccgggcaaggcgcccaagcugcucaucuacacggccaccagccuggccgacggggugcccucccgguucagcggcuccgggagcggcaccgacuucacccugacgaucuccagccuccagcccgaggacuucgccaccuacuacugccagcaggucuacuccaucccguggaccuucggcgggggcaccaagguggagaucaagcgcacgguggccgcgcccagcguguucaucuucccgcccuccgacgagcagcucaagagcgggaccgccuccgucgugugccugcugaacaacuucuacccccgggaggccaaggugcaguggaaggucgacaacgcccugcagagcggcaacucccaggagagcgugaccgagcaggacagcaaggacuccaccuacagccuguccagcacgcucacccuguccaaggcggacuacgagaagcacaagguguacgccugcgaggucacccaccaggggcugagcucccccgugaccaagagcuucaaccgcggcgagugc

SEQ ID NO: 8617 - RNA, 777 nt, Artificial Sequence; identical to SEQ ID NO: 7784
  derived and/or modified sequence opt1 from Caplacizumab_HeavyChain

SEQ ID NO: 8618 - RNA, 657 nt, Artificial Sequence
  derived and/or modified sequence opt1 from Citatuzumab_bogatox_HeavyChain
gaggugcagcugguccagagcggccccgggcucgugcagccgggcggguccgugcgcaucagcugcgccgccuccggcuacaccuucaccaacuacgggaugaacugggucaagcaggcgcccggcaagggccuggaguggaugggguggaucaacacguacaccggcgagagcaccuacgccgacuccuucaaggggcgguucaccuucagccuggacacguccgccagcgccgccuaccuccagaucaacucccugcgcgcggaggacaccgccguguacuacugcgcccgguucgccaucaagggcgacuacugggggcagggcacccugcucaccgugagcuccgcgagcacgaagggccccuccgucuucccccuggccccgagcuccaagagcaccuccgggggcaccgccgcccuggggugccucgugaaggacuacuuccccgagcccgugaccgucagcuggaacuccggcgcccugacgagcggcgugcacaccuuccccgcggugcugcagagcuccgggcucuacagccuguccagcgucgugaccgugccguccagcucccugggcacccagacguacaucugcaacgucaaccacaagcccagcaacaccaagguggacaagaagguggagcccaaguccugc

SEQ ID NO: 8619 - RNA, 1356 nt, Artificial Sequence
  derived and/or modified sequence opt1 from Cosfroviximab_HeavyChain
gacgugaagcugcucgagagcggcgggggccugguccagcccgggggcucccugaagcucagcugcgccgccuccggguucagccuguccaccagcggcgugggcguggggugguuccgccagccguccggcaaggggcuggaguggcucgcgcugaucuggugggacgacgacaaguacuacaaccccagccugaagucccagcucagcaucuccaaggacuucagccggaaccaggucuuccugaagaucuccaacguggacaucgccgacaccgccacguacuacugcgcccgccgggaccccuucggcuacgacaacgccaugggguacuggggccagggcaccagcgugaccgucuccagcgcguccaccaaggggcccagcguguucccgcuggcccccuccagcaagagcacguccggcgggaccgccgcccucggcugccuggugaaggacuacuuccccgagcccgucaccgugagcuggaacuccggcgcgcugaccagcggggugcacacguucccggccguccuccaguccagcggccuguacucccugagcuccguggugaccguccccagcuccagccucgggacccagaccuacaucugcaacgugaaccacaagcccuccaacacgaagguggacaagcgcgucgagcccaagagcugcgacaagacccacacgugcccgcccugccccgcccccgagcugcugggcgggccguccguguuccucuucccgcccaagcccaaggacacccugaugaucagccggacccccgaggugaccugcgucgugguggacgucucccacgaggaccccgaggugaaguucaacugguacgucgacggcguggaggugcacaacgccaagaccaagccccgcgaggagcaguacaacagcaccuaccgggucguguccgugcugacgguccuccaccaggacuggcugaacggcaaggaguacaagugcaaggugagcaacaaggcccugcccgcgccgaucgagaagaccaucagcaaggccaaggggcagccccgcgagccccagguguacacccugcccccgucccgggacgagcucaccaagaaccaggucagccugacgugccucgugaagggcuucuaccccuccgacaucgccguggagugggagagcaacgggcagcccgagaacaacuacaagaccaccccgcccguccuggacuccgacggcagcuucuuccuguacuccaagcucaccguggacaagagccgcuggcagcaggggaacguguucuccugcagcgucaugcacgaggcccugcacaaccacuacacgcagaagucccugagccucucccccggcaag

SEQ ID NO: 8620 - RNA, 639 nt, Artificial Sequence
  derived and/or modified sequence opt1 from Cosfroviximab_LightChain
gacaucgugaugacccagagcccccugucccucagcaccuccgucggcgaccgggugagccugacgugcaaggccucccagaacguggggaccgccgucgcgugguaccagcagaagccgggccagagccccaagcugcucaucuacuccgccagcaaccgguacaccggggugcccgaccgcuucaccggcuccgggagcggcacggacuucacccugaccaucuccaacaugcagagcgaggaccuggccgacuacuucugccagcaguacuccagcuacccccucaccuucggcgccgggacgaagcuggagcugcggaccguggccgcgccguccgucuucaucuucccgcccagcgacgagcagcucaaguccggcaccgccagcguggugugccugcugaacaacuucuacccccgcgaggccaagguccaguggaagguggacaacgcccuccaguccgggaacagccaggagagcgugaccgagcaggacuccaaggacagcacguacucccugagcuccacccugacccucagcaaggcggacuacgagaagcacaaggucuacgccugcgaggugacccaccagggccuguccagccccgugacgaaguccuucaaccgcggggagugc

SEQ ID NO: 8621 - RNA, 1344 nt, Artificial Sequence
  derived and/or modified sequence opt1 from Crizanlizumab_HeavyChain
caggugcagcugguccagagcggcgccgaggugaagaagcccggggccuccgugaaggucagcugcaagguguccggcuacaccuucaccagcuacgacaucaacugggugcgccaggcgccggggaagggccucgaguggaugggguggaucuaccccggcgacggcuccaucaaguacaacgagaaguucaaggggcgggucacgaugaccguggacaagagcaccgacaccgccuacauggagcuguccagccugcgcuccgaggacacggccguguacuacugcgcccggcgcggcgaguacgggaacuacgagggcgccauggacuacugggggcagggcacccucgucaccgugagcuccgcgagcaccaagggccccuccguguucccccuggccccgugcagccgguccacgagcgaguccaccgccgcccuggggugccucgucaaggacuacuuccccgagcccgugaccgugagcuggaacuccggcgcgcugaccagcgggguccacacguuccccgccgugcugcagagcuccggccucuacagccuguccagcguggucaccgugaccuccagcaacuucggcacccagacguacacgugcaacguggaccacaagccguccaacaccaaggucgacaagaccguggagcgcaagugcugcguggagugcccgcccugccccgccccgcccgucgccgggcccagcguguuccuguucccgcccaagcccaaggacacccucaugaucucccggacccccgaggugaccugcgucguggucgacgugagccacgaggaccccgaggugcaguucaacugguacgucgacggcauggaggugcacaacgccaagaccaagccgcgcgaggagcaguucaacuccacguuccggguggucagcgugcugaccgugguccaccaggacuggcugaacgggaaggaguacaagugcgcgguguccaacaagggccuccccgcccccaucgagaagaccaucagcaagaccaaggggcagccccgcgagccccagguguacacgcugccgcccucccgggaggagaugaccaagaaccaggucagccugaccugccucgugaagggcuucuaccccuccgacaucgccguggagugggagagcaacggccagcccgagaacaacuacaagaccacgccgcccaugcuggacuccgacgggagcuucuuccuguacagcaagcucaccgucgacaagucccgcuggcagcagggcaacguguucagcugcuccgugaugcacgaggcccugcacaaccacuacacccagaagucccugagccucagccccgggaag

SEQ ID NO: 8622 - RNA, 654 nt, Artificial Sequence
  derived and/or modified sequence opt1 from Crizanlizumab_LightChain
gacauccagaugacccagagccccuccagccuguccgccagcgugggcgaccgcgucaccaucacgugcaaggccucccagagcguggacuacgacgggcacuccuacaugaacugguaccagcagaagccgggcaaggcgcccaagcuccugaucuacgccgccagcaaccuggaguccggggugcccagccgguucuccggcagcggguccggcaccgacuucacccucaccaucagcucccugcagcccgaggacuucgccacguacuacugccagcagagcgacgagaacccgcugaccuucggcgggggcaccaaggucgagaucaagcgcaccguggccgcgcccuccguguucaucuucccgcccagcgacgagcagcucaaguccgggacggccagcgucgugugccugcugaacaacuucuacccccgggaggccaaggugcaguggaaggucgacaacgcccuccagagcggcaacucccaggagagcgugaccgagcaggacuccaaggacagcaccuacucccugagcuccacccugacgcucagcaaggcggacuacgagaagcacaagguguacgccugcgaggucacccaccaggggcuguccagccccgugaccaaguccuucaaccgcggcgagugc

SEQ ID NO: 8623 - RNA, 1365 nt, Artificial Sequence
  derived and/or modified sequence opt1 from Crotedumab_HeavyChain
gaggugcagcuggucgagagcggcgggggccucgugcagcccgggggcucccugcgccugagcugcgccgccuccggguucaccuucagcaacuaccucaugaacugggugcggcaggcgcccggcaagggccuggaguggcuggccaacauccaggaggacgggaucgagaaguacuacgucgacuccgugaagggccgcuucaccaucagccgggacaacgccaagaacucccucuaccugcagaugaacagccugcgcgccgaggacacggccguguacuacugcgcgcgggagcccucccacuacgacauccucaccggguacgacuacuacuacggcauggacgucugggggcagggcaccaccgugacggugagcuccgccagcaccaagggccccuccgucuucccccuggccccgugcagccgcuccaccagcgaguccaccgccgcgcuggggugccucgugaaggacuacuuccccgagcccgugacggucagcuggaacuccggcgcccugaccagcggggugcacaccuuccccgccgugcugcagagcuccggccucuacagccuguccagcgucgugaccgugccguccagcucccugggcacgaagaccuacacgugcaacgucgaccacaagcccagcaacaccaagguggacaagcggguggaguccaaguacgggccgcccugcccgcccugccccgcccccgaguuccucggcgggccgagcgucuuccuguucccgcccaagcccaaggacacccugaugaucucccgcacccccgaggugaccugcguggucguggacgucagccaggaggaccccgaggugcaguucaacugguacguggacggcgucgaggugcacaacgccaagaccaagccccgggaggagcaguucaacuccacguaccgcguggucagcgugcucaccgugcugcaccaggacuggcugaacgggaaggaguacaagugcaaggucuccaacaagggccuccccagcuccaucgagaagaccaucagcaaggcgaagggccagccgcgggagccccagguguacacccugccgcccucccaggaggagaugacgaagaaccaggugagccugaccugccucgucaagggguucuaccccagcgacaucgccguggagugggaguccaacggccagcccgagaacaacuacaagaccaccccgcccgugcuggacagcgacggguccuucuuccuguacagccgccucacggucgacaagucccgguggcaggagggcaacguguucagcugcuccgugaugcacgaggcccugcacaaccacuacacccagaagucccugagccucagccuggggaag

SEQ ID NO: 8624 - RNA, 642 nt, Artificial Sequence
  derived and/or modified sequence opt1 from Crotedumab_LightChain
gacauccagaugacccagagccccuccagccuguccgccagcgugggcgaccgcgucaccaucacgugccgggccucccaggggauccgcaacgaccucggcugguaccagcagaagccggggaaggcgcccaagcggcugaucuacgccgccagcucccugcagagcggcgugcccucccgcuucagcggguccggcagcggcaccgaguucauccucaccguguccagccugcagcccgaggacuucgccaccuacuacugccugcaguacaacuccaacccguucacguucgggcccggcaccaaggucgacaucaagcggaccguggccgcgcccagcguguucaucuucccgcccuccgacgagcagcucaagagcgggaccgccuccgucgugugccugcugaacaacuucuacccccgcgaggccaaggugcaguggaaggucgacaacgcccuccagagcggcaacagccaggaguccgugacggagcaggacagcaaggacuccaccuacagccuguccagcacccugacccucuccaaggcggacuacgagaagcacaagguguacgccugcgaggucacgcaccaggggcugagcucccccgugaccaagagcuucaaccggggcgagugc

SEQ ID NO: 8625 - RNA, 1356 nt, Artificial Sequence
  derived and/or modified sequence opt1 from Dezamizumab_HeavyChain
caggugcagcugguccagagcggcgccgaggugaagaagcccggguccagcgugaaggucuccugcaaggccagcggcuucaccuucgcgaccuacaacaugcacugggugcgccaggccccggggcagggccucgaguggaugggguacaucuaccccggcgacggcaacgccaacuacaaccagcaguucaaggggcgggugacgaucaccgccgacaaguccaccagcaccgccuacauggagcuguccagccugcgcuccgaggacacggcggucuacuacugcgcccggggcgacuucgacuacgacgggggcuacuacuucgacagcugggggcagggcacccucgugaccguguccagcgccuccaccaagggccccagcgucuucccccuggccccguccagcaaguccacgagcgggggcaccgcggcccuggggugccucgugaaggacuacuuccccgagcccgugaccgucuccuggaacagcggcgcccugaccagcggcgugcacacguuccccgccgugcugcaguccagcgggcucuacucccugagcuccgucgugaccgugccgagcuccagccugggcacccagaccuacaucugcaacgucaaccacaagcccuccaacacgaagguggacaagaagguggagcccaagagcugcgacaagacccacacgugcccgcccugccccgcccccgagcuccucgggggccccuccgucuuccuguucccgcccaagcccaaggacacccugaugaucagccgcacccccgaggugaccugcguggucguggacgucucccacgaggacccggaggugaaguucaacugguacguggacggggucgaggugcacaacgcgaagaccaagccccgggaggagcaguacaacagcaccuaccgcguggucuccgugcugacggugcugcaccaggacuggcucaacggcaaggaguacaagugcaaggucagcaacaaggcccugcccgcccccaucgagaagaccaucuccaaggccaagggccagccgcgggagccccagguguacacccugccgcccagccgcgacgagcucaccaagaaccaggugucccugacgugccuggucaagggguucuaccccagcgacaucgccguggagugggagagcaacggccagcccgagaacaacuacaagaccacgcccccggugcucgacuccgacgggagcuucuuccuguacuccaagcugaccgucgacaagagccgguggcagcagggcaacguguucuccugcagcgugaugcacgaggcgcuccacaaccacuacacccagaagucccugagccugucccccgggaag

SEQ ID NO: 8626 - RNA, 642 nt, Artificial Sequence
  derived and/or modified sequence opt1 from Dezamizumab_LightChain
gacauccagaugacccagagccccuccagccuguccgccagcgugggcgaccgggucaccaucacgugccgggccuccgagaacaucuacagcuaccucgcgugguaccagcagaagccggggaaggcccccaagcugcugauccacaacgccaagacccucgccgagggcgugcccucccgcuucagcggguccggcagcgggaccgacuucacccugacgaucuccagccugcagcccgaggacuucgccaccuacuacugccagcaccacuacggcgcgccgcucaccuucggccaggggaccaagcuggagaucaagcggacgguggccgcccccuccgucuucaucuucccgcccagcgacgagcagcugaaguccggcaccgccagcguggugugccuccugaacaacuucuacccccgcgaggcgaagguccaguggaagguggacaacgcccugcaguccgggaacagccaggaguccgugaccgagcaggacagcaaggacagcaccuacucccucagcuccacgcugacccugagcaaggccgacuacgagaagcacaaggucuacgccugcgaggugacccaccagggccucuccagccccgugaccaaguccuucaaccgcggggagugc

SEQ ID NO: 8627 - RNA, 1506 nt, Artificial Sequence
  derived and/or modified sequence opt1 from Duvortuxizumab_Chain1_scFv
gagaacgugcugacccagagccccgccacccucuccgucacgccgggcgagaaggccaccaucacgugccgcgcgagccaguccgugagcuacaugcacugguaccagcagaagcccgggcaggcgccccggcugcugaucuacgacgccuccaaccgcgccagcggcgugcccucccgguucagcggguccggcagcgggaccgaccacacccucaccaucuccagccuggaggccgaggacgccgccaccuacuacugcuuccagggcuccgucuacccguucaccuucggccaggggacgaagcuggagaucaagggcgggggcagcgggggcggcggggaggugcagcucguggaguccggcgggggccugguccagcccggcgggagccugcgccucuccugcgccgccagcggcuucaccuucuccaccuacgcgaugaacugggugcggcaggcccccgggaagggccuggaguggguggggcgcauccggagcaaguacaacaacuacgccaccuacuacgccgacagcgucaagggccgcuucacgaucucccgggacgacagcaagaacucccuguaccuccagaugaacagccugaagaccgaggacaccgccguguacuacugcgugcgccacggcaacuucgggaacuccuacgucagcugguucgcguacuggggccaggggacccuggugacgguguccagcgccuccaccaagggcgaggucgccgccugcgagaaggagguggccgcgcucgagaaggagguggccgcccuggagaaggaggucgccgcccuggagaagggcgggggcgacaagacccacacgugcccgcccugccccgcgcccgaggccgccgggggccccagcguguuccucuucccgcccaagcccaaggacacccugaugaucucccggacccccgaggugaccugcgucgugguggacgucagccacgaggacccggaggugaaguucaacugguacgucgacgggguggaggugcacaacgccaagaccaagccccgcgaggagcaguacaacuccacguaccgggucgugagcgugcugaccguccuccaccaggacuggcugaacggcaaggaguacaagugcaagguguccaacaaggcccugcccgcgcccaucgagaagaccaucagcaaggccaaggggcagccgcgcgagccccagguguacacccucccgcccucccgggaggagaugacgaagaaccaggucagccuguggugccuggugaagggcuucuaccccuccgacaucgccguggagugggagagcaacggccagcccgagaacaacuacaagaccaccccgcccguccucgacagcgacggguccuucuuccuguacagcaagcugaccguggacaagucccgcuggcagcagggcaacguguucagcugcuccgucaugcacgaggcccuccacaaccacuacacgcagaagucccugagccugagccccgggaag

SEQ ID NO: 8628 - RNA, 813 nt, Artificial Sequence
  derived and/or modified sequence opt1 from Duvortuxizumab_Chain2_scFv
caggccguggucacccaggagcccagccugaccguguccccgggcgggacggugacccugaccugccgcagcuccaccggcgccgucacgaccagcaacuacgcgaacugggugcagcagaagcccgggcaggcgccccggggccugaucgggggcaccaacaagcgcgcccccuggaccccggcccgguucuccggcagccugcucgggggcaaggccgcccugacgaucaccggggcccaggccgaggacgaggccgacuacuacugcgcgcugugguacuccaaccucuggguguucggcgggggcaccaagcugaccguccugggcgggggcgggagcggcggcgggggccaggugacgcuccgcgaguccgggcccgcccuggugaagcccacccagacccugacccucacgugcaccuucagcggcuucucccugagcaccuccgggaugggcgucggcuggauccggcagcccccggggaaggcccuggaguggcucgcccacaucuggugggacgacgacaagcgcuacaaccccgcccucaagagccggcugaccaucuccaaggacacgagcaagaaccagguguuccucaccaugaccaacauggaccccguggacaccgcgacguacuacugcgcccgcauggagcugugguccuacuacuucgacuacuggggccaggggaccaccgucaccgugagcuccgccagcacgaagggcaagguggccgccugcaaggagaaggucgcggcccugaaggagaagguggccgcccucaaggagaagguggccgcgcugaaggag

SEQ ID NO: 8629 - RNA, 681 nt, Artificial Sequence
  derived and/or modified sequence opt1 from Duvortuxizumab_Chain3_h-CH2-CH3
gacaagacccacacgugcccgcccugccccgcccccgaggccgcgggcgggcccagcguguuccuguucccgcccaagcccaaggacacccucaugaucucccgcacccccgaggugaccugcgucguggucgacgugagccacgaggacccggaggugaaguucaacugguacgucgacggcguggaggugcacaacgccaagaccaagccccgggaggagcaguacaacuccacguaccgcgucgugagcgugcugaccguccugcaccaggacuggcucaacgggaaggaguacaagugcaagguguccaacaaggcccugcccgcccccaucgagaagaccaucagcaaggccaagggccagccgcgggagccccagguguacacccugccgcccucccgcgaggagaugacgaagaaccaggucagccucuccugcgcggugaagggguucuaccccagcgacaucgccguggagugggaguccaacggccagcccgagaacaacuacaagaccaccccgcccguccuggacagcgacggcuccuucuuccuggugagcaagcucaccguggacaagucccgguggcagcaggggaacgucuucagcugcuccgugaugcacgaggcccugcacaaccgcuacacgcagaagucccugagccucagccccggcaag

SEQ ID NO: 8630 - RNA, 360 nt, Artificial Sequence
  derived and/or modified sequence opt1 from Efungumab_HeavyChain
auggccgaggugcagcuggucgagagcggcgccgaggugaagaagcccggggagucccuccgcaucagcugcaagggcuccgggugcaucaucagcuccuacuggaucagcugggugcggcagaugccgggcaaggggcuggaguggaugggcaagaucgaccccggcgacuccuacaucaacuacagccccuccuuccaggggcacgucaccaucagcgcggacaaguccaucaacaccgccuaccugcaguggaacagccucaaggccuccgacacggccauguacuacugcgcccgcggcgggcgggacuucggcgacagcuucgacuacugggggcagggcacccuggugaccgug

SEQ ID NO: 8631 - RNA, 750 nt, Artificial Sequence
  derived and/or modified sequence opt1 from Efungumab_HeavyChain_LightChain
auggccgaggugcagcuggucgagagcggcgccgaggugaagaagcccggggagucccuccgcaucagcugcaagggcuccgggugcaucaucagcuccuacuggaucagcugggugcggcagaugccgggcaaggggcuggaguggaugggcaagaucgaccccggcgacuccuacaucaacuacagccccuccuuccaggggcacgucaccaucagcgcggacaaguccaucaacaccgccuaccugcaguggaacagccucaaggccuccgacacggccauguacuacugcgcccgcggcgggcgggacuucggcgacagcuucgacuacugggggcagggcacccuggugaccguguccagcggcgggggcggguccggcggcgggggcagcgggggcgggggcuccgacgucgugaugacccagagccccagcuuccuguccgcguucgugggcgaccgcaucacgaucacgugccgggccagcuccgggaucagccgcuaccucgccugguaccagcaggccccgggcaaggcgcccaagcugcugaucuacgccgccuccacccuccagaccgggguccccagccgguucuccggcagcggguccggcaccgaguucacccugaccaucaacagccugcagcccgaggacuucgccaccuacuacugccagcaccucaacuccuacccgcugacguucggcgggggcaccaagguggacaucaagcgcgccgcggcccuggag

SEQ ID NO: 8632 - RNA, 339 nt, Artificial Sequence
  derived and/or modified sequence opt1 from Efungumab_LightChain
gacguggucaugacccagagccccuccuuccugagcgccuucgugggcgaccgcaucaccaucacgugccgggccuccagcgggaucucccgcuaccucgcgugguaccagcaggccccgggcaaggcccccaagcugcugaucuacgccgccagcacccuccagaccggggugcccucccgguucagcggcuccgggagcggcaccgaguucacgcugaccaucaacucccugcagcccgaggacuucgcgaccuacuacugccagcaccucaacagcuacccgcugaccuucggcgggggcacgaaggucgacaucaagcgcgccgccgcccuggag

SEQ ID NO: 8633 - RNA, 1350 nt, Artificial Sequence
  derived and/or modified sequence opt1 from Elezanumab_HeavyChain
gaggugcagcugguccagagcggcgccgaggugaagaagcccggggccuccgugaaggucagcugcaaggcguccggcuacaccuucaccagccacgggaucuccugggugcgccaggccccgggccaggggcucgacuggaugggcuggaucagccccuacuccggcaacacgaacuacgcccagaagcugcaggggcgggugaccaugaccaccgacacgagcaccuccaccgccuacauggagcugagcucccuccgcagcgaggacaccgccgucuacuacugcgcgcgggugggcuccgggcccuacuacuacauggacguguggggccaggggacgcuggucaccgugagcuccgccagcaccaagggccccuccguguucccgcuggcccccagcuccaagagcaccagcggcgggacggccgcgcucggcugccuggucaaggacuacuuccccgagcccgugaccguguccuggaacagcggggcccugaccuccggcguccacaccuucccggccgugcuccagagcuccggccuguacagccuguccagcguggucacggugcccuccagcucccucgggacccagaccuacaucugcaacgugaaccacaagcccagcaacaccaaggucgacaagaagguggagcccaaguccugcgacaagacgcacacgugcccgcccugccccgcccccgaggccgcgggcgggccgagcguguuccuguucccgcccaagcccaaggaccagcugaugaucucccgcacccccgaggugaccugcgucgucguggacgugagccacgaggaccccgaggucaaguucaacugguacguggacggcguggagguccacaacgccaagaccaagccccgggaggagcaguacaacuccaccuaccgcguggugagcguccucaccgugcugcaccaggacuggcugaacgggaaggaguacaagugcaagguguccaacaaggcccuccccgccccgaucgagaagaccaucagcaaggccaagggccagccccgggagccccaggucuacacgcugcccccgagccgcgaggagaugaccaagaaccaggugucccugaccugccucgugaagggcuucuaccccagcgacaucgcggucgagugggaguccaacgggcagcccgagaacaacuacaagaccacgccgcccgugcuggacagcgacggcuccuucuuccuguacagcaagcucaccguggacaagucccgguggcagcaggggaacgucuucagcugcuccgugcugcacgaggcccugcacaaccacuacacccagaagucccucagccugagccccggcaag

SEQ ID NO: 8634 - RNA, 645 nt, Artificial Sequence
  derived and/or modified sequence opt1 from Elezanumab_LightChain
cagagcgcccugacccagccccgcuccgugagcggcuccccggggcagagcgucaccaucuccugcacgggcaccagcuccagcgugggggacuccaucuacgugagcugguaccagcagcaccccggcaaggcccccaagcucaugcuguacgacgucaccaagcggcccuccggggugccggaccgcuucagcggcuccaagagcggcaacaccgcgucccugacgaucagcgggcuccaggccgaggacgaggccgacuacuacugcuacuccuacgccggcaccgacacccuguucgggggcgggaccaaggugacgguccugggccagcccaaggccgcgcccagcgugacccucuucccgcccuccagcgaggagcugcaggccaacaaggccacccuggugugccucaucagcgacuucuaccccggcgccgucaccguggcguggaaggccgacuccagccccgugaaggccggggucgagacgaccacccccuccaagcagagcaacaacaaguacgccgccuccagcuaccugucccugaccccggagcaguggaagucccaccggagcuacagcugccaggugacgcacgagggcuccaccguggagaagaccgucgcgcccaccgagugcagc

SEQ ID NO: 8635 - RNA, 1359 nt, Artificial Sequence
  derived and/or modified sequence opt1 from Emapalumab_HeavyChain
gaggugcagcugcucgagagcggcgggggccugguccagcccgggggcucccugcgccucagcugcgccgccuccggguucaccuucagcuccuacgcgaugagcugggugcggcaggccccgggcaagggccuggaguggguguccgccaucagcggguccggcgggagcaccuacuacgccgacuccgucaagggccgcuucacgaucagccgggacaacuccaagaacacccuguaccuccagaugaacagccugcgcgccgaggacaccgcgguguacuacugcgccaaggacggguccagcggcugguacgugccccacugguucgaccccuggggccaggggacccuggucacgguguccagcgccuccaccaagggccccagcguguucccgcucgcccccagcuccaagagcaccuccgggggcaccgcggcccugggcugccuggucaaggacuacuuccccgagcccgugacggugagcuggaacuccggggcccucaccagcggcguccacaccuucccggccgugcugcaguccagcgggcuguacucccucagcuccguggucaccgugcccagcuccagccugggcacgcagaccuacaucugcaacgugaaccacaagcccuccaacaccaaggucgacaagcggguggagcccaagagcugcgacaagacccacacgugcccgcccugccccgcccccgagcugcucgggggcccguccguguuccuguucccgcccaagcccaaggacacccugaugaucagccgcacccccgaggugaccugcgucguggucgacgugucccacgaggaccccgaggucaaguucaacugguacguggacggcguggagguccacaacgcgaagacgaagccccgggaggagcaguacaacagcaccuaccgcguggugagcguccucaccgugcugcaccaggacuggcugaacgggaaggaguacaagugcaagguguccaacaaggcccuccccgccccgaucgagaagaccaucagcaaggccaagggccagccccgggagccccaggucuacacgcugcccccgucccgcgaggagaugaccaagaaccaggugagccugaccugccucgugaagggguucuaccccuccgacaucgccgucgagugggagagcaacggccagcccgagaacaacuacaagaccacgccgcccgugcuggacuccgacgggagcuucuuccuguacuccaagcucaccguggacaagagccgguggcagcagggcaacgucuucuccugcagcgugaugcacgaggcgcugcacaaccacuacacccagaagucccugagccucucccccggcaag

SEQ ID NO: 8636 - RNA, 651 nt, Artificial Sequence
  derived and/or modified sequence opt1 from Emapalumab_LightChain
aacuucaugcugacccagccccacagcguguccgagagcccgggcaagaccgucacgaucuccugcacccgcagcuccgggagcaucgccuccaacuacgugcagugguaccagcagcggcccggcagcucccccaccaccgugaucuacgaggacaaccagcgccccagcggggucccggaccgguucuccggcagcaucgacuccagcuccaacagcgccucccucacgaucagcgggcugaagaccgaggacgaggcggacuacuacugccaguccuacgacggcagcaaccgcuggauguucggcgggggcaccaagcugaccgugcucgggcagcccaaggccgcccccagcgugacgcuguucccgcccuccagcgaggagcugcaggccaacaaggccacccucgucugccugaucuccgacuucuaccccggcgcggugaccguggccuggaaggccgacagcucccccgucaaggccgggguggagaccacgacccccagcaagcaguccaacaacaaguacgcggccagcuccuaccugagccucaccccggagcaguggaagucccaccggagcuacuccugccaggugacccacgagggcagcacggucgagaagaccguggcccccaccgagugcucc

SEQ ID NO: 8637 - RNA, 1341 nt, Artificial Sequence
  derived and/or modified sequence opt1 from Enoblituzumab_HeavyChain
cagguggagcuggucgagagcggcgggggccucgugcagcccgggggcucccugcgccugagcugcgccgccuccggguucaccuucaccagcuacuggauguccugggugcggcaggcgccgggcaagggccucgagcuggucagcuccaucacgagcuacggguccuucaccuacuacgccgacagcgugaagggccgcuucaccaucucccgggacaacagcaagaacacccuguaccuccagaugaacucccugcgcgccgaggacacggccguguacuacugcgcccggaacauguacacccacuucgacagcugggggcagggcacccuggucaccguguccagcgcguccacgaaggggcccagcguguucccccucgcccccuccagcaagagcaccuccggcggcaccgccgcccuggggugccuggucaaggacuacuucccggagcccgugaccgugagcuggaacuccggcgcgcucacgagcgggguccacaccuuccccgccgugcugcaguccagcggccuguacucccucagcuccguggucaccgugcccagcuccagccugggcacccagacguacaucugcaacgugaaccacaagccguccaacaccaaggucgacaagaagguggagcccaagagcugcgacaagacccacacgugcccgcccugccccgcccccgagcugcucgggggccccuccguguuccuguucccgcccaagcccaaggacacccugaugaucagccgcacccccgaggugaccugcgucguggucgacgugucccacgaggaccccgaggucaaguucaacugguacguggacgggguggagguccacaacgccaagaccaagccgcgggaggagcaguacaacagcacguaccgcgugguguccguccucaccgugcugcaccaggacuggcugaacggcaaggaguacaagugcaaggugagcaacaaggcccuccccgcgcccaucgagaagaccaucagcaaggccaaggggcagccccgggagccgcaggucuacacccugccgcccucccgcgacgagcugacgaagaaccaggugagccugaccugccucgugaagggcuucuaccccuccgacaucgccgucgagugggagagcaacggccagcccgagaacaacuacaagaccaccccgcccgugcuggacuccgacgggagcuucuuccucuacuccaagcugacgguggacaagagccgguggcagcagggcaacgucuucuccugcagcgugaugcacgaggcccugcacaaccacuacacccagaagucccucagccugucccccgggaag

SEQ ID NO: 8638 - RNA, 648 nt, Artificial Sequence
  derived and/or modified sequence opt1 from Enoblituzumab_LightChain
gacaucgugcugacccagcccccgagcgucuccggcgcccccgggcagcgcgugaccaucagcugcuccggcagcuccagcaacaucggguccaacagcguguccugguaccagcagcuccccggcacggcccccaagcugcugaucuacgacaacagcaagcggccguccgggguccccgaccgcuucagcggcuccaagagcggcaccuccgcgagccucgccaucaccgggcugcaguccgaggacgaggccgacuacuacugccagagccgggacaccuacggcuacuacuggguguucgggggcgggacgaagcugaccgugcucggccagcccaaggccgcccccuccgucacccuguucccgcccagcagcgaggagcugcaggcgaacaaggccacccucgugugccugaucuccgacuucuaccccggcgccgugacggucgccuggaagggggacagcucccccgugaaggcgggcguggagaccaccaccccgagcaagcaguccaacaacaaguacgccgccagcuccuaccugagccucacgcccgagcaguggaagucccaccgcagcuacuccugccaggucacccacgaggggagcaccguggagaagaccguggcccccacggagugcucc

SEQ ID NO: 8639 - RNA, 1323 nt, Artificial Sequence
  derived and/or modified sequence opt1 from Eptinezumab_HeavyChain
gaggugcagcuggucgagagcggcgggggccucgugcagcccgggggcucccugcgccugagcugcgccguguccgggaucgaccucagcggcuacuacaugaacuggguccggcaggccccgggcaaggggcuggagugggugggcgugaucgggaucaacggcgcgaccuacuacgccuccugggccaaggggcgcuucaccaucagccgggacaacuccaagacgaccgucuaccugcagaugaacagccuccgcgccgaggacaccgccguguacuucugcgcgcggggcgacaucuggggccaggggacccuggugacggucuccagcgccuccaccaagggccccagcguguucccccuggcccccuccagcaaguccaccagcgggggcaccgccgcgcucggcugccuggugaaggacuacuucccggagcccgucacgguguccuggaacagcggggcccugaccuccggcgugcacaccuuccccgccguccuccagagcagcgggcuguacucccugagcuccguggugaccguccccagcuccagccucggcacgcagaccuacaucugcaacgugaaccacaagccguccaacaccaagguggacgcccgcgucgagcccaagagcugcgacaagacccacacgugcccgcccugcccggcccccgagcugcucgggggccccuccgugacccuguucccgcccaagcccaaggacacccugaugaucagccggacccccgaggugacgugcgucguggucgacgugucccacgaggaccccgaggugaaguucaacugguacgucgacggcguggaggugcacaacgcgaagaccaagccgcgcgaggagcaguacgccagcaccuaccgggucguguccgugcugaccguccuccaccaggacuggcugaacgggaaggaguacaagugcaaggugagcaacaaggcccugcccgcccccaucgagaagacgaucuccaaggccaagggccagccccgcgagccccagguguacacccucccgcccagccgggaggagaugaccaagaaccaggucucccugaccugccuggugaagggguucuaccccagcgacaucgcgguggagugggaguccaacggccagcccgagaacaacuacaagacgaccccgcccguccucgacagcgacgggagcuucuuccuguacuccaagcugaccguggacaagagccgcuggcagcagggcaacguguucuccugcagcgucaugcacgaggcccuccacaaccacuacacccagaagucccugagccugucccccggcaag

SEQ ID NO: 8640 - RNA, 657 nt, Artificial Sequence
  derived and/or modified sequence opt1 from Eptinezumab_LightChain
caggugcugacccagagccccuccagccucuccgccagcgucggcgaccgcgugaccaucaacugccaggccucccagagcguguaccacaacacguaccuggcgugguaccagcagaagccggggaagguccccaagcagcugaucuacgacgccuccacccucgccagcggcgugcccucccgguucagcggguccggcagcgggaccgacuucacccugacgaucuccagccugcagcccgaggacguggccaccuacuacugccucggcuccuacgacugcaccaacggcgacugcuucgucuucgggggcgggaccaagguggagaucaagcgcacgguggccgcgccgagcgucuucaucuucccgcccuccgacgagcagcucaagagcggcaccgccuccguggugugccugcugaacaacuucuacccccgggaggccaagguccaguggaagguggacaacgcccugcagagcgggaacagccaggaguccgugaccgagcaggacagcaaggacuccaccuacagccuguccagcacgcucacccuguccaaggcggacuacgagaagcacaaggucuacgccugcgaggugacccaccagggccugagcucccccgugaccaagagcuucaaccgcggcgagugc

SEQ ID NO: 8641 - RNA, 1368 nt, Artificial Sequence
  derived and/or modified sequence opt1 from Erenumab_HeavyChain
caggugcagcuggucgagagcggcgggggcguggugcagcccgggcgcucccuccggcugagcugcgccgccuccggcuucaccuucagcuccuucgggaugcacuggguccgccaggcgccgggcaagggccuggaguggguggccgugaucagcuucgacggguccaucaaguacagcgucgacuccgugaagggccgguucaccaucagccgcgacaacuccaagaacacccucuuccugcagaugaacagccugcgggccgaggacaccgccguguacuacugcgcccgcgaccggcucaacuacuacgacuccagcggguacuaccacuacaaguacuacggcauggcggucugggggcagggcaccaccgugacgguguccagcgccuccaccaagggccccagcgucuucccccuggcccccugcucccgcagcaccagcgaguccaccgccgcgcuggggugccucgugaaggacuacuucccggagcccgugacggucagcuggaacuccggcgcccugaccagcggggugcacaccuuccccgccgugcugcaguccagcggccucuacucccugagcuccgucgugaccgugcccagcuccaacuucggcacgcagaccuacacgugcaacgucgaccacaagccgagcaacaccaagguggacaagacgguggagcggaagugcugcgucgagugcccgcccugccccgccccgcccguggccgggcccuccgucuuccuguucccgcccaagcccaaggacacccucaugaucagccgcacccccgaggugaccugcguggucguggacgugucccacgaggaccccgagguccaguucaacugguacguggacggcguggagguccacaacgcgaagacgaagccgcgggaggagcaguucaacagcaccuuccgcgugguguccguccugaccguggugcaccaggacuggcugaacgggaaggaguacaagugcaaggucagcaacaagggccuccccgcccccaucgagaagaccaucuccaagacgaaggggcagccccgggagccccagguguacacccugccgcccagccgcgaggagaugaccaagaaccaggugagccugaccugccucgucaagggcuucuaccccuccgacaucgccguggagugggagagcaacggccagcccgagaacaacuacaagacgaccccgcccaugcuggacuccgacgggagcuucuuccuguacuccaagcucaccguggacaagagccgguggcagcagggcaacgucuucuccugcagcgugaugcacgaggcccugcacaaccacuacacccagaagucccugagccucucccccgggaag

SEQ ID NO: 8642 - RNA, 648 nt, Artificial Sequence
  derived and/or modified sequence opt1 from Erenumab_LightChain
cagagcgugcugacccagcccccguccgucagcgccgcccccggccagaaggugaccaucuccugcagcggguccagcuccaacaucggcaacaacuacgugagcugguaccagcagcuccccgggacggcgcccaagcugcugaucuacgacaacaacaagcgcccguccggcauccccgaccgguucagcggguccaagagcggcaccuccaccacccucggcaucacggggcugcagaccggcgacgaggccgacuacuacugcgggaccugggacagccgccuguccgccgucguguucggcgggggcaccaagcucacggugcugggccagcccaaggccaaccccaccgucacccuguucccgcccagcuccgaggagcuccaggccaacaaggcgacccuggugugccugaucagcgacuucuaccccggggccgugacggucgccuggaaggccgacggcucccccgugaaggcggggguggagaccaccaagccgagcaagcagagcaacaacaaguacgccgccuccagcuaccucucccugacccccgagcaguggaagucccaccggagcuacagcugccaggucacgcacgagggcuccaccguggagaagaccguggcccccaccgagugcagc

SEQ ID NO: 8643 - RNA, 1344 nt, Artificial Sequence
  derived and/or modified sequence opt1 from Fremanezumab_HeavyChain
gaggugcagcuggucgagagcggcgggggccucgugcagcccgggggcucccugcgccugagcugcgccgccuccggguucaccuucagcaacuacuggaucuccugggugcggcaggcgccgggcaagggccucgagugggucgccgagauccgcagcgaguccgacgccagcgccacccacuacgccgaggcggugaaggggcgguucacgaucucccgcgacaacgccaagaacagccuguaccugcagaugaacucccuccgggccgaggacaccgccguguacuacugccuggcguacuucgacuacggccuggccauccagaacuacugggggcagggcacccucgucaccgugagcuccgccagcacgaaggggcccuccguguucccccuggcccccugcagccgcuccaccagcgaguccaccgccgcgcugggcugccucgucaaggacuacuucccggagcccgugaccgugagcuggaacagcggcgcccugacguccgggguccacaccuuccccgccgugcugcagagcuccggccucuacagccuguccagcguggucaccgugcccuccagcaacuucgggacccagacguacacgugcaacguggaccacaagccguccaacaccaaggucgacaagaccguggagcggaagugcugcguggagugcccgcccugccccgccccgcccgucgccggccccagcguguuccuguucccgcccaagcccaaggacacccucaugaucucccgcacccccgaggugaccugcgucguggucgacgugagccacgaggaccccgaggugcaguucaacugguacgucgacggcguggaggugcacaacgcgaagaccaagccccgggaggagcaguucaacuccacguuccgcgucgugagcgugcugaccgucgugcaccaggacuggcugaacgggaaggaguacaagugcaagguguccaacaagggccuccccagcuccaucgagaagaccaucagcaagaccaaggggcagccccgggagccccaggucuacacgcugccgcccucccgcgaggagaugaccaagaaccaggugagccugaccugccucgugaagggcuucuaccccagcgacaucgccgucgagugggaguccaacgggcagcccgagaacaacuacaagaccacgccgcccaugcuggacagcgacggcuccuucuuccuguacagcaagcucaccguggacaagucccgguggcagcagggcaacguguucagcugcuccgucaugcacgaggcccugcacaaccacuacacccagaagucccugagccucagccccgggaag

SEQ ID NO: 8644 - RNA, 642 nt, Artificial Sequence
  derived and/or modified sequence opt1 from Fremanezumab_LightChain
gagaucgugcugacccagagccccgccacccucucccugagcccgggcgagcgggccacgcuguccugcaaggcgagcaagcgggucaccaccuacguguccugguaccagcagaagcccgggcaggcgccccgccuccugaucuacggcgccagcaaccgguaccuggggauccccgcccgcuucuccggcagcggguccggcaccgacuucacgcucaccaucagcucccuggagccggaggacuucgccguguacuacugcagccaguccuacaacuaccccuacaccuucggccaggggaccaagcuggagaucaagcggacggucgccgcccccagcguguucaucuucccgcccuccgacgagcagcucaagagcggcaccgccuccguggucugccugcugaacaacuucuacccccgcgaggccaaggugcaguggaagguggacaacgcgcuccagagcgggaacucccaggagagcgucaccgagcaggacagcaaggacuccaccuacagccuguccagcacgcugacccucuccaaggccgacuacgagaagcacaagguguacgccugcgaggugacccaccagggccugagcucccccgucaccaagagcuucaaccgcggggagugc

SEQ ID NO: 8645 - RNA, 1371 nt, Artificial Sequence
  derived and/or modified sequence opt1 from Frunevetmab_HeavyChain
caggugcagcuggucgagagcggcgccgagcucgugcagcccggggagucccugcgccugaccugcgccgcgagcggcuucucccucaccaacaacaacgugaacuggguccggcaggcccccgggaagggccuggaguggaugggcggggugugggccggcggggccacggacuacaacagcgcccugaagucccgccucaccaucacccgggacaccagcaagaacacgguguuccugcagaugcacucccugcagagcgaggacaccgcgaccuacuacugcgcccgcgacggcggguacuccagcuccacccucuacgccauggacgccuggggccaggggacgaccgucaccgugagcgcggccuccaccacggcccccagcguguucccccuggcccccuccugcggcaccaccagcggcgccaccgucgcgcuggccugccucgugcugggguacuucccggagcccgugacggucuccuggaacagcggcgcccugaccuccggggugcacaccuuccccgccgugcuccaggccagcggccuguacagccuguccagcauggucaccgugcccuccagccgguggcucuccgacacguucacgugcaacguggcgcacccgcccagcaacaccaaggucgacaagaccgugcgcaagaccgaccacccgcccggccccaagcccugcgacugccccaagugcccgccgcccgagaugcucgggggccccuccaucuucaucuucccgcccaagcccaaggacacccugagcaucucccggacccccgaggugaccugccucgucguggaccuggggcccgacgacagcgacgugcagaucacgugguucgucgacaacacccagguguacaccgccaagaccagcccccgcgaggagcaguucaacuccacguaccgggucguguccgugcugcccauccuccaccaggacuggcugaagggcaaggaguucaagugcaaggucaacagcaagucccugcccagccccaucgagcgcaccaucuccaaggccaaggggcagccgcacgagccccagguguacgugcugcccccggcccaggaggagcugagccggaacaaggucuccgugaccugccugaucaagagcuuccacccgcccgacaucgccguggagugggagaucaccggccagcccgagcccgagaacaacuaccgcacgaccccgccccagcucgacagcgacggcaccuacuucgucuacuccaagcugagcguggaccggucccacuggcagcgcgggaacaccuacacgugcagcgugucccacgaggcgcugcacagccaccacacccagaagucccucacccagagccccggcaag

SEQ ID NO: 8646 - RNA, 651 nt, Artificial Sequence
  derived and/or modified sequence opt1 from Frunevetmab_LightChain
gacaucgagaugacccagagcccccugucccucagcgugaccccgggcgaguccgucagcaucuccugccgcgccagcgaggacaucuacaacgcccuggcgugguaccugcagaagcccgggcggagcccccgccuccugaucuacaacacggacacccugcacaccggcgugcccgaccgguucagcggguccggcagcgggaccgacuucacgcucaagaucucccgcgugcagaccgaggacgucggcguguacuucugccagcacuacuuccacuacccgcggaccuucggccaggggaccaagcuggagcugaagcgcagcgacgcccagcccuccguguuccucuuccagcccagccuggacgagcugcacacgggcuccgccagcaucgucugcauccucaacgacuucuaccccaaggaggugaacgugaaguggaaggucgacgggguggugcagaacaagggcauccaggaguccaccaccgagcagaacagcaaggacuccaccuacagccugagcuccacgcugaccaugagcuccaccgaguaccagagccacgagaaguucuccugcgaggucacccacaagagccucgccuccacgcuggugaaguccuucaaccgguccgagugccagcgcgag

SEQ ID NO: 8647 - RNA, 1341 nt, Artificial Sequence
  derived and/or modified sequence opt1 from Gatipotuzumab_HeavyChain
gaggugcagcuggucgagagcggcgggggccucgugcagcccgggggcuccaugcgccugagcugcguggccuccggguucccguucagcaacuacuggaugaacuggguccggcaggcccccggcaagggccuggagugggugggggagauccgccucaaguccaacaacuacaccacccacuacgcggagagcgugaagggccgguucaccaucucccgcgacgacagcaagaacucccuguaccugcagaugaacagccucaagaccgaggacaccgccgucuacuacugcacccggcacuacuacuucgacuacugggggcagggcacgcuggugaccguguccagcgccuccaccaaggggcccagcgucuucccccuggccccguccagcaaguccaccagcggcggcacggccgcgcucgggugccuggugaaggacuacuuccccgagcccgugaccgucuccuggaacagcggcgcccugaccagcggggugcacaccuuccccgccgugcuccaguccagcggccuguacucccugagcuccgucgugacggugccgagcuccagccucggcacccagaccuacaucugcaacgucaaccacaagcccuccaacaccaagguggacaagaagguggagcccaagagcugcgacaagacgcacacgugcccgcccugccccgcccccgagcugcucgggggccccuccgucuuccuguucccgcccaagcccaaggacacccugaugaucagccgcacccccgaggugaccugcguggucguggacgucucccacgaggacccggaggugaaguucaacugguacguggacggggucgaggugcacaacgcgaagaccaagccccgggaggagcaguacaacagcaccuaccgcguggucuccgugcugaccgugcuccaccaggacuggcugaacggcaaggaguacaagugcaaggucagcaacaaggcccugcccgcccccaucgagaagacgaucuccaaggccaaggggcagccgcgggagccccagguguacacccucccgcccagccgcgacgagcugaccaagaaccaggugucccugaccugccucgucaagggcuucuaccccagcgacaucgccguggagugggagagcaacggccagcccgagaacaacuacaagacgacgcccccggugcuggacuccgacgggagcuucuuccuguacuccaagcucaccgucgacaagagccgguggcagcagggcaacguguucuccugcagcgugaugcacgaggggcugcacaaccacuacacccagaagucccugagccucucccccggcaag

SEQ ID NO: 8648 - RNA, 657 nt, Artificial Sequence
  derived and/or modified sequence opt1 from Gatipotuzumab_LightChain
gacaucgugaugacccagagcccccuguccaacccggucacccccggcgagcccgccagcaucuccugccgcagcuccaagagccuccugcacuccaacgggaucacguacuucuucugguaccugcagaagcccggccagagcccgcagcuccugaucuaccagauguccaaccuggccagcggggugcccgaccgguucuccggcagcggguccggcaccgacuucacccuccgcaucagccggguggaggcggaggacgucggcguguacuacugcgcccagaaccuggagcugccgcccaccuucgggcagggcacgaagguggagaucaagcgcaccgucgccgcccccuccguguucaucuucccgcccagcgacgagcagcucaaguccgggaccgccagcguggucugccugcugaacaacuucuacccccgggaggcgaaggugcaguggaagguggacaacgcccuccaguccggcaacagccaggagagcgucaccgagcaggacuccaaggacagcacguacucccugagcuccacccugacccucagcaaggccgacuacgagaagcacaagguguacgccugcgaggugacccaccaggggcuguccagccccgucacgaaguccuucaaccgcggcgagugc

SEQ ID NO: 8649 - RNA, 1365 nt, Artificial Sequence
  derived and/or modified sequence opt1 from Gedivumab_HeavyChain
gaggugcagcuggucgagagcggcgggggcguggugcagcccgggaagucccuccgccugagcugcgccgccuccggccugaccuucagcuccuacgcgguccacugggugcggcaggccccggggaagggccucgagugggugacccugaucagcuacgacggcgccaaccaguacuacgccgacuccgucaaggggcgcuucacgaucagccgggacaacuccaagaacaccguguaccugcagaugaacagccuccgccccgaggacaccgccguguacuacugcgcgguccccggccccguguucgggaucuucccgcccugguccuacuucgacaacuggggccaggggauccuggugaccgucagcuccgccagcacgaagggccccuccguguucccccuggccccgagcuccaagagcaccuccggcgggaccgccgcgcucggcugccuggugaaggacuacuuccccgagcccgucaccgugagcuggaacagcggggcccugacguccggcgugcacaccuuccccgccguccuccagagcuccggccuguacagccuguccagcguggugaccgucccguccagcucccucgggacccagacguacaucugcaacgugaaccacaagcccagcaacaccaagguggacaagaaggucgagcccaaguccugcgacaagacccacacgugcccgcccugccccgcccccgagcugcugggcgggcccagcguguuccucuucccgcccaagcccaaggacacccugaugaucucccggacccccgaggugaccugcgucguggucgacgugagccacgaggacccggaggugaaguucaacugguacgucgacggcguggaggugcacaacgccaagaccaagccccgcgaggagcaguacaacuccacguaccgggucgugagcgugcugaccguccuccaccaggacuggcugaacgggaaggaguacaagugcaagguguccaacaaggcgcugcccgcccccaucgagaagaccaucagcaaggccaagggccagccgcgcgagccccagguguacacccucccgcccucccgggaggagaugacgaagaaccaggucagccugaccugccuggugaagggcuucuaccccagcgacaucgccguggagugggaguccaacgggcagcccgagaacaacuacaagaccacgcccccgguccucgacagcgacggcuccuucuuccuguacagcaagcugaccguggacaagucccgcuggcagcaggggaacguguucagcugcuccgucaugcacgaggcccuccacaaccacuacacccagaagucccugagccugagccccggcaag

SEQ ID NO: 8650 - RNA, 648 nt, Artificial Sequence
  derived and/or modified sequence opt1 from Gedivumab_LightChain
gagaucgugcugacccagagccccgccacccucuccgucagcccgggcgagcgcgccacgcuguccugccgggcgagccaggugaucucccacaaccuggccugguaccagcagaagcccgggcaggcgccccgccuccugaucuacggcgccagcacccgggccuccgggauccccgcccgcuucagcggcuccgggagcggcaccgacuacacccugacgaucaccucccuccagagcgaggacuucgccguguacuacugccagcacuacuccaacuggccgccccggcugaccuucggcgggggcaccaaggucgagaucaagcgcacgguggccgcccccagcguguucaucuucccgcccuccgacgagcagcucaagagcgggaccgcguccgucgugugccugcugaacaacuucuacccccgggaggccaaggugcaguggaaggucgacaacgcccugcagagcggcaacucccaggagagcgugaccgagcaggacagcaaggacuccaccuacagccucuccagcacgcugacccuguccaaggccgacuacgagaagcacaagguguacgccugcgaggucacccaccaggggcucagcucccccgugaccaagagcuucaaccgcggcgagugc

SEQ ID NO: 8651 - RNA, 1329 nt, Artificial Sequence
  derived and/or modified sequence opt1 from Gemetuzumab_HeavyChain
gaggugcagcugguccagagcggcgccgaggugaagaagcccggguccagcgugaaggucuccugcaaggccagcggcuacaccaucaccgacuccaacauccacugggugcgccaggcgcccgggcagagccucgaguggaucggcuacaucuaccccuacaacgggggcacggacuacaaccagaaguucaagaaccgggccacccugaccguggacaaccccaccaacacggccuacauggagcuguccagccuccgcuccgaggacaccgccuucuacuacugcgucaacggcaaccccuggcuggccuacugggggcagggcacccuggugaccgugagcuccgcgagcacgaaggggccguccgucuucccccucgcccccugcagccgguccaccagcgaguccaccgccgcccugggcugccuggugaaggacuacuuccccgagccggugaccgucagcuggaacuccggggcgcucacgagcggcgugcacaccuuccccgccgugcugcagagcuccggccuguacagccucuccagcgucgugaccgugcccuccagcucccuggggaccaagacguacacgugcaacgucgaccacaagcccagcaacaccaagguggacaagcgcguggaguccaaguacggcccgcccugcccgcccugccccgcccccgaguuccucgggggccccagcgucuuccuguucccgcccaagcccaaggacacccugaugaucucccggacccccgaggugaccugcguggucguggacgucagccaggaggaccccgaggugcaguucaacugguacguggacggcgucgaggugcacaacgccaagaccaagccgcgcgaggagcaguucaacuccaccuaccggguggucagcgugcugacggugcuccaccaggacuggcugaacgggaaggaguacaagugcaaggucuccaacaagggccugcccagcuccaucgagaagaccaucagcaaggccaaggggcagccccgcgagccccagguguacacccucccgcccucccaggaggagaugaccaagaaccaggugagccugacgugccuggucaagggcuucuaccccagcgacaucgcgguggagugggaguccaacgggcagccggagaacaacuacaagaccaccccgcccgugcucgacagcgacggcuccuucuuccuguacagccggcugaccgucgacaagucccgcuggcaggagggcaacguguucagcugcuccgugaugcacgaggcccuccacaaccacuacacgcagaagucccugagccugagccucgggaag

SEQ ID NO: 8652 - RNA, 654 nt, Artificial Sequence
  derived and/or modified sequence opt1 from Gemetuzumab_LightChain
gacauccagcugacccagagccccuccacccucagcgccuccgugggcgaccgcgucacgaucacgugccgggccagcgagucccuggacaacuacgggauccgcuuccugaccugguuccagcagaagccgggcaaggcgcccaagcuccugauguacgccgccagcaaccagggguccggcgugcccagccgguucuccgggagcggcuccggcaccgaguucacccugaccaucagcucccuccagcccgacgacuucgccaccuacuacugccagcagaccaaggaggugccguggagcuucgggcagggcacgaaggucgaggugaagcgcaccguggccgcgcccuccgucuucaucuucccgcccagcgacgagcagcugaaguccgggaccgccagcguggugugccugcucaacaacuucuacccccgggaggccaagguccaguggaagguggacaacgcccugcaguccggcaacagccaggagagcgugaccgagcaggacuccaaggacagcacguacucccugagcuccacccucacccugagcaaggcggacuacgagaagcacaaggucuacgccugcgaggugacccaccaggggcuguccagccccgugacgaaguccuucaaccgcggcgagugc

SEQ ID NO: 8653 - RNA, 1365 nt, Artificial Sequence
  derived and/or modified sequence opt1 from Gilvetmab_HeavyChain
gaggugcagcugguccagagcggcggggaccucgugaagcccggcggguccgugcgccugagcugcgucgccuccggcuucaacaucaagaacaccuacaugcacugggugcggcaggcccccgggaagggccugcaguggaucggccgcaucgcgcccgccaacguggacaccaaguacgcccccaaguuccaggggaaggccacgaucagcgccgacaccgcgaagaacaccgccuacaugcagcucaacucccugcgggccgaggacaccgccgucuacuacugcgugcugaucuacuacgacuacgacggcgacaucgacgugugggggcagggcacgcucgucaccgugagcuccgcgagcaccaccgcccccuccguguucccgcuggcccccagcugcggguccacgagcggcuccaccgucgcccuggccugccucgugagcggcuacuuccccgagcccgugaccgucuccuggaacagcgggucccugaccagcggcgugcacacguucccguccgugcugcagagcagcgggcucuacucccugagcuccauggucaccgugcccagcucccgcuggcccagcgagaccuucacgugcaacguggcgcaccccgccuccaagaccaaggucgacaagccggugcccaagcgggagaacggccgcgugccccggcccccggacugccccaagugccccgcccccgagaugcugggcgggccgagcgucuucaucuucccgcccaagcccaaggacacccuccugaucgcccgcacccccgaggugaccugcgucgugguggcccuggaccccgaggaccccgagguccagaucuccugguucguggacggcaagcagaugcagacggcgaagacccagccccgggaggagcaguucgccgggaccuaccgcguggucagcgugcucccgaucggccaccaggacuggcugaaggggaagcaguucacgugcaaggugaacaacaaggcccugcccucccccaucgagcggaccaucagcaaggcccgcggccaggcccaccagccguccgucuacgugcucccgcccagccgggaggagcuguccaagaacaccgugagccugaccugccucaucaaggacuucuucccgcccgacaucgacgucgaguggcaguccaacggccagcaggagcccgagagcaaguaccgcaccacgccgccccagcuggacgaggacggguccuacuuccuguacagcaagcucagcguggacaagucccgguggcagcgcggcgacaccuucaucugcgcggugaugcacgaggcccugcacaaccacuacacccaggagagccugucccacagccccgggaag

SEQ ID NO: 8654 - RNA, 654 nt, Artificial Sequence
  derived and/or modified sequence opt1 from Gilvetmab_LightChain
gacaucgugaugacccagacgccccugagccucuccgucagccugggcgagccggccuccaucagcugccacgccucccagaacaucaacguguggcugagcugguaccgccagaagcccgggcagaucccccagcuccugaucuacaaggcgucccaccuccacaccggcgugcccgaccgguucagcggguccggcagcgggaccgacuucacccugcgcaucucccgggucgaggccgacgacgccggcguguacuacugccagcagggccagagcuggccgcugaccuucgggcagggcacgaagguggagaucaagcgcaacgacgcccagcccgccgucuaccuguuccagcccucccccgaccagcuccacaccgggagcgcguccguggugugccugcugaacagcuucuacccgaaggacaucaacgucaaguggaagguggacggcgugauccaggacaccgggauccaggaguccgucaccgagcaggacagcaaggacuccacguacagccucagcuccacccugaccaugagcuccaccgaguaccugagccacgagcucuacuccugcgagaucacgcacaagagccugcccuccacccugaucaagagcuuccagcgguccgagugccagcgcguggac

SEQ ID NO: 8655 - RNA, 1344 nt, Artificial Sequence; identical to SEQ ID NO: 7938
  derived and/or modified sequence opt1 from Ifabotuzumab_HeavyChain

SEQ ID NO: 8656 - RNA, 642 nt, Artificial Sequence; identical to SEQ ID NO: 7939
  derived and/or modified sequence opt1 from Ifabotuzumab_LightChain

SEQ ID NO: 8657 - RNA, 1323 nt, Artificial Sequence
  derived and/or modified sequence opt1 from Iratumumab_HeavyChain
caggugcagcugcagcaguggggcgccgggcuccugaagcccagcgagacccugucccugaccugcgccgucuacggcgggagcuucuccgcguacuacuggagcuggauccgccagccgcccggcaaggggcuggaguggaucggcgacaucaaccacggcgggggcacgaacuacaaccccucccucaagagccgggugaccaucuccguggacaccagcaagaaccaguucucccucaagcugaacagcgucaccgccgccgacacggccguguacuacugcgccucccugaccgcguacugggggcagggcagccucgugaccgucuccagcgccuccaccaaggggcccagcguguucccgcuggcccccuccagcaaguccacgagcggcggcaccgccgcgcuggggugccucgugaaggacuacuuccccgagcccgucaccgugagcuggaacuccggcgcccugaccagcggggugcacacguucccggccguccugcaguccagcggccucuacucccugagcuccguggugaccguccccagcuccagccugggcacccagaccuacaucugcaacgugaaccacaagcccuccaacacgaagguggacaagaaggucgagcccaagagcugcgacaagacccacacgugcccgcccugccccgcccccgagcuccucgggggcccguccguguuccuguucccgcccaagcccaaggacacccugaugaucagccgcacccccgaggugaccugcgucgugguggacgucucccacgaggaccccgaggugaaguucaacugguacgucgacgggguggaggugcacaacgccaagaccaagccccgggaggagcaguacaacagcaccuaccgcgucguguccgugcugacgguccugcaccaggacuggcucaacggcaaggaguacaagugcaaggugagcaacaaggcgcugcccgccccgaucgagaagaccaucuccaaggccaaggggcagccccgggagccccagguguacacccugcccccgagccgcgacgagcucaccaagaaccaggucagccugacgugccuggugaagggcuucuaccccuccgacaucgccguggagugggagagcaacggccagcccgagaacaacuacaagaccaccccgcccguccucgacuccgacgggagcuucuuccuguacuccaagcugaccguggacaagagccgguggcagcagggcaacguguucuccugcagcgucaugcacgaggcccuccacaaccacacgcagaagucccugagccugucccccgggaag

SEQ ID NO: 8658 - RNA, 642 nt, Artificial Sequence
  derived and/or modified sequence opt1 from Iratumumab_LightChain
gacauccagaugacccagagccccaccucccugagcgccuccgugggcgaccgcgucacgaucacgugccgggccagccaggggaucuccagcuggcucaccugguaccagcagaagccggagaaggcgcccaagucccugaucuacgccgccagcucccugcagagcggcgugcccucccgcuucagcggguccggcagcgggaccgacuucacgcucaccaucuccagccugcagcccgaggacuucgccaccuacuacugccagcaguacgacuccuacccgaucaccuucggccagggcacgcggcuggagaucaagcgcaccguggccgcgcccagcgucuucaucuucccgcccuccgacgagcagcucaagagcgggaccgccagcguggugugccugcugaacaacuucuacccccgggaggccaagguccaguggaagguggacaacgcccuccaguccggcaacagccaggaguccgugaccgagcaggacagcaaggacuccacguacagccuguccagcacccugacccucuccaaggcggacuacgagaagcacaaggucuacgccugcgaggugacccaccaggggcugagcucccccgugaccaagagcuucaaccgcggcgagugc

SEQ ID NO: 8659 - RNA, 1344 nt, Artificial Sequence
  derived and/or modified sequence opt1 from Lacnotuzumab_HeavyChain
caggugcagcugcaggagagcggccccgggcucgucaagccgucccagacccugagccugaccugcacgguguccgacuacagcaucaccuccgacuacgccuggaacuggauccgccaguuccccggcaaggggcucgaguggaugggcuacaucagcuacuccgggagcaccuccuacaaccccagccugaagucccggaucaccaucagccgcgacacguccaagaaccaguucagccugcagcucaacuccgugaccgccgcggacaccgccgucuacuacugcgccagcuucgacuacgcccacgccauggacuacuggggccagggcaccacggugaccguguccagcgcguccaccaaggggcccagcgucuucccgcuggcccccagcuccaagagcaccuccggcgggacggccgcccugggcugccucgugaaggacuacuuccccgagcccgugaccgucagcuggaacuccggggcgcugaccagcggcgugcacaccuucccggccgugcugcaguccagcggccucuacucccugagcuccgucgugacggugcccagcuccagccuggggacccagaccuacaucugcaacgucaaccacaagcccuccaacaccaagguggacaagcggguggagcccaagagcugcgacaagacgcacacgugcccgcccugccccgcccccgagcuccugggcgggccguccgucuuccuguucccgcccaagcccaaggacacccucaugaucagccgcacccccgaggugaccugcguggucguggacgugucccacgaggaccccgaggucaaguucaacugguacguggacggcgucgaggugcacaacgccaagaccaagccccgggaggagcaguacaacagcaccuaccgcguggucagcgugcugaccgugcugcaccaggacuggcucaacggcaaggaguacaagugcaaggucuccaacaaggcccugcccgcgccgaucgagaagacgaucagcaaggccaaggggcagccccgggagccccagguguacacccugcccccgucccgcgaggagaugaccaagaaccaggugagccugaccugccucgucaagggcuucuaccccuccgacaucgccguggagugggagagcaacgggcagcccgagaacaacuacaagacgaccccgcccgugcuggacuccgacggcagcuucuuccucuacuccaagcugaccgucgacaagagccgguggcagcaggggaacguguucuccugcagcgugaugcacgaggcccugcacaaccacuacacccagaagucccucagccugucccccggcaag

SEQ ID NO: 8660 - RNA, 642 nt, Artificial Sequence
  derived and/or modified sequence opt1 from Lacnotuzumab_LightChain
gacaucgugcugacccagagccccgccuuccucuccgucaccccgggcgagaaggugacguucacgugccaggccagccaguccaucgggaccagcauccacugguaccagcagaagaccgaccaggcgcccaagcugcugaucaaguacgccuccgagagcaucuccggcauccccagccgguucuccgggagcggcuccgggaccgacuucacccucaccaucagcuccguggaggccgaggacgccgccgacuacuacugccagcagaucaacagcuggcccaccacguucggcggcgggaccaagcuggagaucaagcggaccgucgcggccccguccguguucaucuucccgcccagcgacgagcagcugaaguccggcaccgccagcguggucugccuccugaacaacuucuacccccgcgaggccaaggugcaguggaagguggacaacgcgcugcaguccgggaacagccaggagagcgucacggagcaggacuccaaggacagcaccuacucccucagcuccacccugacccugagcaaggccgacuacgagaagcacaagguguacgccugcgaggugacgcaccagggccucuccagccccgucaccaaguccuucaaccgcggggagugc

SEQ ID NO: 8661 - RNA, 1347 nt, Artificial Sequence
  derived and/or modified sequence opt1 from Larcaviximab_HeavyChain
gaggugcagcugcaggagagcggccccgagcucgagaugccgggggccuccgucaagaucagcugcaaggccuccggcagcuccuucaccggguucagcaugaacugggugaagcaguccaacggcaagagccuggaguggaucgggaacaucgacaccuacuacggcggcacgaccuacaaccagaaguucaaggggaaggcgacccugaccguggacaaguccagcuccacggccuacaugcagcucaagagccugaccuccgaggacagcgccgucuacuacugcgcccgcuccgccuacuacggcagcaccuucgcguacugggggcagggcacccuggugacgguguccgccgccagcaccaaggggcccuccgucuucccccucgcccccagcagcaaguccaccagcggcggcaccgcggcccuggggugccuggugaaggacuacuucccggagcccgugacggucuccuggaacagcggcgcccucaccuccggggugcacaccuuccccgccgugcugcagagcuccggccuguacagccucuccagcgucgugaccgugcccuccagcucccugggcacgcagaccuacaucugcaacgucaaccacaagccgagcaacaccaagguggacaagcggguggagcccaaguccugcgacaagacccacacgugcccgcccugcccggcccccgagcugcucgggggccccagcgucuuccuguucccgcccaagcccaaggacacccugaugaucucccgcacccccgaggugaccugcguggucguggacgugagccacgaggaccccgaggucaaguucaacugguacguggacggggucgaggugcacaacgcgaagacgaagccgcgggaggagcaguacaacuccaccuaccgcguggucagcgugcucaccgugcugcaccaggacuggcugaacggcaaggaguacaagugcaaggucagcaacaaggcccuccccgcccccaucgagaagaccaucuccaaggccaaggggcagccccgggagccccagguguacacgcugccgcccagccgcgacgagcugaccaagaaccaggugucccugaccugccucgucaagggcuucuaccccagcgacaucgccguggagugggaguccaacggccagcccgagaacaacuacaagaccacgccgcccgugcuggacagcgacggguccuucuuccucuacagcaagcugaccgucgacaagucccgguggcagcagggcaacguguucagcugcuccgugaugcacgaggcgcugcacaaccacuacacccagaagucccucagccugagccccgggaag

SEQ ID NO: 8662 - RNA, 642 nt, Artificial Sequence
  derived and/or modified sequence opt1 from Larcaviximab_LightChain
gacauccagaugacccagagccccgccucccugagcgccuccgugggcgagaccgucacgaucacgugccgcgcgagcgagaacaucuacuccuaccucgccugguaccagcagaagcagggcaagagcccgcagcugcugguguacaacgccaagacccucaucgagggggugcccucccgguucagcggguccggcagcgggacccaguucucccugaagaucaacagccugcagcccgaggacuucggcuccuacuucugccagcaccacuucggcacccccuucaccuucgggagcggcaccgagcucgagaucaagcgcaccgucgccgccccguccguguucaucuucccgcccagcgacgagcagcugaaguccgggacggcgagcguggucugccugcucaacaacuucuacccccgggaggccaaggugcaguggaagguggacaacgcccugcaguccggcaacagccaggagagcgucaccgagcaggacuccaaggacagcaccuacucccugagcuccacccucacgcugagcaaggccgacuacgagaagcacaagguguacgcgugcgaggugacccaccaggggcuguccagccccgucaccaaguccuucaaccgcggcgagugc

SEQ ID NO: 8663 - RNA, 1338 nt, Artificial Sequence
  derived and/or modified sequence opt1 from Lendalizumab_HeavyChain
caggugcagcugguccagagcggcgccgaggugaagaagcccggggccuccgugaaggucagcugcaaggcguccggcuacaccuucaccgacuacagcauggacugggugcgccaggcccccgggcagggccucgaguggaugggggccauccaccugaacacgggcuacaccaacuacaaccagaaguucaagggccgggugaccaugacccgcgacacguccaccagcaccgucuacauggagcuguccagccuccgguccgaggacaccgccguguacuacugcgcccgcggguucuacgacggcuacagccccauggacuacugggggcagggcacgaccgugaccgucuccagcgcguccaccaaggggcccagcguguucccccuggccccgugcucccggagcacguccgagagcaccgccgcccugggcugccucgugaaggacuacuuccccgagcccgucaccguguccuggaacagcggcgcgcugaccagcggggugcacacguuccccgccguccugcaguccagcggccucuacucccugagcuccguggugaccgucccgagcuccaacuucgggacccagaccuacacgugcaacguggaccacaagcccagcaacaccaagguggacaagaccgucgagcgcaagugcugcguggagugcccgcccugcccggccccgcccguggccggccccuccgucuuccuguucccgcccaagcccaaggacacccucaugaucagccggacgcccgaggugaccugcgucgugguggacgucucccaggaggaccccgaggugcaguucaacugguacguggacggcgucgaggugcacaacgccaagaccaagccccgcgaggagcaguucaacagcaccuaccggguggucuccgugcugacggugcugcaccaggacuggcucaacgggaaggaguacaagugcaaggucagcaacaagggccugcccuccagcaucgagaagaccaucuccaaggcgaaggggcagccccgcgagccccagguguacacccugccgcccagccaggaggagaugaccaagaaccaggugucccucacgugccuggucaagggcuucuaccccagcgacaucgccguggagugggagagcaacgggcagcccgagaacaacuacaagaccaccccgcccgugcuggacuccgacggcagcuucuuccucuacucccggcugaccgucgacaagagccgcuggcaggagggcaacguguucuccugcagcgugaugcacgaggcccugcacaaccacuacacgcagaagucccucagccugucccuggggaag

SEQ ID NO: 8664 - RNA, 654 nt, Artificial Sequence
  derived and/or modified sequence opt1 from Lendalizumab_LightChain
gacauccagaugacccagagccccuccagccuguccgccagcgugggcgaccgcgucaccaucacgugccgggccuccgagagcguggacuccuacgggaacagcuucaugcacugguaccagcagaagccgggcaaggcgcccaagcuccugaucuaccgcgccuccaaccuggagagcggggugcccucccgguucagcggcuccgggagcggcaccgacuucacccucaccaucuccagccugcagcccgaggacuucgccacguacuacugccagcaguccaacgaggacccguacaccuucggcgggggcaccaaggucgagaucaagcgcaccguggccgcccccagcguguucaucuucccgcccuccgacgagcagcucaagagcgggacggcgagcgucgugugccugcugaacaacuucuacccccgggaggccaaggugcaguggaaggucgacaacgcccugcaguccggcaacagccaggaguccgugaccgagcaggacagcaaggacuccaccuacagccucuccagcacccugacgcuguccaaggccgacuacgagaagcacaagguguacgcgugcgaggucacccaccaggggcucagcucccccgugaccaagagcuucaaccgcggcgagugc

SEQ ID NO: 8665 - RNA, 1359 nt, Artificial Sequence
  derived and/or modified sequence opt1 from Lesofavumab_HeavyChain
gaggugcagcugguccagagcggcgccgaggugaagaagcccggggagucccucaagaucagcugcaagguguccggcuacagcuucaccucccaguggaucggguggguccgccagaugcccggcaaggggcuggaguggaucggcaugauguaccccggcgagagcgagaccaucuacucccccagcuuccagggccaggugacgaucuccgccgacaacagcaucuccaccgcguaccugcaguggagcucccucaaggccagcgacaccgccaucuacuacugcgccuccgggcccggguacagcggcuaccacuacgggugguucgacaccuggggccagggcacgcuggugaccgucuccagcgccuccaccaaggggccgagcguguucccccuggcgcccagcuccaagagcaccuccggcgggacggccgcccucggcugccuggugaaggacuacuuccccgagccggucaccgugagcuggaacuccggcgcccugaccagcggggugcacaccuuccccgcgguccuccaguccagcggccuguacucccugagcuccguggugacgguccccagcuccagccucgggacccagaccuacaucugcaacgugaaccacaagcccuccaacaccaagguggacaagaaggucgagcccaagagcugcgacaagacgcacacgugcccgcccugccccgccccggagcugcugggcgggcccuccguguuccucuucccgcccaagcccaaggacacccugaugaucagccggacccccgaggugaccugcgucgugguggacgucucccacgaggaccccgaggugaaguucaacugguacgucgacggcguggaggugcacaacgccaagaccaagccccgcgaggagcaguacaacagcaccuaccgggucgugagcgugcugaccguccuccaccaggacuggcugaacggcaaggaguacaagugcaagguguccaacaaggcccugccggcccccaucgagaagacgaucagcaaggcgaaggggcagccccgcgagccccagguguacacccucccgcccucccgggaggagaugaccaagaaccaggucagccugaccugccuggugaagggcuucuaccccuccgacaucgccguggagugggagagcaacgggcagccggagaacaacuacaagacgaccccgcccguccucgacuccgacggcagcuucuuccuguacuccaagcugaccguggacaagagccgcuggcagcaggggaacguguucuccugcagcgucaugcacgaggcccuccacaaccacuacacccagaagucccugagccugucccccggcaag

SEQ ID NO: 8666 - RNA, 657 nt, Artificial Sequence
  derived and/or modified sequence opt1 from Lesofavumab_LightChain
gacaucgugaugacccagagcccccugucccucccggucacccccggcgagcccgccagcaucuccugccgcagcucccagagccugcugcgguccaacggguacaacuaccucgacugguaccugcagaagcccggccagagcccgcagcugcucaucuaccugggguccaaccgcgccagcggcgugcccgaccgguucuccgggagcggcuccggcacggacuucacccugaagaucagccgcguggaggcggaggacgucgggguguacuacugcaugcaggcccuccagacccccuacaccuucggccaggggacgaagcuggagaucaagcggaccguggccgcccccuccgucuucaucuucccgcccagcgacgagcagcugaaguccggcaccgccagcguggugugccuccugaacaacuucuacccccgcgaggcgaagguccaguggaagguggacaacgcccugcaguccgggaacagccaggagagcgugaccgagcaggacuccaaggacagcacguacucccucagcuccacccugacccugagcaaggccgacuacgagaagcacaaggucuacgccugcgaggugacccaccagggccucuccagccccgugacgaaguccuucaaccggggcgagugc

SEQ ID NO: 8667 - RNA, 1059 nt, Artificial Sequence
  derived and/or modified sequence opt1 from Letolizumab_HeavyChain
gaggugcagcugcucgagagcggcgggggccugguccagcccgggggcucccugcgccucagcugcgccgccuccggguucaccuucaacugggagcugaugggcugggcgcggcaggcccccggcaaggggcuggagugggugagcggcaucgaggggcccggcgacgugaccuacuacgccgacuccgucaaggggcgcuucacgaucagccgggacaacuccaagaacacccucuaccugcagaugaacagccugcgcgccgaggacaccgccguguacuacugcgugaaggucggcaaggacgcgaaguccgacuaccggggccaggggacccucgugacggugagcuccgccagcaccgagcccaaguccagcgacaagacccacaccagcccgcccagccccgcccccgagcugcugggcggguccagcgucuuccucuucccgcccaagcccaaggacacgcugaugaucucccgcacccccgaggugaccugcguggucguggacgugagccacgaggaccccgaggucaaguucaacugguacguggacggcguggagguccacaacgccaagaccaagccgcgggaggagcaguacaacagcacguaccgcgugguguccguccugaccgugcuccaccaggacuggcugaacggcaaggaguacaagugcaaggugagcaacaaggcgcugcccgcccccaucgagaagaccaucuccaaggccaaggggcagccccgggagccgcaggucuacacccucccgcccagccgcgacgagcugacgaagaaccaggugucccugaccugccucgucaagggcuucuaccccagcgacaucgccguggagugggaguccaacgggcagcccgagaacaacuacaagaccaccccgcccgugcuggacagcgacggcuccuucuuccuguacagcaagcucacggucgacaagucccgguggcagcaggggaacguguucagcugcuccgugaugcacgaggcccugcacaaccacuacacccagaagucccugucccucagccccggcaag

SEQ ID NO: 8668 - RNA, 1338 nt, Artificial Sequence
  derived and/or modified sequence opt1 from Losatuxizumab_HeavyChain
gaggugcagcugcaggagagcggccccgggcucgucaagccgucccagacccugagccugaccugcacgguguccggcuacagcaucucccgcgacuucgccuggaacuggauccggcagccgcccgggaagggccucgaguggaugggguacaucagcuacaacggcaacacccgcuaccagcccucccucaagagccggaucaccaucucccgcgacaccagcaagaaccaguucuuccugaagcugaacuccgugacggccgcggacaccgccaccuacuacugcgucaccgccagccggggcuucccguacugggggcagggcacgcuggugaccguguccagcgccuccaccaaggggcccagcgucuucccccuggcccccuccagcaaguccaccagcggcgggacggcggcccucggcugccuggugaaggacuacuucccggagcccgugaccgucagcuggaacuccggcgcccugaccagcggggugcacaccuuccccgccgugcuccaguccagcggccuguacucccugagcuccgucgugacggugcccagcuccagccucgggacccagaccuacaucugcaacgucaaccacaagccguccaacaccaagguggacaagaagguggagcccaagagcugcgacaagacgcacacgugcccgcccugccccgcgcccgagcugcugggcggccccuccgucuuccucuucccgcccaagcccaaggacacccugaugaucagccgcacccccgaggugaccugcguggucguggacgugucccacgaggaccccgaggucaaguucaacugguacguggacggggucgaggugcacaacgccaagaccaagccgcgggaggagcaguacaacagcaccuaccgcguggucuccgugcugaccgugcuccaccaggacuggcugaacggcaaggaguacaagugcaaggucagcaacaaggcccugcccgcccccaucgagaagacgaucuccaaggccaaggggcagccccgggagccccagguguacacccucccgcccagccgcgaggagaugaccaagaaccaggugagccugaccugccuggucaagggcuucuaccccuccgacaucgcgguggagugggagagcaacgggcagcccgagaacaacuacaagacgaccccgcccgugcucgacuccgacggcagcuucuuccuguacuccaagcugaccgucgacaagagccgguggcagcagggcaacguguucuccugcagcgugaugcacgaggcccuccacaaccacuacacccagaagucccugagccugucccccgggaag

SEQ ID NO: 8669 - RNA, 642 nt, Artificial Sequence; identical to SEQ ID NO: 7847
  derived and/or modified sequence opt1 from Losatuxizumab_LightChain

SEQ ID NO: 8670 - RNA, 1338 nt, Artificial Sequence
  derived and/or modified sequence opt1 from Lupartumab_HeavyChain
gaggugcagcugcucgagagcggcgggggccugguccagcccgggggcucccugcgccucagcugcgccgccuccggguucaccuucagcaacgcguggauguccugggugcggcaggccccgggcaagggccuggagugggugagcuacaucuccagcuccgggagcaccaucuacuacgccgacuccgucaagggccgcuucacgaucagccgggacaacuccaagaacacccuguaccuccagaugaacagccugcgcgccgaggacaccgccguguacuacugcgcgcgggaggggcugugggccuucgacuacuggggccaggggacccucgugacggucuccagcgccuccaccaagggccccagcguguucccccuggcccccuccagcaagagcaccuccggcgggaccgcggcccugggcugccucgugaaggacuacuucccggagcccgucacggugagcuggaacuccggggcccugaccagcggcgugcacaccuuccccgccguccugcaguccagcggccucuacucccugagcuccguggugaccguccccagcuccagccuggggacgcagaccuacaucugcaacgugaaccacaagccguccaacaccaagguggacaagaaggucgagcccaagagcugcgacaagacccacacgugcccgcccugcccggcccccgagcuccugggcgggcccuccguguuccuguucccgcccaagcccaaggacacccucaugaucagccgcacccccgaggugaccugcgucgugguggacgucucccacgaggaccccgaggugaaguucaacugguacgucgacggcguggaggugcacaacgcgaagacgaagccgcgggaggagcaguacaacagcaccuaccgcgucguguccgugcugaccguccugcaccaggacuggcucaacgggaaggaguacaagugcaaggugagcaacaaggcccugcccgcccccaucgagaagaccaucagcaaggccaagggccagccccgggagccccagguguacacgcugccgcccucccgcgacgagcucaccaagaaccaggucagccugaccugccuggugaagggcuucuaccccuccgacaucgccguggagugggagagcaacgggcagcccgagaacaacuacaagaccacgccgcccguccucgacuccgacggcagcuucuuccuguacuccaagcugaccguggacaagagccgguggcagcaggggaacguguucuccugcagcgucaugcacgaggcgcuccacaaccacuacacccagaagucccugagccugucccccggc

SEQ ID NO: 8671 - RNA, 651 nt, Artificial Sequence
  derived and/or modified sequence opt1 from Lupartumab_LightChain
gagagcgugcugacccagcccccguccgucagcggcgcccccgggcagcgcgugaccaucuccugcacgggcagcuccagcaacaucggggccggcuacgugguccacugguaccagcagcuccccgggaccgcgcccaagcugcugaucuacgacaacaacaagcggccguccggcgugcccgaccgcuucagcggcuccaagagcgggaccuccgccagccucgccaucuccggccugcggagcgaggacgaggccgacuacuacugcgccgcgugggacgaccgccugaacgggcccguguucggcgggggcaccaagcucacgguccugggccagcccaaggccgccccguccgugacccuguucccgcccagcuccgaggagcuccaggccaacaaggcgacccuggugugccugaucagcgacuucuaccccggggccgucaccguggccuggaaggccgacuccagccccgugaaggccggcgucgagacgaccacccccagcaagcaguccaacaacaaguacgcggccagcuccuaccucagccugacccccgagcaguggaagucccaccggagcuacuccugccaggugacgcacgaggggagcaccguggagaagaccgucgcccccaccgagugcucc

SEQ ID NO: 8672 - RNA, 1731 nt, Artificial Sequence
  derived and/or modified sequence opt1 from Lutikizumab_HeavyChain
gaggugcagcuggucgagagcggcgggggcguggugcagcccgggcgcucccuccggcugagcugcuccgccagcggcuucaucuucucccgcuacgacaugagcuggguccggcaggccccggggaagggccuggaguggguggcguacaucucccacggcggggccggcaccuacuaccccgacagcgugaaggggcgcuucaccaucucccgggacaacagcaagaacacccucuuccugcagauggacucccugcgccccgaggacaccggcgucuacuucugcgcccgcgggggcgugaccaagggcuacuucgacgugugggggcagggcacccccgucacggugagcuccgccagcaccaaggggccccaggugcagcucgucgaguccggcggcgggguggugcagcccggccggagccugcggcuguccugcaccgccagcggguucaccuucuccauguucggcguccacugggugcgccaggcgcccgggaagggccucgaguggguggccgccgucagcuacgacggcagcaacaaguacuacgccgaguccgugaaggggcgguucacgaucagccgcgacaacuccaagaacauccuguuccugcagauggacagccuccggcuggaggacaccgcgguguacuacugcgcccgcggccggcccaaggucgugaucccggcgccccuggcccacugggggcagggcacccucgugaccuucuccagcgccuccacgaaggggcccagcgucuucccccuggccccguccagcaaguccaccagcggcggcaccgccgcccuggggugccucgugaaggacuacuuccccgagcccgucaccguguccuggaacagcggcgcccugacguccggggugcacaccuuccccgccguccugcagagcuccggccucuacagccuguccagcguggugaccgucccgagcuccagccuggggacccagacguacaucugcaacgugaaccacaagcccuccaacaccaagguggacaagaaggucgagcccaagagcugcgacaagacccacacgugcccgccgugccccgcgcccgaggccgccggcggccccuccguguuccucuucccgcccaagcccaaggacacgcugaugaucagccgcacccccgaggugaccugcgucgugguggacgucucccacgaggacccggaggugaaguucaacugguacguggacggggucgaggugcacaacgccaagaccaagccccgggaggagcaguacaacagcacguaccgcguggucuccgugcugaccgugcuccaccaggacuggcugaacggcaaggaguacaagugcaaggucagcaacaaggcccugcccgcgccgaucgagaagaccaucuccaaggccaaggggcagccccgggagccccagguguacacccucccgcccagccgcgaggagaugacgaagaaccaggugucccugaccugccuggucaagggcuucuaccccagcgacaucgccguggagugggaguccaacggccagcccgagaacaacuacaagaccacgcccccggugcucgacagcgacggguccuucuuccuguacagcaagcugaccgucgacaagagccgguggcagcagggcaacguguucuccugcagcgugaugcacgaggcccuccacaaccacuacacccagaagucccugagccugucccccgggaag

SEQ ID NO: 8673 - RNA, 981 nt, Artificial Sequence
  derived and/or modified sequence opt1 from Lutikizumab_LightChain
gacauccagaugacccagagccccuccagccuguccgccagcgugggcgaccgggucaccaucacgugccgggccuccgggaacauccacaacuaccucaccugguaccagcagaccccgggcaaggcgcccaagcugcugaucuacaacgccaagacccucgccgacggggugcccagccgcuucuccggcagcggguccggcacggacuacaccuucaccaucagcucccugcagcccgaggacaucgccaccuacuacugccagcacuucuggagcaucccguacacguucggccaggggaccaagcugcagaucacccggaccguggccgcgcccgacauccagaugacgcagucccccagcuccgucagcgccuccgugggcgaccgcgugaccaucacgugccgggccagccaggggaucuccagcuggcucgccugguaccagcagaagcccggcaaggcgccgaagcugcugaucuacgaggccagcaaccucgagaccgggguccccucccgcuucagcggcuccggcagcggguccgacuucacccugaccaucagcucccugcagcccgaggacuucgccaccuacuacugccagcagaccagcuccuuccuccugagcuucggcgggggcacgaagguggagcacaagcggaccguggccgcccccuccgucuucaucuucccgcccagcgacgagcagcugaaguccggcaccgcgagcguggugugccuccugaacaacuucuacccccgcgaggccaagguccaguggaagguggacaacgcccugcaguccgggaacagccaggaguccgugaccgagcaggacagcaaggacuccacguacagccucagcuccacccugacccugagcaaggccgacuacgagaagcacaaggucuacgccugcgaggugacccaccagggccucuccagccccgugacgaaguccuucaaccgcggggagugc

SEQ ID NO: 8674 - RNA, 1341 nt, Artificial Sequence
  derived and/or modified sequence opt1 from Oleclumab_HeavyChain
gaggugcagcugcucgagagcggcgggggccugguccagcccgggggcucccugcgccucagcugcgccgccuccggguucaccuucagcuccuacgcguacagcugggugcggcaggccccgggcaagggccuggaguggguguccgccaucagcggguccggcgggcgcaccuacuacgccgacagcgucaagggccgguucacgaucucccgcgacaacagcaagaacacccuguaccuccagaugaacucccugcgggccgaggacaccgcgguguacuacugcgcccgccugggguacggccggguggacgaguggggccgcgggacccucgucacggugagcuccgccagcaccaagggccccuccguguucccccuggcccccagcuccaagagcaccagcgggggcaccgcggcccugggcugccucgucaaggacuacuucccggagcccgugacgguguccuggaacagcggggcccugaccuccggcguccacaccuuccccgccgugcugcagagcuccgggcucuacagccuguccagcguggucaccgugcccuccagcucccugggcacgcagaccuacaucugcaacgugaaccacaagccgagcaacaccaaggucgacaagcggguggagcccaaguccugcgacaagacccacacgugcccgcccugccccgcccccgaguucgagggcgggcccagcguguuccucuucccgcccaagcccaaggacacccugaugaucucccgcacccccgaggugaccugcgucguggucgacgugagccacgaggaccccgaggucaaguucaacugguacguggacggcguggagguccacaacgcgaagacgaagccgcgggaggagcaguacaacuccaccuaccgcguggugagcguccugaccgugcuccaccaggacuggcugaacgggaaggaguacaagugcaagguguccaacaaggcccugcccgccagcaucgagaagaccaucagcaaggccaagggccagccccgggagccccaggucuacacgcucccgcccucccgcgaggagaugaccaagaaccaggugagccugaccugccuggugaagggguucuaccccuccgacaucgccgucgagugggagagcaacggccagcccgagaacaacuacaagaccacgccgcccgugcucgacuccgacgggagcuucuuccuguacuccaagcugaccguggacaagagccgguggcagcagggcaacgucuucuccugcagcgugaugcacgaggcgcuccacaaccacuacacccagaagucccugagccugucccccggcaag

SEQ ID NO: 8675 - RNA, 648 nt, Artificial Sequence
  derived and/or modified sequence opt1 from Oleclumab_LightChain
cagagcgugcugacccagcccccguccgccagcggcacccccgggcagcgcgucacgaucuccugcagcggcucccucagcaacaucgggcggaaccccgugaacugguaccagcagcugcccggcaccgccccgaagcugcucaucuaccuggacaaccugcgccucuccggggugcccgaccgguucagcggcuccaagagcggcaccuccgcgagccuggccaucuccgggcugcagagcgaggacgaggccgacuacuacugcgccaccugggacgacucccaccccggcuggacguucgggggcgggaccaagcucaccguccugggccagcccaaggccgcgccgagcgugacccuguucccgcccuccagcgaggagcuccaggccaacaaggccacgcuggugugccugaucuccgacuucuaccccggcgccgucaccguggcguggaaggccgacagcagccccgugaaggccggggucgagaccaccacgcccuccaagcagagcaacaacaaguacgccgccuccagcuaccucucccugacccccgagcaguggaagucccaccgcagcuacagcugccaggugacccacgagggcuccaccguggagaagacggucgcgcccaccgagugcagc

SEQ ID NO: 8676 - RNA, 1449 nt, Artificial Sequence; identical to SEQ ID NO: 8291
  derived and/or modified sequence opt1 from Otlertuzumab_HeavyChain

SEQ ID NO: 8677 - RNA, 339 nt, Artificial Sequence
  derived and/or modified sequence opt1 from Ozoralizumab_HeavyChain
gaggugcagcuggucgagagcggcgggggccucgugcagcccgggggcucccugcgccugagcugcgccgccuccggguucaccuucagcgacuacuggauguacugggugcggcaggcgccgggcaagggccucgagugggucuccgagaucaacaccaacgggcugaucacgaaguaccccgacagcgugaagggccgcuucaccaucucccgggacaacgccaagaacacccuguaccuccagaugaacagccugcgccccgaggacaccgccguguacuacugcgcccggucccccagcggguucaaccgcggccaggggacgcuggucaccgug

SEQ ID NO: 8678 - RNA, 1089 nt, Artificial Sequence; identical to SEQ ID NO: 8296
  derived and/or modified sequence opt1 from Ozoralizumab_HeavyChain_HeavyChain_HeavyChain

SEQ ID NO: 8679 - RNA, 1494 nt, Artificial Sequence
  derived and/or modified sequence opt1 from Pasotuxizumab_HeavyChain_LightChain_HeavyChain_LightChain
caggugcagcuggucgagagcggcgggggccucgugaagcccggggagucccugcgccugagcugcgccgccuccggcuucaccuucagcgacuacuacauguacugggugcggcaggcgccggggaagggccucgagugggucgccaucaucuccgacggcggguacuacaccuacuacagcgacaucaucaagggccgcuucacgaucucccgggacaacgccaagaacagccuguaccugcagaugaacucccucaaggccgaggacaccgccguguacuacugcgcgcgcggguucccccugcugcggcacggcgccauggacuacugggggcagggcacccucgugaccgucagcuccggcgggggcgggagcggcggcgggggcuccgggggcgggggcagcgacauccagaugacgcagucccccagcucccugagcgccuccgugggcgaccgcgugaccaucacgugcaaggccagccagaacgucgacaccaacguggcgugguaccagcagaagcccgggcaggcccccaagagccugaucuacuccgccagcuaccgguacuccgacgugcccagccgcuucuccggcagcgccuccgggaccgacuucacccucaccaucagcuccguccagagcgaggacuucgccaccuacuacugccagcaguacgacuccuaccccuacacguucggcgggggcaccaagcuggagaucaagagcggcgggggcggguccgaggugcagcugguggagagcggcgggggccucguccagcccggcgggucccugaagcugagcugcgcggccuccggcuucaccuucaacaaguacgccaugaacugggugcggcaggccccggggaagggccucgaguggguggcccgcauccggagcaaguacaacaacuacgcgaccuacuacgccgacuccgucaaggaccgcuucacgaucagccgggacgacagcaagaacaccgccuaccugcagaugaacaaccugaagaccgaggacaccgccguguacuacugcgugcgccacggcaacuucgggaacuccuacaucagcuacugggccuacuggggccaggggacgcucgucaccguguccagcggcgggggcggcuccgggggcgggggcagcgggggcggcgggucccagaccguggucacccaggagcccagccugacggugucccccggcgggaccgucacccugaccugcggcagcuccacgggggcggugaccagcggcaacuaccccaacugggugcagcagaagccgggccaggccccgcgggggcucaucggcgggaccaaguuccuggcccccggcacccccgcccgcuucuccgggagccugcucggcggcaaggccgcgcugacgcuguccgggguccagccggaggacgaggccgaguacuacugcgugcucugguacagcaaccgguggguguucggcgggggcaccaagcugaccguccug

SEQ ID NO: 8680 - RNA, 357 nt, Artificial Sequence
  derived and/or modified sequence opt1 from Pasotuxizumab_HeavyChain1
caggugcagcuggucgagagcggcgggggccucgugaagcccggggagucccugcgccugagcugcgccgccuccggcuucaccuucagcgacuacuacauguacugggugcggcaggcgccggggaagggccucgagugggucgccaucaucuccgacggcggguacuacaccuacuacagcgacaucaucaagggccgcuucacgaucucccgggacaacgccaagaacagccuguaccugcagaugaacucccucaaggccgaggacaccgccguguacuacugcgcgcgcggguucccccugcugcggcacggcgccauggacuacugggggcagggcacccucgugaccguc

SEQ ID NO: 8681 - RNA, 369 nt, Artificial Sequence
  derived and/or modified sequence opt1 from Pasotuxizumab_HeavyChain2
gaggugcagcuggucgagagcggcgggggccucgugcagcccgggggcucccugaagcugagcugcgccgccuccggguucaccuucaacaaguacgcgaugaacugggugcgccaggccccgggcaagggccucgagugggucgcccggauccgcagcaaguacaacaacuacgccaccuacuacgccgacuccgugaaggaccgguucacgaucagccgcgacgacuccaagaacaccgcguaccugcagaugaacaaccugaagaccgaggacaccgccguguacuacugcguccggcacgggaacuucggcaacagcuacaucuccuacugggccuacugggggcagggcacgcucgugaccgug

SEQ ID NO: 8682 - RNA, 321 nt, Artificial Sequence
  derived and/or modified sequence opt1 from Pasotuxizumab_LightChain1
gacauccagaugacccagagccccuccagccuguccgccagcgugggcgaccgcgucaccaucacgugcaaggccucccagaacguggacaccaacguggcgugguaccagcagaagccggggcaggcccccaagagccucaucuacuccgccagcuaccgguacuccgacguccccagccgcuucuccggcagcgccuccgggaccgacuucacccugacgaucagcuccgugcagagcgaggacuucgccaccuacuacugccagcaguacgacuccuaccccuacaccuucggcgggggcaccaagcuggagaucaag

SEQ ID NO: 8683 - RNA, 327 nt, Artificial Sequence
  derived and/or modified sequence opt1 from Pasotuxizumab_LightChain2
cagaccguggucacccaggagcccagccugacgguguccccgggcgggaccgugacccugaccugcggcagcuccacgggggccgucaccagcggcaacuaccccaacugggugcagcagaagcccgggcaggcgccccgcggccucaucggcgggaccaaguuccuggccccgggcacccccgcccgguucuccgggagccuccugggcgggaaggccgcccugacgcucuccggcgugcagcccgaggacgaggccgaguacuacugcguccugugguacagcaaccgcuggguguucggcgggggcaccaagcugaccgugcuc

SEQ ID NO: 8684 - RNA, 1023 nt, Artificial Sequence; identical to SEQ ID NO: 8340
  derived and/or modified sequence opt1 from Placulumab_HeavyChain

SEQ ID NO: 8685 - RNA, 1353 nt, Artificial Sequence
  derived and/or modified sequence opt1 from Porgaviximab_HeavyChain
gaggugcagcugcaggagagcggcgggggccucaugcagcccgggggcuccaugaagcugagcugcgucgccuccggguucaccuucagcaacuacuggaugaacugggugcgccaguccccggagaagggccuggaguggguggccgagauccggcucaagagcaacaacuacgcgacccacuacgccgaguccgucaagggccgcuucacgaucagccgggacgacuccaagcgcagcguguaccugcagaugaacacccugcgggccgaggacaccgggaucuacuacugcacccgcggcaacgggaacuaccgggccauggacuacuggggccaggggacguccgugaccgucagcuccgccagcaccaagggccccuccguguucccccucgcgcccagcuccaagagcaccuccggcgggacggccgcccugggcugccuggugaaggacuacuucccggagcccgucaccgugagcuggaacagcggggcccucaccuccggcgugcacaccuuccccgcgguccugcagagcuccggccuguacagccucuccagcguggugacgguccccuccagcucccuggggacccagaccuacaucugcaacgugaaccacaagccgagcaacaccaagguggacaagcgcgucgagcccaaguccugcgacaagacgcacacgugcccgcccugcccggcccccgagcugcucggcgggcccagcguguuccuguucccgcccaagcccaaggacacccugaugaucucccggacccccgaggugaccugcgucgugguggacgucagccacgaggaccccgaggugaaguucaacugguacgucgacggcguggaggugcacaacgccaagaccaagccgcgcgaggagcaguacaacuccaccuaccgggucgugagcgugcucaccguccugcaccaggacuggcugaacgggaaggaguacaagugcaagguguccaacaaggcccuccccgcccccaucgagaagacgaucagcaaggcgaagggccagccccgcgagccccagguguacacccugccgcccucccgggacgagcugaccaagaaccaggucagccugaccugccucgugaagggcuucuaccccagcgacaucgccguggagugggaguccaacgggcagcccgagaacaacuacaagacgaccccgcccguccuggacagcgacggcuccuucuuccucuacagcaagcugaccguggacaagucccgcuggcagcaggggaacguguucagcugcuccgucaugcacgaggcccugcacaaccacuacacccagaagucccucagccugagccccggcaag

SEQ ID NO: 8686 - RNA, 642 nt, Artificial Sequence
  derived and/or modified sequence opt1 from Porgaviximab_LightChain
gacauccagaugacccagagccccgccucccugagcguguccgucggcgagaccgugagcaucacgugccgcgccuccgagaacaucuacagcucccucgcgugguaccagcagaagcagggcaagagcccgcagcugcugguguacuccgccaccauccucgccgacgggguccccagccgguucuccgggagcggcuccgggacccaguacagccugaagaucaacucccugcagagcgaggacuucggcaccuacuacugccagcacuucuggggcacgcccuacaccuucgggggcgggaccaagcucgagaucaagcgcaccguggccgcccccuccguguucaucuucccgcccagcgacgagcagcugaaguccggcacggcgagcgucgugugccugcucaacaacuucuacccccgggaggccaaggugcaguggaaggucgacaacgcccugcagagcgggaacucccaggagagcgugaccgagcaggacuccaaggacagcaccuacucccugagcuccacccucacgcugagcaaggccgacuacgagaagcacaagguguacgcgugcgaggucacccaccagggccuguccagccccgugaccaaguccuucaaccgcggcgagugc

SEQ ID NO: 8687 - RNA, 1341 nt, Artificial Sequence
  derived and/or modified sequence opt1 from Prezalumab_HeavyChain
gaggugcagcuggucgagagcggcgggggccucgugcagcccgggggcucccugcgccugagcugcgccgccuccggguucaccuucagcuccuacuggaugagcugggugcggcaggcgccgggcaagggccucgagugggucgccuacaucaagcaggacgggaacgagaaguacuacguggacuccgugaagggccgcuucaccaucagccgggacaacgccaagaacucccuguaccugcagaugaacagccuccgcgccgaggacacggccgucuacuacugcgcgcgggaggggauccugugguucggcgaccugcccaccuucugggggcagggcacccucgugaccguguccagcgccuccacgaagggccccagcgucuucccccuggccccgugcucccgcagcaccuccgagagcaccgccgcgcuggggugccucgugaaggacuacuuccccgagcccgugaccgucuccuggaacagcggcgcccugacgagcggggugcacaccuuccccgccgugcugcaguccagcggccucuacucccugagcuccgucgugaccgugccgagcuccaacuucggcacccagacguacacgugcaacgucgaccacaagcccagcaacaccaagguggacaagaccguggagcggaagugcugcgucgagugcccgcccugccccgccccgcccguggccgggcccuccguguuccuguucccgcccaagcccaaggacacccucaugaucagccgcacccccgaggugaccugcgucgucguggacgugucccacgaggaccccgagguccaguucaacugguacguggacggcguggagguccacaacgcgaagaccaagccccgggaggagcaguucaacagcacguuccgcgugguguccguccugaccguggugcaccaggacuggcugaacgggaaggaguacaagugcaaggucagcaacaagggccuccccgcccccaucgagaagaccaucuccaagaccaaggggcagccgcgggagccccagguguacacgcugccgcccagccgcgaggagaugaccaagaaccaggugucccugaccugccucgucaagggcuucuaccccagcgacaucgccguggagugggaguccaacggccagcccgagaacaacuacaagaccacgcccccgaugcuggacagcgacgggagcuucuuccuguacuccaagcucaccguggacaagagccgguggcagcagggcaacgucuucuccugcagcgugaugcacgaggcccugcacaaccacuacacccagaagucccugagccucucccccgggaag

SEQ ID NO: 8688 - RNA, 642 nt, Artificial Sequence
  derived and/or modified sequence opt1 from Prezalumab_LightChain
gacauccagaugacccagagccccuccagccuguccgccagcgugggcgaccgcgucaccaucacgugccgggccucccaggggaucagcaacuggcucgcgugguaccagcagaagccggagaaggcccccaagucccugaucuacgccgccagcucccugcagagcggcgugcccucccgcuucagcggguccggcagcgggaccgacuucacccucaccaucuccagccugcagcccgaggacuucgccacguacuacugccagcaguacgacuccuacccgcggaccuucggccagggcaccaagguggagaucaagcgcaccgucgcggcccccagcguguucaucuucccgcccuccgacgagcagcucaagagcgggacggccagcguggucugccugcugaacaacuucuacccccgggaggccaaggugcaguggaagguggacaacgcgcugcaguccggcaacagccaggaguccgucaccgagcaggacagcaaggacuccaccuacagccucuccagcacccugacgcuguccaaggccgacuacgagaagcacaagguguacgccugcgaggugacccaccaggggcucagcucccccgucaccaagagcuucaaccgcggcgagugc

SEQ ID NO: 8689 - RNA, 342 nt, Artificial Sequence
  derived and/or modified sequence opt1 from Radretumab_HeavyChain
gaggugcagcugcucgagagcggcgggggccugguccagcccgggggcucccugcgccucagcugcgccgccuccggguucaccuucagcuccuucagcauguccugggugcggcaggcgccgggcaagggccuggagugggugagcuccaucagcggguccagcggcaccacguacuacgccgacuccgucaaggggcgcuucaccaucagccgggacaacuccaagaacacccuguaccuccagaugaacagccugcgcgccgaggacaccgccguguacuacugcgccaagcccuuccccuacuucgacuacuggggccaggggacgcuggugaccguc

SEQ ID NO: 8690 - RNA, 1071 nt, Artificial Sequence; identical to SEQ ID NO: 8359
  derived and/or modified sequence opt1 from Radretumab_HeavyChain_LightChain

SEQ ID NO: 8691 - RNA, 693 nt, Artificial Sequence
  derived and/or modified sequence opt1 from Radretumab_LightChain
gccagcgagaucgugcugacccagucccccggcacccucagccuguccccgggggagcgggccacgcugagcugccgggcgucccagagcgucuccagcuccuuccucgccugguaccagcagaagcccggccaggcgccccgccugcugaucuacuacgccagcucccgggccaccgggauccccgaccgcuucagcggcuccgggagcggcaccgacuucacccucacgaucucccggcuggagccggaggacuucgccguguacuacugccagcagaccggccgcaucccgcccaccuucgggcagggcaccaagguggagaucaagagcgggggcuccgggggcccccgggccgcccccgaggucuacgccuucgcgacgcccgaguggcccggcagccgcgacaagcggacccuggccugccucauccagaacuucaugcccgaggacaucuccgugcaguggcugcacaacgaggugcagcugccggacgcccgccacagcaccacccagccccggaagacgaaggggagcggcuucuucgucuucucccgccucgaggugacccgggccgagugggagcagaaggacgaguucaucugccgcgccgugcacgaggcggccagccccucccagaccguccagcgggccgugagcgugaaccccgaguccagccgccgcgggggcugc

SEQ ID NO: 8692 - RNA, 1359 nt, Artificial Sequence
  derived and/or modified sequence opt1 from Ranevetmab_HeavyChain1
gaggugcagcuggucgagagcggcgggggccucgugcagcccgggggcucccugcgccugagcugcguggccuccggguucagccucaccaacaacaacgucaacugggugcggcaggccccgggcaagggccuggagugggucgggggcgugugggccgggggcgcgaccgacuacaacuccgcccucaagagccgcuucacgaucucccgggacaacgccaagaacaccguguuccuccagaugcacagccugcgcuccgaggacaccgccguguacuacugcgcgcgggacgggggcuacagcuccagcacccuguacgccauggacgccuggggccaggggacguccgucaccgugagcuccgccagcaccaccgcgcccuccguguucccccucgcccccagcugcggcuccacgagcgggagcaccgucgcccuggccugccugguguccggcuacuucccggagcccgugaccgucagcuggaacuccggcagccugaccuccggggugcacacguuccccagcgugcugcaguccagcggccugcacucccucagcuccauggucaccgugcccagcucccgcuggccgagcgagaccuucacgugcaacgugguccaccccgccuccaacaccaagguggacaagcccguguucaacgagugccggugcaccgacacgcccccgugccccguccccgagccccucgggggcccgagcgugcugaucuucccgcccaagcccaaggacauccugcgcaucacccggacccccgaggugaccugcgucgugcuggaccuggggcgcgaggaccccgagguccagaucuccugguucguggacggcaaggaggugaucaccgcgaagacccagagccgggagcagcaguucaacggcacguaccaggucguguccgugcuccccaucgagcaccaggacuggcugaccgggaaggaguucaagugccgcgucaaccacaucgaccugcccagcccgaucgagcggaccaucagcaaggcccgcggccgggcccacaagcccuccguguacgugcucccgcccagccccaaggagcuguccagcuccgacaccgucagcaucacgugccugaucaaggacuucuacccgcccgacaucgacguggaguggcaguccguggggcagcaggagcccgagcgcaagcaccggaugaccccgccccagcucgacgaggacggcagcuacuuccuguacuccaagcugagcgucgacaagucccgcuggcagcagggggaccccuucacgugcgccgugaugcacgagacccuccagaaccacuacaccgaccugagccugucccacagccccggcaag

SEQ ID NO: 8693 - RNA, 1359 nt, Artificial Sequence
  derived and/or modified sequence opt1 from Ranevetmab_HeavyChain2
gaggugcagcuggucgagagcggcgggggccucgugcagcccgggggcucccugcgccugagcugcguggccuccggguucagccucaccaacaacaacgucaacugggugcggcaggccccgggcaagggccuggagugggucgggggcgugugggccgggggcgcgaccgacuacaacuccgcccucaagagccgcuucacgaucucccgggacaacgccaagaacaccguguuccuccagaugcacagccugcgcuccgaggacaccgccguguacuacugcgcgcgggacgggggcuacagcuccagcacccuguacgccauggacgccuggggccaggggacguccgucaccgugagcuccgccagcaccaccgcgcccuccguguucccccucgcccccagcugcggcuccacgagcgggagcaccgucgcccuggccugccugguguccggcuacuucccggagcccgugaccgucagcuggaacuccggcagccugaccuccggggugcacacguuccccagcgugcugcaguccagcggccugcacucccucagcuccauggucaccgugcccagcucccgcuggccgagcgagaccuucacgugcaacgugguccaccccgccuccaacaccaagguggacaagcccguguucaacgagugccggugcaccgacacgcccccgugccccguccccgagccccucgggggcccgagcgugcugaucuucccgcccaagcccaaggacauccugcgcaucacccggacccccgaggugaccugcgucgugcuggaccuggggcgcgaggaccccgagguccagaucuccugguucguggacggcaaggaggugcucaccgcgaagacccagagccgggagcagcaguucaacggcacguaccaggucguguccgugcugcccaucgagcaccaggacuggcugaccgggaaggaguucaagugccgcgucaaccacaucgaccuccccagcccgaucgagcggaccaucagcaaggcccgcggccgggcccacaagcccuccguguacgugcugccgcccagccccaaggagcuguccagcuccgacaccgucagcaucacgugccucaucaaggacuucuacccgcccgacaucgacguggaguggcaguccguggggcagcaggagcccgagcgcaagcaccggaugaccccgccccagcuggacgaggacggcagcuacuuccuguacuccaagcucagcgucgacaagucccgcuggcagcagggggaccccuucacgugcgccgugaugcacgagacccugcagaaccacuacaccgaccugagccucucccacagccccggcaag

SEQ ID NO: 8694 - RNA, 651 nt, Artificial Sequence
  derived and/or modified sequence opt1 from Ranevetmab_LightChain
gacaucgugaugacccagagccccgccucccugagccucucccagggcgagaccgucacgaucacgugccgcgccagcgaggacaucuacaacgcgcuggccugguaccagcagaagccggggcaggcccccaagcugcucaucuacaacaccgacacccugcacaccggcgugcccucccgguucagcggguccggcagcgggaccgacuucucccugaccaucagcucccucgagcccgaggacguggccgucuacuacugccagcacuacuuccacuacccgcgcaccuucggccagggcacgaagguggagcugaagcggaacgacgcccagcccgcgguguaccuguuccagcccagccccgaccagcuccacaccggguccgccagcgucgugugccugcugaacuccuucuacccgaaggacaucaacgugaaguggaaggucgacggcgugauccaggacaccgggauccaggagagcgugaccgagcaggacaaggacuccacguacagccucuccagcacccugaccaugagcuccaccgaguaccugagccacgagcucuacuccugcgagaucacgcacaagagccugcccuccacccugaucaagagcuuccagcgcuccgagugccagcgggucgac

SEQ ID NO: 8695 - RNA, 1761 nt, Artificial Sequence
  derived and/or modified sequence opt1 from Remtolumab_HeavyChain
gaggugcagcuggucgagagcggcgggggccucgugcagcccgggcgcucccugcggcugagcugcgccgccuccggcuucaccuucgacgacuacgcgaugcacugggugcgccaggccccggggaagggccucgagugggucagcgccaucaccuggaacuccggccacaucgacuacgccgacagcguggaggggcgguucacgaucucccgcgacaacgccaagaacagccuguaccugcagaugaacucccuccgggcggaggacaccgccguguacuacugcgccaaggucagcuaccuguccaccgccagcucccuggacuacuggggccaggggacccucgugacggugagcuccggcgggggcggcagcgggggcgggggcuccgagguccagcuggugcagagcggcgcggaggugaagaagcccggguccagcgucaaggugagcugcaaggccuccggcgggagcuucggcggguacggcaucggcugggugcgccaggcccccgggcagggccuggaguggaugggcgggaucacccccuucuucggguucgccgacuacgcccagaaguuccagggccgggucaccaucaccgcggacgaguccacgaccaccgccuacauggagcucagcggccugaccuccgacgacacggccguguacuacugcgcccgcgacccgaacgaguucuggaacggguacuacagcacccacgacuucgacuccuggggccaggggaccaccgugacggucagcuccgccagcaccaagggccccuccguguucccccuggcgcccagcuccaagagcaccuccgggggcaccgccgcccucggcugccuggugaaggacuacuucccggagcccgucacggugagcuggaacuccggggcccugaccagcggcgugcacaccuuccccgccguccuccaguccagcgggcuguacagccuguccagcguggucaccgugcccuccagcucccucggcacgcagaccuacaucugcaacgugaaccacaagccgagcaacaccaaggucgacaagaagguggagcccaaguccugcgacaagacccacacgugcccgcccugcccggcgcccgagcugcugggcgggcccagcguguuccucuucccgcccaagcccaaggacacccugaugaucucccggacccccgaggugaccugcgucguggucgacgugagccacgaggaccccgaggugaaguucaacugguacgucgacggcguggaggugcacaacgccaagacgaagccgcgcgaggagcaguacaacuccaccuaccgggucgugagcgugcugaccguccuccaccaggacuggcugaacgggaaggaguacaagugcaagguguccaacaaggcccugcccgcccccaucgagaagaccaucagcaaggccaagggccagccccgcgagccccagguguacacgcucccgcccucccgggacgagcugaccaagaaccaggucagccugaccugccucgugaagggguucuaccccuccgacaucgcgguggagugggagagcaacggccagcccgagaacaacuacaagaccaccccgcccguccuggacagcgacggcuccuucuuccuguacagcaagcucacgguggacaagucccgcuggcagcaggggaacguguucagcugcuccgucaugcacgaggcccugcacaaccacuacacccagaagucccugagccucagccccggcaag

SEQ ID NO: 8696 - RNA, 993 nt, Artificial Sequence
  derived and/or modified sequence opt1 from Remtolumab_LightChain
gacauccagaugacccagagccccuccagccuguccgccagcgugggcgaccgcgucaccaucacgugccgggccucccaggggauccgcaacuaccucgcgugguaccagcagaagccgggcaaggcccccaagcugcugaucuacgccgccagcacccuccaguccggggugcccagccgguucuccggcagcggguccggcaccgacuucacccugacgaucagcucccugcagcccgaggacguggccaccuacuacugccagcgcuacaaccgggcgccguacaccuucggccaggggaccaaggucgagaucaagcgcggcgggagcggcgggggcggcuccggggagaucgugcucacgcagagccccgacuuccaguccgugacccccaaggagaaggucaccaucacgugccgggccagccaggacaucggcuccgagcugcacugguaccagcagaagcccgaccagccgcccaagcugcucaucaaguacgccagccacagcaccuccggggugcccagccgcuucuccggcagcggcuccgggaccgacuucacccugaccaucaacggccuggaggccgaggacgcggggacguacuacugccaccagaccgacagccuccccuacaccuucggcccggggaccaagguggacaucaagcggacggucgccgcccccuccguguucaucuucccgcccagcgacgagcagcugaaguccggcaccgccagcguggucugccugcucaacaacuucuacccccgcgaggccaaggugcaguggaagguggacaacgcgcugcaguccggcaacagccaggaguccgucaccgagcaggacagcaaggacuccaccuacagccuguccagcacgcucacccuguccaaggccgacuacgagaagcacaagguguacgccugcgaggugacccaccaggggcugagcagccccgucaccaaguccuucaaccggggcgagugc

SEQ ID NO: 8697 - RNA, 1341 nt, Artificial Sequence
  derived and/or modified sequence opt1 from Rosmantuzumab_HeavyChain
caggugcagcugguccagagcggcgccgaggugaagaagcccggggccuccgugaaggucagcugcaaggcguccggcuacaccuucaccgacuacagcauccacugggugcgccaggccccggggcagggccucgaguggaucggguacaucuaccccuccaacggcgacagcggcuacaaccagaaguucaagaaccgggugaccaugacccgcgacaccuccaccagcacggccuacauggagcugucccggcugcgcagcgaggacaccgccgucuacuacugcgccaccuacuucgcgaacaacuucgacuacugggggcagggcaccacgcucaccguguccagcgccuccaccaaggggcccagcguguucccccuggccccguccagcaaguccaccagcggcgggacggccgcgcugggcugccucgucaaggacuacuuccccgagcccgugaccguguccuggaacagcggcgcccugaccagcgggguccacaccuuccccgccgugcugcaguccagcggccucuacucccugagcuccguggucacggugccgagcuccagccuggggacccagaccuacaucugcaacgugaaccacaagcccuccaacaccaaggucgacaagcggguggagcccaagagcugcgacaagacgcacacgugcccgcccugccccgcccccgagcuccugggcggccccuccguguuccuguucccgcccaagcccaaggacacccucaugaucagccgcacccccgaggugaccugcgucguggucgacgugucccacgaggacccggaggucaaguucaacugguacguggacgggguggagguccacaacgccaagaccaagccccgggaggagcaguacaacagcaccuaccgcgugguguccguccugaccgugcugcaccaggacuggcucaacggcaaggaguacaagugcaaggugagcaacaaggcgcugcccgcccccaucgagaagacgaucuccaaggccaaggggcagccgcgggagccccaggucuacacccugccgcccagccgcgaggagaugaccaagaaccaggugucccugaccugccucgugaagggcuucuaccccagcgacaucgccgucgagugggagagcaacgggcagcccgagaacaacuacaagacgacgcccccggugcuggacuccgacggcagcuucuuccucuacuccaagcugaccguggacaagagccgguggcagcagggcaacgucuucuccugcagcgugaugcacgaggcccugcacaaccacuacacccagaagucccucagccugucccccgggaag

SEQ ID NO: 8698 - RNA, 654 nt, Artificial Sequence
  derived and/or modified sequence opt1 from Rosmantuzumab_LightChain
gacauccagaugacccagagccccuccagccuguccgccagcgugggcgaccgcgucaccaucacgugcaaggccucccagagcguggacuacgacggggacuccuacaugaacugguaccagcagaagccgggcaaggcgcccaagcuccugaucuacgccgccagcaaccuggaguccggggugcccagccgguucuccggcagcggguccggcaccgacuucacccucaccaucagccccguccaggccgaggacuucgccacguacuacugccagcaguccaacgaggacccgcugaccuucggcgcggggaccaagcuggagcucaagcgcaccguggccgcccccagcguguucaucuucccgcccuccgacgagcagcucaagagcggcacggccuccgucgugugccugcugaacaacuucuacccccgggaggcgaaggugcaguggaaggucgacaacgcccugcagagcgggaacagccaggaguccgugaccgagcaggacagcaaggacuccaccuacagccuguccagcacccucacgcuguccaaggccgacuacgagaagcacaagguguacgccugcgaggucacccaccagggccugagcucccccgugaccaagagcuucaaccgcggggagugc

SEQ ID NO: 8699 - RNA, 1332 nt, Artificial Sequence
  derived and/or modified sequence opt1 from Rozanolixizumab_HeavyChain
gaggugccccuggucgagagcggcgggggccucgugcagcccgggggcucccugcgccugagcugcgccguguccggguucaccuucagcaacuacggcauggucugggugcggcaggcccccggcaaggggcucgaguggguggcguacaucgacuccgacggcgacaacaccuacuaccgcgacagcgucaaggggcgguucacgaucucccgcgacaacgccaagagcucccuguaccugcagaugaacagccuccgggccgaggacaccgccguguacuacugcaccaccggcaucgugcgccccuuccuguacugggggcagggcacgcuggucaccguguccagcgccuccaccaagggccccagcguguucccgcucgcgcccugcucccggagcaccuccgagagcacggccgcccuggggugccuggucaaggacuacuuccccgagcccgugaccguguccuggaacagcggcgcccucaccagcgggguccacaccuucccggcggugcugcaguccagcggccuguacucccucagcuccguggucacggugcccagcuccagccugggcaccaagaccuacacgugcaacguggaccacaagcccuccaacaccaaggucgacaagcgcguggagagcaaguacgggcccccgugcccgcccugccccgccccggaguuccugggcgggcccuccguguuccucuucccgcccaagcccaaggacacccugaugaucagccggacccccgaggugaccugcgucgucguggacgugucccaggaggaccccgagguccaguucaacugguacguggacggcguggagguccacaacgccaagacgaagccccgcgaggagcaguucaacagcaccuaccgggugguguccguccugaccgugcuccaccaggacuggcugaacgggaaggaguacaagugcaaggugagcaacaagggccugccguccagcaucgagaagaccaucuccaaggccaagggccagccccgcgagccccaggucuacacgcucccgcccagccaggaggagaugaccaagaaccaggugagccugaccugccuggugaagggguucuaccccuccgacaucgccgucgagugggagagcaacggccagcccgagaacaacuacaagaccacgccgcccgugcucgacuccgacgggagcuucuuccuguacucccggcugaccguggacaagagccgcuggcaggagggcaacgucuucuccugcagcgugaugcacgaggcgcuccacaaccacuacacccagaagucccugagccugucccucgggaag

SEQ ID NO: 8700 - RNA, 657 nt, Artificial Sequence
  derived and/or modified sequence opt1 from Rozanolixizumab_LightChain
gacauccagaugacccagagccccuccagccuguccgccagcgugggcgaccgcgucaccaucacgugcaaguccagccagucccucgugggggccagcggcaagaccuaccuguacuggcuguuccagaagccggggaaggcgcccaagcggcucaucuaccugguguccacccuggacagcggcauccccucccgcuucagcggguccggcagcggcaccgaguucacgcucaccaucuccagccugcagcccgaggacuucgccaccuacuacugccugcaggggacccacuucccgcacacguucggccaggggaccaagcucgagaucaagcggaccgucgccgcccccuccguguucaucuucccgcccagcgacgagcagcugaaguccggcaccgccagcguggucugccugcucaacaacuucuacccccgcgaggcgaaggugcaguggaagguggacaacgcccugcagagcgggaacucccaggagagcgucacggagcaggacuccaaggacagcaccuacucccugagcuccacccucacccugagcaaggccgacuacgagaagcacaagguguacgccugcgaggugacgcaccagggccuguccagccccgucaccaaguccuucaaccggggcgagugc

SEQ ID NO: 8701 - RNA, 1329 nt, Artificial Sequence
  derived and/or modified sequence opt1 from Sapelizumab_HeavyChain
caggugcagcugcaggagagcggccccgggcucgucaagcccuccgagacccugagccugaccugcgccguguccggccacagcaucucccacgaccacgccuggagcugggugcgccagccgcccggggagggccucgaguggaucggguucaucuccuacagcggcaucacgaacuacaaccccucccugcagggccgggucaccaucagccgcgacaacuccaagaacacccuguaccuccagaugaacagccugcgggcggaggacaccgccguguacuacugcgcccgcucccuggcccggacgaccgccauggacuacuggggcgaggggacccucgugaccgucagcuccgcgagcacgaaggggcccuccguguucccccuggcccccagcuccaagagcaccagcggcgggaccgccgcccugggcugccucgugaaggacuacuuccccgagccggucaccguguccuggaacagcggcgcgcugacguccggggugcacaccuuccccgccguccugcagagcuccggccucuacagccuguccagcguggugaccguccccuccagcaacuucgggacccagacguacacgugcaacguggaccacaagcccuccaacaccaagguggacaagaccgucgagcgcaagagcugcguggagugcccgcccugccccgcgcccccgguggccggccccuccgucuuccuguucccgcccaagcccaaggacacccucaugaucagccggacccccgaggugaccugcguggucguggacgucucccaggaggaccccgaggugcaguucaacugguacguggacggcgucgaggugcacaacgccaagaccaagccccgcgaggagcaguucaacagcacguuccggguggucuccgugcugaccgugguccaccaggacuggcugaacgggaaggaguacaagugcaaggugagcaacaagggccucccggcccccaucgagaagaccaucuccaagaccaaggggcagccccgcgagccccagguguacacgcugccgcccagccaggaggagaugaccaagaaccaggucagccugaccugccucgugaagggcuucuaccccuccgacaucgccguggagugggagagcaacgggcagccggagaacaacuacaagaccacgccgcccaugcuggacuccgacggcagcuucuuccuguacuccaagcucaccgucgacaagagccgguggcaggagggcaacguguucuccugcagcgugaugcacgaggcccugcacgcccacuacacccagaagucccugagccucuccccc

SEQ ID NO: 8702 - RNA, 642 nt, Artificial Sequence
  derived and/or modified sequence opt1 from Sapelizumab_LightChain
gacauccagaugacccagagccccuccagccuguccgccagcgugggcgacuccgucaccaucacgugccaggccagcaccgacaucuccagccaccucaacugguaccagcagaagccggggaaggcgcccgagcugcugaucuacuacggcucccaccuccugagcggggugcccucccgcuucagcggcuccgggagcggcaccgacuucaccuucacgaucuccagccuggaggccgaggacgccgccaccuacuacugcggccaggggaaccggcuccccuacaccuucggccaggggaccaagguggagaucgagcgcacggucgccgcgccguccguguucaucuucccgcccagcgacgagcagcugaaguccggcaccgccagcguggucugccugcucaacaacuucuacccccgggaggccaaggugcaguggaagguggacaacgcccugcagagcgggaacucccaggagagcgucaccgagcaggacuccaaggacagcaccuacucccugagcuccacgcucacccugagcaaggcggacuacgagaagcacaagguguacgccugcgaggugacccaccagggccuguccagccccgucaccaaguccuucaaccgcggcgagugc

SEQ ID NO: 8703 - RNA, 1356 nt, Artificial Sequence
  derived and/or modified sequence opt1 from Selicrelumab_HeavyChain
caggugcagcugguccagagcggcgccgaggugaagaagcccggggccuccgugaaggucagcugcaaggcguccggcuacaccuucaccggguacuacaugcacugggugcgccaggccccgggccaggggcucgaguggaugggcuggaucaaccccgacagcggcgggacgaacuacgcccagaaguuccagggccgggugaccaugacccgcgacaccuccaucagcacggccuacauggagcugaaccggcugcgcuccgacgacaccgccgucuacuacugcgcgcgggaccagccccucggguacugcaccaacggcgugugcagcuacuucgacuacugggggcagggcacccuggugacggucuccagcgccuccaccaagggccccagcguguucccgcuggcccccugcucccgcagcaccuccgagagcaccgccgcgcucgggugccuggugaaggacuacuuccccgagcccgucacgguguccuggaacagcggcgcccugaccuccggggugcacaccuucccggccguccuccagagcagcggccuguacucccugagcuccguggugaccguccccagcuccaacuucggcacgcagaccuacacgugcaacguggaccacaagcccagcaacaccaagguggacaagaccgucgagcggaagugcugcguggagugcccgcccugccccgccccgcccguggccgggcccuccgucuuccucuucccgcccaagcccaaggacacccugaugaucagccgcacccccgaggugaccugcgucgugguggacgucucccacgaggaccccgaggugcaguucaacugguacguggacggcgucgaggugcacaacgcgaagacgaagccccgggaggagcaguucaacagcaccuuccgcguggucuccgugcugaccgugguccaccaggacuggcucaacgggaaggaguacaagugcaaggugagcaacaagggccugcccgccccgaucgagaagaccaucuccaagacgaaggggcagccccgggagccccagguguacacccugcccccgagccgcgaggagaugaccaagaaccaggucucccugaccugccucgugaagggcuucuaccccagcgacaucgccguggagugggaguccaacggccagcccgagaacaacuacaagacgaccccgcccaugcuggacagcgacggguccuucuuccucuacagcaagcugaccgucgacaagagccgguggcagcagggcaacguguucuccugcagcgugaugcacgaggcccugcacaaccacuacacccagaagucccucagccugucccccgggaag

SEQ ID NO: 8704 - RNA, 642 nt, Artificial Sequence
  derived and/or modified sequence opt1 from Selicrelumab_LightChain
gacauccagaugacccagagccccuccagcguguccgccagcgucggcgaccgcgugaccaucacgugccgggccucccaggggaucuacagcuggcuggcgugguaccagcagaagccgggcaaggcccccaaccuccugaucuacaccgccuccacccugcagagcggggugcccucccgcuucagcggcuccgggagcggcaccgacuucacgcucaccaucuccagccugcagcccgaggacuucgccaccuacuacugccagcaggccaacaucuucccgcugaccuucggcgggggcacgaaggucgagaucaagcggaccguggcggcccccuccguguucaucuucccgcccagcgacgagcagcucaaguccgggaccgccagcgucgugugccugcugaacaacuucuacccccgcgaggccaaggugcaguggaaggucgacaacgcgcuccaguccggcaacagccaggagagcgugaccgagcaggacuccaaggacagcacguacucccugagcuccacccugacccucagcaaggccgacuacgagaagcacaagguguacgccugcgaggucacccaccaggggcuguccagccccgugacgaaguccuucaaccggggcgagugc

SEQ ID NO: 8705 - RNA, 354 nt, Artificial Sequence
  derived and/or modified sequence opt1 from Solitomab_HeavyChain1
gaggugcagcugcucgagcagagcggcgccgagcugguccgccccgggaccuccgugaagaucagcugcaaggccuccggcuacgcguucaccaacuacuggcuggggugggugaagcagcggccgggccacgggcucgaguggaucggcgacaucuuccccggcagcgggaacauccacuacaacgagaaguucaagggcaaggccacgcugaccgccgacaaguccagcuccaccgccuacaugcagcugagcucccucaccuucgaggacagcgccgucuacuucugcgcgcgccugcggaacugggacgagcccauggacuacugggggcagggcacgaccgugaccgug

SEQ ID NO: 8706 - RNA, 375 nt, Artificial Sequence
  derived and/or modified sequence opt1 from Solitomab_HeavyChain2
gacgugcagcugguccagagcggcgccgaggugaagaagcccggggccuccgugaaggucagcugcaaggcguccggcuacaccuucacccgcuacacgaugcacugggugcggcaggccccggggcagggccucgaguggaucggguacaucaaccccagccgcggcuacaccaacuacgccgacuccgugaagggccgguucaccaucaccacggacaagagcaccuccaccgccuacauggagcugagcucccugcgcagcgaggacaccgccacguacuacugcgcgcgguacuacgacgaccacuacugccucgacuacugggggcagggcaccaccgucaccguguccagcggggagggcacguccacc

SEQ ID NO: 8707 - RNA, 1488 nt, Artificial Sequence
  derived and/or modified sequence opt1 from Solitomab_LightChain_HeavyChain_HeavyChain_LightChain
gagcuggugaugacccagagccccuccagccucaccgucacggccggcgagaaggugaccauguccugcaagagcucccagagccugcugaacuccgggaaccagaagaacuaccucaccugguaccagcagaagccgggccagccgcccaagcugcugaucuacugggccagcacccgcgaguccggggugcccgaccgguucacgggcagcggguccggcaccgacuucacccucaccaucagcuccguccaggcggaggaccuggccguguacuacugccagaacgacuacagcuacccccugacguucggcgccgggaccaagcucgagaucaagggcgggggcggguccggcggcgggggcagcgggggcggcggguccgaggugcagcugcuggagcagagcggcgccgagcucguccgccccgggaccuccgugaagaucagcugcaaggccagcggcuacgcguucaccaacuacuggcuggggugggugaagcagcggcccggccacggccuggaguggaucggggacaucuuccccggcuccgggaacauccacuacaacgagaaguucaagggcaaggccacgcucaccgccgacaagagcuccagcaccgccuacaugcagcuguccagccugaccuucgaggacuccgcggucuacuucugcgcccgccuccggaacugggacgagccgauggacuacugggggcagggcacgaccgugaccgugagcuccggcgggggcgggagcgacguccagcuggugcaguccggcgccgaggugaagaagcccggggccagcgucaagguguccugcaaggccagcggcuacaccuucacgcgcuacaccaugcacugggugcggcaggcgcccggccaggggcuggaguggaucggcuacaucaaccccucccgcggguacaccaacuacgccgacagcgucaagggccgguucaccaucacgaccgacaaguccaccagcaccgccuacauggagcucuccagccugcgcagcgaggacacggccaccuacuacugcgcccgguacuacgacgaccacuacugccuggacuacuggggccaggggaccaccgugacgguguccagcggcgaggggaccuccaccggcagcgggggcuccggcgggagcggcggggcggacgacaucguccucacccaguccccggccacgcugagccugucccccggcgagcgcgccacccucagcugccgggccucccagagcguguccuacaugaacugguaccagcagaagcccgggaaggcccccaagcgcuggaucuacgacaccagcaagguggcguccggcgucccggcccgguucagcggcuccgggagcggcaccgacuacagccugaccaucaacucccuggaggccgaggacgccgccacguacuacugccagcaguggagcuccaacccccucaccuucgggggcgggaccaagguggagaucaag

SEQ ID NO: 8708 - RNA, 339 nt, Artificial Sequence
  derived and/or modified sequence opt1 from Solitomab_LightChain1
gagcuggugaugacccagagccccuccagccucaccgucacggccggcgagaaggugaccauguccugcaagagcucccagagccugcugaacuccgggaaccagaagaacuaccucaccugguaccagcagaagccgggccagccgcccaagcugcugaucuacugggccagcacccgcgaguccggggugcccgaccgguucacgggcagcggguccggcaccgacuucacccucaccaucagcuccguccaggcggaggaccuggccguguacuacugccagaacgacuacagcuacccccugacguucggcgccgggaccaagcucgagaucaag

SEQ ID NO: 8709 - RNA, 324 nt, Artificial Sequence
  derived and/or modified sequence opt1 from Solitomab_LightChain2
gccgacgacaucgugcugacccagagccccgccacccucucccugagcccgggcgagcgcgcgacgcuguccugccgggccagccaguccgucagcuacaugaacugguaccagcagaagcccgggaaggcccccaagcgcuggaucuacgacaccuccaagguggccagcggcgugcccgcccgguucuccgggagcggcuccgggaccgacuacagccucaccaucaacucccuggaggcggaggacgccgccacguacuacugccagcaguggagcuccaacccgcugaccuucggcggcgggaccaaggucgagaucaag

SEQ ID NO: 8710 - RNA, 1359 nt, Artificial Sequence
  derived and/or modified sequence opt1 from Suptavumab_HeavyChain2
gaggugcagcuggucgagagcggcggggaccucgugcagcccggccgcucccugcggcugagcugcguggccuccggguucaccuucgacgacuacgccaugcacuggguccgccaggcgccgggcaaggggcucgagugggugagcggcguguccuggagcggcuccaccgucggguacgccgacagcgugaagggccgguucacggugucccgcgacaacgcccagaagucccuguaccugcagaugaacagccuccgggccgaggacaccgcccuguacuacugcgucaaggacgcguacaaguucaacuacuacuacuacgggcuggacguguggggccaggggaccaccgugacggucagcuccgccagcaccaagggccccuccguguucccccucgcccccagcuccaagagcaccuccggcgggaccgccgcgcugggcugccuggugaaggacuacuucccggagcccgucacggugagcuggaacagcggggcccucaccuccggcgugcacaccuuccccgccguccugcagagcuccggccuguacagccucuccagcguggugaccguccccuccagcucccuggggacgcagaccuacaucugcaacgugaaccacaagccgagcaacaccaagguggacaagaaggucgagcccaaguccugcgacaagacccacacgugcccgcccugcccggcccccgagcugcucggcgggcccagcguguuccuguucccgcccaagcccaaggacacccugaugaucucccgcacccccgaggugaccugcgucguggucgacgugagccacgaggaccccgaggugaaguucaacugguacgucgacggcguggaggugcacaacgccaagacgaagccgcgggaggagcaguacaacuccaccuaccgcgucgugagcgugcucaccguccugcaccaggacuggcugaacgggaaggaguacaagugcaagguguccaacaaggcgcuccccgcccccaucgagaagaccaucagcaaggccaagggccagccccgggagccccagguguacacgcugccgcccucccgcgacgagcugaccaagaaccaggucagccugaccugccucgugaagggcuucuaccccagcgacaucgccguggagugggaguccaacgggcagcccgagaacaacuacaagaccacgccgcccguccuggacagcgacggcuccuucuuccucuacagcaagcugaccguggacaagucccgguggcagcaggggaacguguucagcugcuccgucaugcacgaggcccugcacaaccacuacacccagaagucccucagccugagccccggcaag

SEQ ID NO: 8711 - RNA, 1356 nt, Artificial Sequence
  derived and/or modified sequence opt1 from Suvratoxumab_HeavyChain
gaggugcagcuggucgagagcggcgggggccucgugcagcccgggggcucccugcgccugagcugcgccgccuccggguucaccuucagcucccacgacaugcacugggugcggcaggcgaccggcaagggccucgagugggucagcgggaucggcacggccggggacaccuacuacccggacuccgugaagggccgcuucaccaucagccgggagaacgccaagaacucccuguaccugcagaugaacagccuccgcgccggggacaccgccguguacuacugcgcgcgggaccgcuacucccccacgggccacuacuacggcauggacgucugggggcagggcaccaccgugaccgugagcuccgccagcacgaaggggcccuccgucuucccccuggccccgagcuccaagagcaccuccggcggcaccgccgcgcuggggugccucgugaaggacuacuuccccgagcccgugaccgucagcuggaacagcggcgcccugacguccggggugcacaccuuccccgccgugcugcagagcuccggccucuacagccuguccagcgucgugaccgugccguccagcucccuggggacccagacguacaucugcaacgucaaccacaagcccagcaacaccaagguggacaagcggguggagcccaaguccugcgacaagacccacacgugcccgcccugccccgcccccgagcuccugggcggccccagcgucuuccuguucccgcccaagcccaaggacacccucuacaucacccgcgagcccgaggugaccugcguggucguggacgucucccacgaggacccggaggugaaguucaacugguacguggacggggucgaggugcacaacgccaagaccaagccccgggaggagcaguacaacagcacguaccgcguggucuccgugcugaccgugcugcaccaggacuggcucaacggcaaggaguacaagugcaaggucagcaacaaggcgcugcccgcccccaucgagaagaccaucuccaaggccaaggggcagccgcgggagccccagguguacacccugccgcccagccgcgaggagaugacgaagaaccaggugucccugaccugccucgucaagggcuucuaccccagcgacaucgccguggagugggagagcaacgggcagcccgagaacaacuacaagaccacgcccccggugcuggacuccgacggcagcuucuuccucuacuccaagcugaccgucgacaagagccgguggcagcagggcaacguguucuccugcagcgugaugcacgaggcccugcacaaccacuacacccagaagucccucagccugucccccgggaag

SEQ ID NO: 8712 - RNA, 639 nt, Artificial Sequence
  derived and/or modified sequence opt1 from Suvratoxumab_LightChain
gacauccagaugacccagagccccuccacccugagcgccuccgugggcgaccgcgucacgaucacgugccgggccagccaguccaucagcuccuggcucgcgugguaccagcagaagccggggaaggcccccaagcugcugaucuacaaggccagcucccucgagagcggcgugcccucccgcuucagcggguccggcagcgggaccgaguucacccugaccaucuccagccugcagcccgacgacuucgccaccuacuacugcaagcaguacgccgacuacuggaccuucggccagggcaccaagguggagaucaagcggacggucgcggccccguccguguucaucuucccgcccagcgacgagcagcucaaguccgggaccgccagcguggucugccugcugaacaacuucuacccccgcgaggccaaggugcaguggaagguggacaacgcgcuccagagcggcaacucccaggagagcgucaccgagcaggacuccaaggacagcaccuacucccugagcuccacgcugacccucagcaaggccgacuacgagaagcacaagguguacgccugcgaggugacccaccaggggcuguccagccccgucaccaaguccuucaaccggggcgagugc

SEQ ID NO: 8713 - RNA, 642 nt, Artificial Sequence
  derived and/or modified sequence opt1 from Tadocizumab_LightChain
gacauccagaugacccagacccccagcacgcuguccgccagcgugggcgaccgggucaccaucuccugccgggccagccaggacaucaacaacuaccucaacugguaccagcagaagccggggaaggcgcccaagcugcugaucuacuacaccuccacccuccacagcggcgugcccucccgcuucagcggguccggcagcgggacggacuacacccugaccaucuccagccugcagcccgacgacuucgccaccuacuucugccagcagggcaacacgcucccguggaccuucggccaggggaccaagguggaggucaagcggaccguggccgcccccuccguguucaucuucccgcccagcgacgagcagcugaaguccggcacggccagcgucgugugccugcucaacaacuucuacccccgcgaggcgaaggugcaguggaaggucgacaacgcccugcaguccgggaacagccaggaguccgugaccgagcaggacagcaaggacagcaccuacucccugagcuccacccucacgcugagcaaggccgacuacgagaagcacaagguguacgccugcgaggucacccaccagggccuguccagccccgugaccaaguccuucaaccgcggggagugc

SEQ ID NO: 8714 - RNA, 1341 nt, Artificial Sequence
  derived and/or modified sequence opt1 from Tanezumab_HeavyChain
caggugcagcugcaggagagcggccccgggcucgucaagccguccgagacccugagccugaccugcacgguguccggcuucagccucaucggguacgaccugaacuggauccgccagccgcccggcaaggggcuggaguggaucggcaucaucuggggcgacgggaccaccgacuacaacuccgccgucaagagccgggugaccaucuccaaggacacgagcaagaaccaguucucccucaagcugagcuccgugaccgccgcggacaccgccguguacuacugcgcccgcggcggguacugguacgccaccagcuacuacuucgacuacuggggccaggggacgcuggucaccguguccagcgccuccaccaagggccccagcguguucccccucgcgcccugcucccggagcaccuccgagagcacggccgcccugggcugccuggucaaggacuacuuccccgagcccgugaccgugagcuggaacuccggggcccucaccagcggcguccacaccuucccggcggugcugcaguccagcgggcuguacucccucagcuccguggucacggugcccagcuccaacuucggcacccagaccuacacgugcaacguggaccacaagcccagcaacaccaaggucgacaagaccguggagcgcaagugcugcguggagugcccgcccugccccgccccgcccgucgccggccccuccguguuccuguucccgcccaagcccaaggacacccugaugaucagccggacccccgaggugacgugcgucguggucgacgugucccacgaggaccccgaggugcaguucaacugguacgucgacgggguggaggugcacaacgccaagaccaagccccgcgaggagcaguucaacagcaccuuccgggucguguccgugcucaccgucgugcaccaggacuggcugaacggcaaggaguacaagugcaaggugagcaacaaggggcugcccuccagcaucgagaagacgaucuccaagaccaagggccagccgcgcgagccccaggucuacacccucccgcccagccgggaggagaugaccaagaaccaggugagccugacgugccuggugaagggguucuaccccuccgacaucgccgucgagugggagagcaacggccagcccgagaacaacuacaagaccacgcccccgaugcucgacuccgacggcagcuucuuccuguacuccaagcugaccguggacaagagccgcuggcagcaggggaacguguucuccugcagcgucaugcacgaggcgcuccacaaccacuacacccagaagucccugagccugucccccggcaag

SEQ ID NO: 8715 - RNA, 642 nt, Artificial Sequence
  derived and/or modified sequence opt1 from Tanezumab_LightChain
gacauccagaugacgcagagccccuccagccuguccgccagcgugggcgaccgcgucaccaucacgugccgggccucccagagcaucuccaacaaccucaacugguaccagcagaagccggggaaggcgcccaagcugcugaucuacuacaccagccgcuuccacuccggcgugcccagccgguucuccgggagcggcuccgggaccgacuucaccuucacgaucagcucccuccagcccgaggacaucgccaccuacuacugccagcaggagcacacccugccguacaccuucggccagggcacgaagcuggagaucaagcgcaccguggccgcccccagcgucuucaucuucccgcccuccgacgagcagcucaagagcgggaccgccuccguggugugccugcugaacaacuucuacccccgggaggcgaagguccaguggaagguggacaacgcccuccagagcggcaacagccaggaguccgugaccgagcaggacagcaaggacuccacguacagccuguccagcacccugacccucuccaaggccgacuacgagaagcacaaggucuacgccugcgaggugacccaccaggggcugagcucccccgugaccaagagcuucaaccgcggcgagugc

SEQ ID NO: 8716 - RNA, 1353 nt, Artificial Sequence
  derived and/or modified sequence opt1 from Tavolixizumab_HeavyChain
caggugcagcugcaggagagcggccccgggcucgucaagcccucccagacccugagccugaccugcgccguguacggcggguccuucagcuccggcuacuggaacuggauccgcaagcaccccgggaagggccucgaguacaucggcuacaucagcuacaacgggaucacguaccacaaccccucccucaagagccggaucaccaucaaccgcgacaccuccaagaaccaguacagccugcagcugaacuccgugacccccgaggacacggccgucuacuacugcgcgcgguacaaguacgacuacgacggcgggcacgccauggacuacuggggccaggggacccuggugaccgugagcuccgccagcaccaagggcccguccgucuucccccuggcccccagcuccaagagcacguccggcgggaccgccgcgcucggcugccuggugaaggacuacuuccccgagccggugaccgucagcuggaacagcggggcccugaccuccggcgugcacacguuccccgccgugcuccagagcuccggccuguacagccuguccagcgucgugaccgugcccuccagcucccucgggacccagaccuacaucugcaacgucaaccacaagcccagcaacacgaagguggacaagcgcguggagccgaaguccugcgacaagacccacacgugcccgcccugccccgcccccgagcugcugggcgggcccagcgucuuccucuucccgcccaagcccaaggacacccugaugaucucccggacccccgaggugaccugcguggucguggacgugagccacgaggaccccgaggucaaguucaacugguacguggacggcgucgaggugcacaacgcgaagaccaagccccaggaggagcaguacaacuccaccuaccgcguggucagcgugcugacggugcuccaccaggacuggcugaacgggaaggaguacaagugcaaggucuccaacaaggcccugccggcccccaucgagaagaccaucagcaaggccaagggccagccccgggagccccagguguacacccucccgcccucccgcgaggagaugaccaagaaccaggugagccugacgugccuggucaagggcuucuaccccagcgacaucgccguggagugggaguccaacgggcagccggagaacaacuacaagaccaccccgcccgugcucgacagcgacggcuccuucuuccuguacagcaagcugaccgucgacaagucccgguggcagcaggggaacguguucagcugcuccgugaugcacgaggcgcuccacaaccacuacacgcagaagucccugagccugagccccggcaag

SEQ ID NO: 8717 - RNA, 642 nt, Artificial Sequence
  derived and/or modified sequence opt1 from Tavolixizumab_LightChain
gacauccagaugacccagagccccuccagccuguccgccagcgugggcgaccgggucaccaucacgugccgggccucccaggacaucagcaacuaccucaacugguaccagcagaagccggggaaggcgcccaagcugcugaucuacuacaccuccaagcuccacagcggcgugcccucccgcuucagcggguccggcagcgggaccgacuacacccugacgaucuccagccugcagcccgaggacuucgccaccuacuacugccagcagggcuccgcccucccguggaccuucggccaggggaccaagguggagaucaagcggacggucgccgcccccagcguguucaucuucccgcccuccgacgagcagcucaagagcggcaccgcguccguggucugccugcugaacaacuucuacccccgcgaggccaaggugcaguggaagguggacaacgcccugcagagcgggaacagccaggaguccgucaccgagcaggacagcaaggacuccaccuacagccuguccagcacgcucacccuguccaaggccgacuacgagaagcacaagguguacgcgugcgaggugacccaccagggccugagcucccccgucaccaagagcuucaaccgcggggagugc

SEQ ID NO: 8718 - RNA, 1335 nt, Artificial Sequence
  derived and/or modified sequence opt1 from Telisotuzumab_HeavyChain
caggugcagcugguccagagcggcgccgaggugaagaagcccggggccuccgugaaggucagcugcaaggcguccggcuacaucuucaccgccuacaccaugcacugggugcgccaggccccggggcagggccucgaguggaugggguggaucaagcccaacaacggccuggccaacuacgcccagaaguuccagggccgggugacgaugacccgcgacaccagcaucuccaccgcguacauggagcugagccggcuccgcuccgacgacacggccgucuacuacugcgcccggagcgagaucaccaccgaguucgacuacugggggcagggcacccuggugacgguguccagcgccuccaccaaggggcccagcgucuucccccuggcgccguccagcaaguccaccagcggcgggaccgccgcccucggcugccuggugaaggacuacuuccccgagcccgugacggucuccuggaacagcggcgcccugaccuccggggugcacaccuuccccgccgugcuccagagcagcggccuguacucccugagcuccgucgugaccgugccgagcuccagccucgggacgcagaccuacaucugcaacgucaaccacaagcccuccaacaccaagguggacaagcgcguggagcccaagagcugcgacugccacugcccgcccugccccgcgcccgagcugcugggcggccccuccgucuuccucuucccgcccaagcccaaggacacccugaugaucagccggacgcccgaggugaccugcguggucguggacgucucccacgaggacccggaggugaaguucaacugguacguggacggggucgaggugcacaacgccaagaccaagccccgcgaggagcaguacaacagcaccuaccggguggucuccgugcugacggugcuccaccaggacuggcugaacggcaaggaguacaagugcaaggucagcaacaaggcccugcccgcccccaucgagaagaccaucuccaaggccaaggggcagccgcgcgagccccagguguacacccucccgcccagccgggaggagaugaccaagaaccaggugucccugacgugccuggucaagggcuucuaccccagcgacaucgcgguggagugggaguccaacgggcagcccgagaacaacuacaagaccacgcccccggugcucgacagcgacggcagcuucuuccuguacuccaagcugaccgucgacaagagccgcuggcagcagggcaacguguucuccugcagcgugaugcacgaggcccuccacaaccacuacacccagaagucccugagccugucccccggg

SEQ ID NO: 8719 - RNA, 654 nt, Artificial Sequence
  derived and/or modified sequence opt1 from Telisotuzumab_LightChain
gacaucgugaugacccagagccccgacucccuggccgucagccucggcgagcgcgccaccaucaacugcaaguccagcgaguccguggacagcuacgcgaacuccuuccugcacugguaccagcagaagccggggcagccgcccaagcugcucaucuaccgggccagcacgcgcgaguccggcgugcccgaccgguucagcggguccggcagcgggaccgacuucacccugaccaucuccagccugcaggccgaggacgucgccguguacuacugccagcaguccaaggaggacccccucacguucggcggcgggaccaagguggagaucaagcgcaccgucgccgcgcccagcguguucaucuucccgcccuccgacgagcagcucaagagcggcaccgccuccguggucugccugcugaacaacuucuacccccgggaggccaaggugcaguggaagguggacaacgcccugcagagcgggaacagccaggaguccgucacggagcaggacagcaaggacuccaccuacagccuguccagcacccucacccuguccaaggcggacuacgagaagcacaagguguacgccugcgaggugacgcaccagggccugagcucccccgucaccaagagcuucaaccgcggggagugc

SEQ ID NO: 8720 - RNA, 1335 nt, Artificial Sequence; identical to SEQ ID NO: 8718
  derived and/or modified sequence opt1 from Telisotuzumab_vedotin_HeavyChain

SEQ ID NO: 8721 - RNA, 654 nt, Artificial Sequence; identical to SEQ ID NO: 8719
  derived and/or modified sequence opt1 from Telisotuzumab_vedotin_LightChain

SEQ ID NO: 8722 - RNA, 1350 nt, Artificial Sequence
  derived and/or modified sequence opt1 from Timigutuzumab_HeavyChain
gaggugcagcuggucgagagcggcgggggccucgugcagcccgggggcucccugcgccugagcugcgccgccuccggguucaacaucaaggacaccuacauccacugggugcggcaggcgccgggcaagggccucgagugggucgcccgcaucuaccccaccaacggguacacgcgguacgccgacagcgugaagggccgcuucaccaucuccgccgacaccagcaagaacaccgccuaccugcagaugaacucccugcgggcggaggacacggccguguacuacugcagccgcuggggcggggacggguucuacgccauggacuacuggggccagggcacccucgucaccguguccagcgccuccaccaaggggcccagcguguucccccuggcgccguccagcaaguccacgagcggcgggaccgccgcccugggcugccucgucaaggacuacuuccccgagcccgugaccguguccuggaacagcggcgcccugaccuccgggguccacacguuccccgccgugcugcagagcagcggccucuacucccugagcuccguggucaccgugccgagcuccagccuggggacccagaccuacaucugcaacgugaaccacaagcccuccaacacgaaggucgacaagaagguggagcccaagagcugcgacaagacccacacgugcccgcccugccccgcgcccgagcuccugggcgggcccuccguguuccuguucccgcccaagcccaaggacacccucaugaucagccggacccccgaggugaccugcgucguggucgacgugucccacgaggacccggaggucaaguucaacugguacguggacggcguggagguccacaacgccaagaccaagccccgcgaggagcaguacaacagcaccuaccgggugguguccguccugacggugcugcaccaggacuggcucaacggcaaggaguacaagugcaaggugagcaacaaggcccugcccgcccccaucgagaagaccaucuccaaggccaaggggcagccgcgcgagccccaggucuacacccugccgcccagccgggacgagcucaccaagaaccaggugucccugacgugccuggugaagggcuucuaccccagcgacaucgcggucgagugggaguccaacgggcagcccgagaacaacuacaagaccacgcccccggugcucgacagcgacggcagcuucuuccuguacuccaagcugaccguggacaagagccgcuggcagcaggggaacgucuucuccugcagcgugaugcacgagggccuccacaaccacuacacccagaagucccugagccugucccccggcaag

SEQ ID NO: 8723 - RNA, 642 nt, Artificial Sequence; identical to SEQ ID NO: 8384
  derived and/or modified sequence opt1 from Timigutuzumab_LightChain

SEQ ID NO: 8724 - RNA, 1332 nt, Artificial Sequence; identical to SEQ ID NO: 7768
  derived and/or modified sequence opt1 from Timolumab_HeavyChain

SEQ ID NO: 8725 - RNA, 642 nt, Artificial Sequence; identical to SEQ ID NO: 7769
  derived and/or modified sequence opt1 from Timolumab_LightChain

SEQ ID NO: 8726 - RNA, 1347 nt, Artificial Sequence
  derived and/or modified sequence opt1 from Tomuzotuximab_HeavyChain
caggugcagcugaagcagagcggccccgggcucguccagccgucccagagccuguccaucacgugcaccgugagcggcuucucccugaccaacuacggggugcacuggguccgccagagccccggcaaggggcucgaguggcugggcgugaucugguccggcgggaacaccgacuacaacacccccuucaccagccggcuguccaucaacaaggacaacagcaagucccagguguucuucaagaugaacagccuccaguccaacgacacggccaucuacuacugcgcccgcgcgcugaccuacuacgacuacgaguucgccuacuggggccaggggacccuggucaccgugagcacggccuccaccaagggccccagcguguucccgcucgcccccuccagcaaguccaccagcgggggcaccgccgcgcugggcugccuggucaaggacuacuuccccgagcccgugacggugagcuggaacuccggggcccucaccagcggcguccacaccuucccggccgugcugcaguccagcgggcuguacucccucagcuccguggucaccgugcccagcuccagccugggcacgcagaccuacaucugcaacgugaaccacaagcccuccaacaccaaggucgacaagaagguggagcccaagagcugcgacaagacccacacgugcccgcccugccccgcccccgagcugcucggcgggccguccguguuccuguucccgcccaagcccaaggacacccugaugaucagccggacccccgaggugaccugcgucguggucgacgugucccacgaggaccccgaggucaaguucaacugguacguggacggcguggagguccacaacgcgaagacgaagccccgcgaggagcaguacaacagcaccuaccgggugguguccguccucaccgugcugcaccaggacuggcugaacgggaaggaguacaagugcaaggugagcaacaaggcccuccccgccccgaucgagaagaccaucuccaaggccaagggccagccccgcgagccccaggucuacacgcugcccccgagccgggacgagcugaccaagaaccaggugagccugaccugccucgugaagggguucuaccccuccgacaucgccgucgagugggagagcaacggccagcccgagaacaacuacaagaccacgccgcccgugcuggacuccgacggcagcuucuuccucuacuccaagcugaccguggacaagagccgcuggcagcaggggaacgucuucuccugcagcgugaugcacgagggccugcacaaccacuacacccagaagucccucagccugucccccgggaag

SEQ ID NO: 8727 - RNA, 642 nt, Artificial Sequence; identical to SEQ ID NO: 7799
  derived and/or modified sequence opt1 from Tomuzotuximab_LightChain

SEQ ID NO: 8728 - RNA, 1347 nt, Artificial Sequence; identical to SEQ ID NO: 8527
  derived and/or modified sequence opt1 from Trastuzumab_duocarmazine_HeavyChain

SEQ ID NO: 8729 - RNA, 642 nt, Artificial Sequence; identical to SEQ ID NO: 8384
  derived and/or modified sequence opt1 from Trastuzumab_duocarmazine_LightChain

SEQ ID NO: 8730 - RNA, 1368 nt, Artificial Sequence
  derived and/or modified sequence opt1 from Varisacumab_HeavyChain
caggugcagcugguccagagcggcgccgaggugaagaagcccggggccuccgugaaggucagcugcaaggcguccggcgggaccuucagcuccuacgccaucagcugggugcgccaggccccgggccaggggcucgaguggaugggcggcuucgaccccgaggacggggagaccaucuacgcccagaaguuccagggccgggugacgaugaccgaggacaccuccaccgacacggccuacauggagcugagcucccugcgcagcgaggacaccgcggucuacuacugcgccaccgggcgguccauggugcgcggcgugaucauccccuucaacgggauggacgucuggggccagggcaccacggugaccgugagcuccgccagcaccaaggggcccuccgucuucccgcucgcccccagcuccaagagcaccuccggcgggacggcggcccugggcugccuggugaaggacuacuuccccgagcccgugaccgucagcuggaacagcggcgcccucaccuccggggugcacaccuucccggccgugcugcagagcuccggccuguacagccucuccagcgucgugacggugcccuccagcucccuggggacccagaccuacaucugcaacgucaaccacaagcccagcaacaccaagguggacaagaagguggagcccaaguccugcgacaagacgcacacgugcccgcccugccccgcccccgagcugcucggcgggccgagcgucuuccuguucccgcccaagcccaaggacacccugaugaucucccggacccccgaggugaccugcgucgugguggacgucagccacgaggaccccgaggugaaguucaacugguacguggacggcgucgaggugcacaacgcgaagaccaagccccgcgaggagcaguacaacuccaccuaccggguggucagcgugcucaccgugcugcaccaggacuggcugaacggcaaggaguacaagugcaaggucuccaacaaggcccuccccgccccgaucgagaagacgaucagcaaggccaaggggcagccccgcgagccccagguguacacccugcccccgucccgggacgagcugaccaagaaccaggugagccugaccugccucgucaagggcuucuaccccagcgacaucgccguggagugggaguccaacgggcagcccgagaacaacuacaagacgaccccgcccgugcuggacagcgacggcuccuucuuccucuacagcaagcugaccgucgacaagucccgcuggcagcaggggaacguguucagcugcuccgugaugcacgaggcgcugcacaaccacuacacccagaagucccucagccugagccccggcaag

SEQ ID NO: 8731 - RNA, 642 nt, Artificial Sequence
  derived and/or modified sequence opt1 from Varisacumab_LightChain
gacauccgcaugacccagagccccuccagccuguccgccagcgugggcgaccgggucaccaucacgugccgcgccucccagagcaucuccagcuaccucaacugguaccagcagaagccggggaaggcgcccaagcugcugaucuacgccgccuccagccuccaguccggcgugcccagccgguucuccgggagcggcuccgggaccgacuucacccugaccaucagcucccugcagcccgaggacuucgccacguacuacugccagcagagcuacuccaccccgcucaccuucggcggcgggaccaagguggagaucaagcgcacggucgccgcgcccagcguguucaucuucccgcccagcgacgagcagcugaaguccggcaccgccagcguggucugccugcucaacaacuucuacccccgggaggccaaggugcaguggaagguggacaacgcccugcaguccgggaacagccaggaguccgucaccgagcaggacagcaaggacuccaccuacagccuguccagcacgcucacccuguccaaggcggacuacgagaagcacaagguguacgccugcgaggugacccaccagggccugagcucccccgucaccaagagcuucaaccgcggggagugc

SEQ ID NO: 8732 - RNA, 1359 nt, Artificial Sequence
  derived and/or modified sequence opt1 from Vunakizumab_HeavyChain
gaggugcagcugguccagagcggcgccgaggugaagaagcccggggccuccgugaaggucagcugcaaggcguccggcuacaccuucaccgacuacgaggugcacugggugcgccaggccccggggcagggccucgaguggaugggggucaucgaccccggcacgggcgggguggccuacaaccagaaguucgagggccgggugaccaugaccgccgacaccagcacguccaccgccuacauggagcugcgcagccugcgguccgacgacaccgcggucuacuacugcacccgcuacagccucuucuacggguccagccccuacgccauggacuacuggggccaggggacgcuggugaccguguccagcgccuccaccaagggccccagcgucuucccgcuggcccccuccagcaaguccaccagcggcgggacggcggcccucggcugccuggugaaggacuacuuccccgagcccgugaccgucuccuggaacagcggggcccugaccagcggcgugcacaccuucccggccgugcuccaguccagcggccuguacucccugagcuccgucgugacggugcccagcuccagccucgggacccagaccuacaucugcaacgucaaccacaagcccuccaacaccaagguggacaagaagguggagcccaagagcugcgacaagacgcacacgugcccgcccugccccgcccccgagcugcugggcgggccguccgucuuccucuucccgcccaagcccaaggacacccugaugaucagccggacccccgaggugaccugcgucgugguggacgucucccacgaggaccccgaggugaaguucaacugguacguggacggcgucgaggugcacaacgcgaagaccaagccccgcgaggagcaguacaacagcaccuaccggguggucuccgugcugaccgugcuccaccaggacuggcugaacgggaaggaguacaagugcaaggucagcaacaaggcccugcccgccccgaucgagaagacgaucuccaaggccaagggccagccccgcgagccccagguguacacccucccgcccagccgggaggagaugaccaagaaccaggugucccugaccugccuggucaagggcuucuaccccagcgacaucgccguggagugggagagcaacgggcagcccgagaacaacuacaagacgaccccgcccgugcucgacuccgacggcagcuucuuccuguacuccaagcugaccgucgacaagagccgcuggcagcaggggaacguguucuccugcagcgugaugcacgaggcgcuccacaaccacuacacccagaagucccugagccugucccccggcaag

SEQ ID NO: 8733 - RNA, 639 nt, Artificial Sequence
  derived and/or modified sequence opt1 from Vunakizumab_LightChain
gagaucgugcugacccagagccccgacuuccaguccgucaccccgaaggagaaggugacgaucacgugcagcgccuccagcuccgugaacuacaugcacugguuccagcagaagcccgaccagagccccaagcucuggaucuaccgcaccuccaaccuggccagcggcguccccucccgguucagcggguccggcagcgggaccgacuacacgcugaccaucaacucccucgaggcggaggacgccgccaccuacuacugccagcagcgcagcuccuacccguggaccuucggccaggggacgaagcuggagaucaagcggaccguggccgcccccagcguguucaucuucccgcccuccgacgagcagcucaagagcggcaccgcguccgucgugugccugcugaacaacuucuacccccgcgaggccaaggugcaguggaaggucgacaacgcccugcagagcggcaacagccaggaguccgugaccgagcaggacagcaaggacuccacguacagccucuccagcacccugacccuguccaaggccgacuacgagaagcacaagguguacgcgugcgaggucacccaccaggggcucagcucccccgugaccaagagcuucaaccggggcgagugc

SEQ ID NO: 8734 - RNA, 1341 nt, Artificial Sequence; identical to SEQ ID NO: 8637
  derived and/or modified sequence opt1 from Xentuzumab_HeavyChain

SEQ ID NO: 8735 - RNA, 648 nt, Artificial Sequence; identical to SEQ ID NO: 8638
  derived and/or modified sequence opt1 from Xentuzumab_LightChain

SEQ ID NO: 8736 - RNA, 726 nt, Artificial Sequence
  derived and/or modified sequence opt1 from anti-rabies_SO57_LightChain
augagcgugcccaccauggccugggcccugcuccugcugucccuccugacccagggcacggggagcugggcgcaguccgcccugacccagccgcgcagcgucuccggcagccccgggcaguccgugaccaucagcugcaccggcacguccagcgacaucgggggcuacaacuucguguccugguaccagcagcaccccggcaaggcccccaagcucaugaucuacgacgccaccaagcggccgagcgggguccccgaccgcuucuccggcagcaaguccgggaacaccgccagccugaccaucuccggccugcaggcggaggacgaggccgacuacuacugcugcagcuacgccggggacuacacgcccggcgugguguucggcgggggcaccaagcucaccguccuggggcagcccaaggccgcgccguccgugacccuguucccgcccagcagcgaggagcuccaggccaacaaggccacgcuggugugccugaucuccgacuucuaccccggcgccgucaccguggccuggaaggcggacagcucccccgugaaggccggcgucgagaccaccacgcccagcaagcaguccaacaacaaguacgccgccagcuccuaccucagccugacccccgagcaguggaagucccaccggagcuacuccugccaggugacccacgaggggagcaccguggagaagacggucgcccccaccgagugcucc

SEQ ID NO: 8737 - RNA, 1428 nt, Artificial Sequence
  derived and/or modified sequence opt1 from anti-rabies_SO57_HeavyChain
auggacuggaccuggcgcuuccuguucguggucgccgccgcgaccggcgugcagagccaggugcagcucguccaguccggggccgaggugaagaagcccggcagcuccgugaaggucagcugcaaggccuccgggggcacguucaaccgguacaccgugaacugggugcgccaggccccggggcagggccuggaguggaugggcgggaucauccccaucuucggcaccgccaacuacgcgcagcgguuccaggggcgccugaccaucacggccgacgagagcaccuccaccgccuacauggagcucagcucccugcggagcgacgacaccgccgucuacuucugcgcgcgcgagaaccuggacaacuccggcacguacuacuacuucagcgggugguucgaccccuggggccagggcacccucgugaccguguccagcgccuccaccaaggggcccagcgucuucccgcuggcccccuccagcaaguccacgagcggcgggaccgccgcccugggcugccucgugaaggacuacuuccccgagcccgugaccgucagcuggaacuccggcgcgcugaccagcggggugcacacguucccggccgugcugcaguccagcggccucuacucccugagcuccgucgugaccgugcccagcuccagccuggggacccagaccuacaucugcaacgucaaccacaagcccuccaacacgaagguggacaagcggguggagcccaagagcugcgacaagacccacacgugcccgcccugccccgcccccgagcuccugggcgggccguccgucuuccuguucccgcccaagcccaaggacacccucaugaucagccgcacccccgaggugaccugcgucgugguggacgucucccacgaggaccccgaggugaaguucaacugguacguggacggcgucgaggugcacaacgccaagaccaagccccgggaggagcaguacaacagcaccuaccgcguggucuccgugcugacggugcugcaccaggacuggcucaacggcaaggaguacaagugcaaggucagcaacaaggcccugcccgcgccgaucgagaagaccaucuccaaggccaaggggcagccccgggagccccagguguacacccugcccccgagccgcgaggagaugaccaagaaccaggugagccucacgugccuggucaagggcuucuaccccuccgacaucgccguggagugggagagcaacgggcagcccgagaacaacuacaagaccaccccgcccgugcuggacuccgacggcagcuucuuccucuacuccaagcugaccgucgacaagagccgguggcagcaggggaacguguucuccugcagcgugaugcacgaggcccugcacaaccacuacacgcagaagucccucagccugucccccggcaag

SEQ ID NO: 8738 - RNA, 696 nt, Artificial Sequence
  derived and/or modified sequence opt1 from anti-rabies_SOJB_LightChain
auggccuggaccgugcugcuccugggccugcucagccacugcaccggguccgucacgagcuacgugcugacccagcccccguccgugagcgucgcccccggcaagaccgcgcgcaucaacugcgggggcaacaacaucgaguaccgguccgugcacugguaccagcagaaguccgggcaggcccccguggccgucaucuacgacaacagcgaccgccccagcggcaucccggagcgguucuccggcagcaaguccgggaacaccgccacgcugaccaucagccgcguggaggccggcgacgaggcggacuacuacugccaggugugggacaucuccagcgacgucguguucgggggcgggaccaagcucaccgugcugggccagcccaaggccgcccccuccgucacgcuguucccgcccagcuccgaggagcuccaggccaacaaggcgacccuggugugccugaucagcgacuucuaccccggcgccgugaccgucgccuggaaggccgacuccagccccgugaaggccgggguggagaccacgacccccagcaagcaguccaacaacaaguacgcggccagcuccuaccucagccugaccccggagcaguggaagucccaccggagcuacuccugccaggucacccacgagggcagcacgguggagaagaccguggcccccaccgagugcucc

SEQ ID NO: 8739 - RNA, 1554 nt, Artificial Sequence
  derived and/or modified sequence opt1 from anti-rabies_SOJB_HeavyChain
auggacacccugugcagcacccuccugcugcucacgauccccuccugggugcugagccagaucacccugaaggagaccggccccacccucgucaagcccacgcagacccugacccugaccugcacguucuccggguucagccucuccaccagcggcgugggggugggcuggauccgccagccgcccgggaaggcccuggagugggucacccugaucuacugggacgacgacaagcgguacuccccgagccucgagaaccgcgugaccauccggaaggacacguccaagaaccagguggcccugaccaugaccaacauggacccccuggacaccggcacguacuacugcgcgcaccgccagcacaucagcuccuuccccugguucgacagcuggggccaggggacccucgucaccguguccagcgccuccaccaagggccccagcguguucccgcuggcccccugcucccggagcacguccgggggcaccgccgcccuggggugccucgucaaggacuacuuccccgagcccgugaccgugagcuggaacagcggcgcgcugaccuccggcguccacacguucccggccgugcugcagagcuccgggcucuacagccuguccagcguggucaccgugcccuccagcucccugggcacccagaccuacacgugcaacgugaaccacaagcccagcaacaccaaggucgacaagcgcguggagcucaagacgccccugggggacaccacccacacgugcccgcggugccccgagcccaaguccugcgacacgcccccgcccugcccccgcugccccgagcccaagagcugcgacacgcccccgcccugcccccggugccccgagcccaaguccugcgacaccccgccgcccugcccccgcugccccgcccccgagcugcucggcggccccagcguguuccuguucccgcccaagcccaaggacacccugaugaucucccggacccccgaggugaccugcgucguggucgacgugagccacgaggaccccgagguccaguucaagugguacguggacgggguggagguccacaacgccaagaccaagccgcgcgaggagcaguucaacuccaccuuccggguggugagcguccucaccgugcugcaccaggacuggcugaacggcaaggaguacaagugcaagguguccaacaaggcgcuccccgcccccaucgagaagaccaucagcaagaccaaggggcagccccgcgagccgcaggucuacacccugccgcccagccgggaggagaugaccaagaaccaggugucccugaccugccucgugaagggcuucuaccccagcgacaucgccgucgagugggaguccagcgggcagcccgagaacaacuacaacaccacgccgcccaugcuggacuccgacggcagcuucuuccuguacuccaagcucaccguggacaagagccgcuggcagcagggcaacaucuucuccugcagcgugaugcacgaggcccugcacaaccgguucacccagaagucccugagccucucccccgggaag

SEQ ID NO: 8740 - RNA, 702 nt, Artificial Sequence
  derived and/or modified sequence opt1 from anti-rabies_SOJA_LightChain
auggaggcccccgcccagcuccuguuccugcugcuccuguggcugccggacaccaccggcgagaucgugcucacgcagagccccgcgacccugucccugagccccggggagcgggccacccucgccugccgggccucccagaccgccagccgcuaccuggcgugguaccagcagaagcccggccaggccccgcggcugcucaucuacgacacguccaaccgcgccaccgggauccccgcccgguucagcggcuccgggagcggcaccgacuucacccuguccaucagcucccuggagcccgaggacuucgcggucuacuacugccagcagcgcuucaacuggcccuggacguucggccaggggaccaagguggaguucaagcggaccguggccgccccgagcgucuucaucuucccgcccuccgacgagcagcucaagagcggcaccgccuccguggugugccugcugaacaacuucuacccccgcgaggccaagguccaguggaagguggacaacgcgcuccagagcgggaacucccaggagagcgugacggagcaggacuccaaggacagcaccuacagccuguccagcacccugacccucuccaaggccgacuacgagaagcacaaggucuacgccugcgaggugacgcaccagggccugagcucccccgugaccaagagcuucaaccgcggggagugc

SEQ ID NO: 8741 - RNA, 1422 nt, Artificial Sequence
  derived and/or modified sequence opt1 from anti-rabies_SOJA_HeavyChain
auggaguucggccugagcuggcuguuccugguggccauccugaaggggguccagugcgaggugcagcuccuggaguccggcgggggccuggugcagcccgggggcagccuccgccuguccugcgccgcgagcggcuucaccuucuccaacuacgccaugagcuggguccggcaggccccggggaagggccuggaguggguguccgccaucagcgccuccgggcacagcaccuaccucgcggacuccgugaagggccgcuucacgaucagccgggacaacuccaagaacacccuguaccugcagaugaacagccuccgcgccgaggacaccgccgucuacuacugcgccaaggaccgggaggugaccaugaucgugguccugaacgggggcuucgacuacuggggccaggggacgcgcgugaccguguccagcgcguccaccaagggccccagcgucuucccccuggcccccuccagcaagagcaccuccgggggcacggccgcccucggcugccuggugaaggacuacuucccggagcccgugaccgucagcuggaacuccggggcccugaccagcggcgugcacaccuuccccgcggugcuccaguccagcgggcuguacucccugagcuccgucgugacggugcccagcuccagccucggcacccagaccuacaucugcaacgucaaccacaagccguccaacaccaagguggacaagcggguggagcccaagagcugcgacaagacgcacacgugcccgcccugcccggcccccgagcugcucgggggccccuccgucuuccucuucccgcccaagcccaaggacacccugaugaucagccgcacccccgaggugaccugcgucgugguggacgucucccacgaggaccccgaggugaaguucaacugguacguggacggcgucgaggugcacaacgccaagaccaagccgcgggaggagcaguacaacagcaccuaccgcguggucuccgugcugaccgugcuccaccaggacuggcugaacgggaaggaguacaagugcaaggucagcaacaaggcccugcccgcccccaucgagaagacgaucagcaaggcgaagggccagccccgggagccccagguguacacccucccgcccucccgcgaggagaugaccaagaaccaggugagccugaccugccuggucaagggguucuaccccuccgacaucgccguggagugggagagcaacggccagcccgagaacaacuacaagacgaccccgcccgugcucgacuccgacgggagcuucuuccuguacuccaagcugaccgucgacaagagccgguggcagcagggcaacguguucuccugcagcgugaugcacgaggcccuccacaaccacuacacccagaagucccugagccugucccccggcaag

SEQ ID NO: 8742 - RNA, 321 nt, Artificial Sequence
  derived and/or modified sequence opt1 from anti-rabies_LightChain
gugaugacccagagccccgccacccugucccucagcccgggcgagcgcgccacgcuguccugccgggcgagccaguccguccgcaacuaccuggccugguaccagcagaagcccgggcaggcgccccggcuccugaucuacggcgccagcaaccgcgccaccgggauccccgcccgguucuccggcagcggguccggcaccgacuucacccugacgaucagcucccucgagccggaggacuucgccguguacuacugccagcagcgcagcgacuggccccuguccuucggccaggggaccaagcuggagaucaagcggacc

SEQ ID NO: 8743 - RNA, 333 nt, Artificial Sequence
  derived and/or modified sequence opt1 from anti-rabies_HeavyChain
ggccccgccugggaggugccggagacccugcccguccagccccucgacagccccuccguggccauggcgugcaccggggugcgccaggccccgggcaaggggcuggagugggucgccgugaucagcuacgacggcuccaacaaguacuacgccgacagcgugaaggggcgguucacgaucucccgcgacaacagcaagaacacccuguaccuccagaugaacucccugcgggccgaggacaccgcggucuacuacugcgccaaggacagcaacuccggcagcuacuacgcccacgaccugggcuacugggggcagggcacccucgugacggug

SEQ ID NO: 8744 - RNA, 342 nt, Artificial Sequence
  derived and/or modified sequence opt1 from anti-rabies_LightChain
gagcuggugaugacccagagcccccucucccugccggucacccugggccagcccgccagcaucuccugccgcagcucccagagccucauccacuccaacgggaacacguaccugaacugguuccagcagcggcccggccagagcccccgccggcugaucuacaagguguccgaccgcgacagcggggugccggaccgguucuccggcagcggguccggcaccgacuucacccucaagaucagccgcgucgaggccgaggacgugggcguguacuacugccugcaggggacccacuggccccggacguucggccaggggaccaagcuggagaucaagcgcacc

SEQ ID NO: 8745 - RNA, 351 nt, Artificial Sequence
  derived and/or modified sequence opt1 from anti-rabies_HeavyChain
gugguccagcccggccgcagccugcggcucuccugcgccgccagcggguucaccuucuccagcuacgcgaugcacugggugcgccaggccccgggcaaggggcuggaguggguggccgucaucuccuacgacggcagcaacaaguacuacgccgacuccgugaaggggcgguucaccaucagccgcgacaacuccaagaacacgcuguaccuccagaugaacagccugcgggccgaggacaccgcgguguacuacugcgcccgcgacaaggcccuggccgcgcggcgcggcuacuacuacuacuacggcaccgacgucugggggcagggcacccucgugacgguguccagc

SEQ ID NO: 8746 - RNA, 648 nt, Artificial Sequence
  derived and/or modified sequence opt1 from anti-RSV_5ITB_LightChain
agcgacauccagaugacccagucccccagcacccuguccgccagcgugggcgaccgcgucacgaucacgugccgggccucccagagcaucuccagcuggcucgcgugguaccagcagaagccggggaaggcccccaagcugcugaucuacgacgccuccagccucgaguccggcgugcccagccgcuucuccgggagcggcuccgggaccgaguucacccugaccaucagcucccugcagcccgacgacuucgccaccuacuacugccagcaguacaacaccuacagcugguggaccuucggccagggcacgaagguggacaucaagcggaccgucgccgcgccguccguguucaucuucccgcccagcgacgagcagcucaagagcgggaccgccuccguggucugccugcugaacaacuucuacccccgcgaggccaaggugcaguggaagguggacaacgcccuccagagcggcaacucccaggagagcgucaccgagcaggacuccaaggacagcacguacucccugagcuccacccugacccucagcaaggcggacuacgagaagcacaagguguacgccugcgaggugacccaccaggggcuguccagccccgucacgaaguccuucaaccggggcgagugc

SEQ ID NO: 8747 - RNA, 660 nt, Artificial Sequence
  derived and/or modified sequence opt1 from anti-RSV_5ITB_HeavyChain
guggagagcggcgggggccugauccagcccgggggcucccuccgccugagcugcgccgucuccggguucaccgugagcuccaaguacaugaccugggugcggcaggccccgggcaagggccuggagugggucagcgugaucuacgggggcggguccacguacuacgcggacagcguggucggccgcuucaccaucucccgggacaacagcaagaacacccucuaccugcagaugaacucccugcgcgccgaggacaccgccguguacuacugcgccagccggcucggggugcgcgccacgaccggcgaccuggacuacuggggccaggggacccuggucaccguguccagcgcguccacgaagggccccagcguguucccccucgcccccuccagcaaguccaccagcgggggcaccgccgcccugggcugccuggucaaggacuacuucccggagcccgugaccgugagcuggaacuccggggcgcucacgagcggcguccacaccuuccccgccgugcugcaguccagcgggcuguacucccucagcuccguggucaccgugcccagcuccagccugggcacccagacguacaucugcaacgugaaccacaagccguccaacaccaaggucgacaagcggguggagcccaagagcugc

SEQ ID NO: 8748 - RNA, 639 nt, Artificial Sequence; identical to SEQ ID NO: 8712
  derived and/or modified sequence opt1 from anti-alpha-toxin_4U6V_LightChain

SEQ ID NO: 8749 - RNA, 675 nt, Artificial Sequence
  derived and/or modified sequence opt1 from anti-alpha-toxin_4U6V_HeavyChain
gaggugcagcuggucgagagcggcgggggccucgugcagcccgggggcucccugcgccugagcugcgccgccuccggguucaccuucagcucccacgacaugcacugggugcggcaggcgaccggcaagggccucgagugggucagcgggaucggcacggccggggacaccuacuacccggacuccgugaagggccgcuucaccaucagccgggagaacgccaagaacucccuguaccugcagaugaacagccuccgcgccggggacaccgccguguacuacugcgcgcgggaccgcuacucccccacgggccacuacuacggcauggacgucugggggcagggcaccaccgugaccgugagcuccgccagcacgaaggggcccuccgucuucccccuggccccgagcuccaagagcaccuccggcggcaccgccgcgcuggggugccucgugaaggacuacuuccccgagcccgugaccgucagcuggaacagcggcgcccugacguccggggugcacaccuuccccgccgugcugcagagcuccggccucuacagccuguccagcgucgugaccgugccguccagcucccuggggacccagacguacaucugcaacgucaaccacaagcccagcaacaccaagguggacaagcggguggagcccaaguccugc

SEQ ID NO: 8750 - RNA, 879 nt, Artificial Sequence
  derived and/or modified sequence opt1 from anti-alpha-toxin_4U6V_Chain-A
gccgacagcgacaucaacaucaagaccggcaccacggacaucggguccaacaccaccgugaagaccggcgaccuggucacguacgacaaggagaacgggaugcacaagaagguguucuacagcuucaucgacgacaagaaccacaacaagaagcuccuggugauccgcaccaagggcaccaucgccgggcaguaccgggucuacuccgaggagggcgcgaacaagagcggccuggccuggcccuccgccuucaaggugcagcuccagcugccggacaacgagguggcccagaucagcgacuacuacccccgcaacuccaucgacaccaaggaguacaugagcacgcugaccuacggguucaacggcaacgucaccggggacgacaccggcaagaucgggggccucaucggcgccaacguguccaucgggcacacgcugaaguacgugcagcccgacuucaagaccauccuggagagccccaccgacaagaaggucggcuggaaggugaucuucaacaacauggugaaccagaacugggggccguacgaccgggacuccuggaaccccgucuacggcaaccagcuguucaugaagacccgcaacggcagcaugaaggcggccgacaacuuccucgaccccaacaaggccuccagccugcucuccagcggguucucccccgacuucgccacggugaucaccauggaccggaaggcgagcaagcagcagaccaacaucgacgugaucuacgagcgcguccgggacgacuaccagcugcacuggaccuccacgaacuggaagggcaccaacaccaaggacaaguggaucgaccgcagcagcgagcgguacaagaucgacugggagaaggaggagaugaccaac

SEQ ID NO: 8751 - RNA, 879 nt, Artificial Sequence; identical to SEQ ID NO: 8750
  derived and/or modified sequence opt1 from anti-alpha-toxin_4U6V_Chain-B

SEQ ID NO: 8752 - RNA, 642 nt, Artificial Sequence
  derived and/or modified sequence opt1 from anti-IsdB_5D1Q_Chain-A
gacauccagcugacccagagccccuccagcguguccgccagcgucggcgaccgcaucaccaucacgugccgggccucccaggacaucagcaacuggguggcgugguaccagcagaagccggggaaggcccccaagcuccugaucuacuccgccagcucccugcagagcggcgugcccucccgcuucagcggguccggcagcgggaccgacuucacccucaccaucuccagccugcagcccgaggacuucgccacguacuacugccagcaggccaacaccuucccguggaccuucggccagggcaccaaggucgagaucaagcggacgguggcggcccccuccguguucaucuucccgcccagcgacgagcagcugaaguccgggaccgccagcgucgugugccuccugaacaacuucuacccccgcgaggccaaggugcaguggaaggucgacaacgcgcugcagagcggcaacucccaggagagcgugaccgagcaggacuccaaggacagcaccuacucccucagcuccacgcugacccugagcaaggccgacuacgagaagcacaagguguacgccugcgaggucacccaccaggggcucuccagccccgugaccaaguccuucaaccggggcgagugc

SEQ ID NO: 8753 - RNA, 783 nt, Artificial Sequence
  derived and/or modified sequence opt1 from anti-IsdB_5D1Q_Chain-B
caggugcagcugguccagagcggcgccgaggugaagaagcccgccuccagcgugaaggucuccugccaggcgagcgggggcuccuucagcacccgcaccaucuccuggcuccggcaggccccggggcagggccuggaguggaugggcgggaucagccccaucuucggcgccgccaacuacgcccagcgcuuccaggggcgggugacgaucaccgcggacaaguccaccagcaccgccuacauggagcugacgucccucaccagcgaggacaccgccguguacuacugcgcccgcgaccggccgcccggcgcgcaguucgacaccugggggcagggcacgcuggucaccguguccagcgccuccaccaaggggccgagcguguucccccuggcccccuccagcaaguccaccagcggcggcacggccgcccucgggugccuggucaaggacuacuuccccgagccggugaccgugagcuggaacuccggcgcgcugaccagcgggguccacaccuuccccgccgugcuccaguccagcggccuguacucccugagcuccguggucacggugcccagcuccagccucggcacccagaccuacaucugcaacgugaaccacaagcccuccaacaccaaggucgacaagaagguggagcccaagagcugcgggggcggguccggccaccaccaccaccaccaccaccaccaccacgggggcgacuacaaggaccacgacggcgacuacaaggaccacgacaucgacuacaaggacgacgacgacaag

SEQ ID NO: 8754 - RNA, 822 nt, Artificial Sequence
  derived and/or modified sequence opt1 from anti-IsdB_5D1Q_Chain-C
gaggugcagcuggucgagagcggcgggggccucgugcagcccgggggcucccugacccugagcugcgccgccuccgggcucaucuucagcgacuccaccaugcacugggugcgccaggcgagcggccggggccuggagugggucgcccgcauccgguccaaggccaacaacuacgccacgagcuccgacaagagcgccaccgcguaccuggccuccgugaaggggcgcuucaccaucagccgggacgacuccaaggacaccacguuccucgagaugagcucccugaagaucgaggacaccgccguguacuacugcaucgccagcuccaccaccggcugguacguccgcgaggacuucgacuacugggggcacggcacgcuggugaccgugagcuccgcgagcaccaaggggccgagcgucuucccccucgcccccuccagcaaguccaccagcggcggcacggccgcccuggggugccuggugaaggacuacuuccccgagccggugaccgucuccuggaacagcggcgcccucaccuccggggugcacaccuuccccgcggugcugcagagcuccggccuguacagccucuccagcgucgugacggugcccuccagcucccugggcacccagaccuacaucugcaacgucaaccacaagcccagcaacaccaagguggacaagaagguggagccgaaguccugcgggggcgggagcggccaccaccaccaccaccaccaccaccaccacgggggcgacuacaaggaccacgacggcgacuacaaggaccacgacaucgacuacaaggacgacgacgacaag

SEQ ID NO: 8755 - RNA, 648 nt, Artificial Sequence
  derived and/or modified sequence opt1 from anti-IsdB_5D1Q_Chain-D
gagaucgugcugacccagagccccggcacccucucccugagcccgggggagcgcgccacgcuguccugccgggccagccaguccgucagcuccagcuaccucgcgugguaccagcagaagcccggccaggcgccccgccugcugaucuacggggccuccagccgggccaccggcauccccgaccgcuucuccgggagcggcuccggcaccgacuucacccucagcaucucccggcuggagccggaggacuucgccguguacuacugccugcacuacgggacgagccccauguacaccuucggccaggggaccaagcucgagaucaagcgcaccguggccgcccccuccgucuucaucuucccgcccagcgacgagcagcugaaguccggcacggccagcguggugugccugcucaacaacuucuacccccgggaggccaagguccaguggaagguggacaacgcgcugcagagcgggaacucccaggagagcgugaccgagcaggacuccaaggacagcaccuacucccugagcuccacccucacgcugagcaaggccgacuacgagaagcacaaggucuacgccugcgaggugacccaccagggccuguccagccccgugaccaaguccuucaaccgcggcgagugc

SEQ ID NO: 8756 - RNA, 360 nt, Artificial Sequence
  derived and/or modified sequence opt1 from anti-IsdB_5D1Q_Chain-E
cccggcaagaugaccgaccugcaggacaccaaguacguggucuacgagagcguggagaacaacgaguccaugauggacacguucgugaagcacccgaucaagaccgggaugcucaacggcaagaaguacauggucauggagaccaccaacgacgacuacuggaaggacuucaugguggaggggcagcgcgugcggacgaucagcaaggacgccaagaacaacacccgcaccaucaucuuccccuacgucgagggcaagacccuguacgacgccaucgugaaggugcacgucaagacgaucgacuacgacgggcaguaccacgugcggaucguggacaaggaggcguucaccaaggccaac

SEQ ID NO: 8757 - RNA, 657 nt, Artificial Sequence
  derived and/or modified sequence opt1 from anti-IsdB_5D1X_Chain-A
gacaucgugaugacccagagcccccugucccucccggucacccugggccagcccgccagcaucuccugcagcuccgcccagagccuggugcacuccgacggggacagcuaccucacgugguuccaccagcgccccggccagagcccccggcgccugaucuacaagguguccauccgggacgcgggggucccggaccgcuucuccggcagcggguccggcaccgacuucacccugaagaucagccggguggaggccgaggacgugggcgucuacuacugcaugcaggccacccacuggcccuacacguucgggcagggcaccaagcucgagaucaagcgcaccguggccgcccccuccguguucaucuucccgcccagcgacgagcagcugaaguccgggaccgcgagcgucgugugccugcucaacaacuucuacccccgggaggccaaggugcaguggaaggucgacaacgcccugcaguccggcaacagccaggagagcgugacggagcaggacuccaaggacagcaccuacucccugagcuccacccucacccugagcaaggccgacuacgagaagcacaagguguacgcgugcgaggucacgcaccaggggcuguccagccccgugaccaaguccuucaaccgcggcgagugc

SEQ ID NO: 8758 - RNA, 777 nt, Artificial Sequence
  derived and/or modified sequence opt1 from anti-IsdB_5D1X_Chain-B
caggugcagcugguccagagcggcuccgaggugaagaagcccgggagcuccgugacccucagcugcaaggccuccggcgacaccuucaacacgcacaccuacagcuggguccggcaggccccggggcagcggcuggaguggaucggcgggaucaugcccaucuucgcggccuccaagagcgcgccccaccuccaggaccgccugaccaucaccgccaacaaggccacgcggaccgccuacauggagcugaccucccugaccagcgacgacuccggcguguacuacugcgcccgcgacggccgcggggcccuccaguacuggggccaggggacgcuggugaccgucagcuccgccagcaccaagggccccuccguguucccgcuggcgcccagcuccaagagcaccuccgggggcacggccgcccucggcugccuggugaaggacuacuuccccgagcccgucaccgugagcuggaacagcggggcccugaccuccggcgugcacaccuucccggccguccuccagagcuccgggcuguacagccuguccagcguggugacgguccccuccagcucccucggcacccagaccuacaucugcaacgugaaccacaagcccagcaacaccaagguggacaagaaggucgagcccaaguccugcggcgggggcagcgggcaccaccaccaccaccaccaccaccaccacggcggggacuacaaggaccacgacggcgacuacaaggaccacgacaucgacuacaaggacgacgacgacaag

SEQ ID NO: 8759 - RNA, 822 nt, Artificial Sequence; identical to SEQ ID NO: 8754
  derived and/or modified sequence opt1 from anti-IsdB_5D1X_Chain-C

SEQ ID NO: 8760 - RNA, 648 nt, Artificial Sequence
  derived and/or modified sequence opt1 from anti-IsdB_5D1X_Chain-D
gagaucgugcugacgcagacccccgccacgcucagccugaccccgggcgagcgcgccacccugaccugccgggcgucccagagcgucuccagcuccuaccucgccugguaccagcagaagcccgggcaggcgccccgccugcugaucuacggcgccagcucccgggccacggggauccccgaccgcuucagcggcuccgggagcggcaccgacuucacccucuccaucagccggcuggagccggaggacuucgccguguacuacugccugcacuacggcaccucccccauguacuucuucgggcgcggcacggugcucgacaucaagcggaccgucgccgcccccagcguguucaucuucccgcccuccgacgagcagcucaagagcgggaccgccuccguggucugccugcugaacaacuucuacccccgcgaggcgaaggugcaguggaagguggacaacgcccugcagagcggcaacucccaggagagcgucaccgagcaggacagcaaggacuccacguacagccuguccagcacccucacccuguccaaggccgacuacgagaagcacaagguguacgccugcgaggugacccaccaggggcugagcucccccgucaccaagagcuucaaccggggcgagugc

SEQ ID NO: 8761 - RNA, 354 nt, Artificial Sequence
  derived and/or modified sequence opt1 from anti-IsdB_5D1X_Chain-E
aagaugaccgaccugcaggacaccaaguacguggucuacgagagcguggagaacaacgaguccaugauggacacguucgugaagcaccccaucaagaccggcaugcucaacgggaagaaguacauggucauggagaccaccaacgacgacuacuggaaggacuucaugguggagggccagcgcgugcggacgaucagcaaggacgccaagaacaacacccgcaccaucaucuucccguacgucgaggggaagacccuguacgacgccaucgugaaggugcacgucaagacgaucgacuacgacggccaguaccacgugcggaucguggacaaggaggcguucaccaaggccaac

SEQ ID NO: 8762 - RNA, 792 nt, Artificial Sequence
  derived and/or modified sequence opt1 from anti-IsdB_5D1Z_Chain-B
gccgaggugcagcuggucgagagcggcgggggcguggugcagcccgggggcucccuccgccugagcugcgccgcguccggguucaccuucaacaaguucuggaugaacuggguccggcaggccccgggcaagggccuggaguggguggccgacauccagguggacgggagcgagaagaacuacgucgacuccgugaagggccgcuucaccaucagccgggacaacgggaagaacucccucuaccugcagaugaacagccugcgcgccgaggacacgggcguguacuacugcgcccgggggcgcuacgacuacugguccggcuaccucagccccuggggccaggggacccuggucaccguguccagcgcguccaccaagggccccagcguguucccccuggccccguccagcaaguccacgagcgggggcaccgccgcccucggcugccuggucaaggacuacuuccccgagcccgugaccguguccuggaacagcggggcgcugaccagcggcguccacacguuccccgccgugcuccaguccagcgggcuguacucccugagcuccguggucaccgugccgagcuccagccucggcacccagaccuacaucugcaacgugaaccacaagcccuccaacacgaaggucgacaagaagguggagcccaagagcugcgggggcggcuccgggcaccaccaccaccaccaccaccaccaccacggcggggacuacaaggaccacgacggcgacuacaaggaccacgacaucgacuacaaggacgacgacgacaag

SEQ ID NO: 8763 - RNA, 642 nt, Artificial Sequence
  derived and/or modified sequence opt1 from anti-IsdB_5D1Z_Chain-C
gacauccagcugacccagagccccuccuuccucagcgccuccguggccgaccgcgucaccaucacgugccgggcgagccaggccgugcgcuccagccuggccugguaccagcagaagccgggcaaggcgccccagcugcucaucuacuccgccagcacccuggagaacgggguguccagccgguucuccggcagcgggcccggcaccgaguucacccugacgaucuccagccuccagcccgaggacgucgggaccuacuacugccagcagcugaacaccuacccguucaccuucggccccggcacgaagguggagaucaagcgcaccguggccgcccccuccgucuucaucuucccgcccagcgacgagcagcugaaguccgggaccgccagcguggugugccuccugaacaacuucuacccccgggaggccaagguccaguggaagguggacaacgcgcugcaguccggcaacagccaggagagcgugaccgagcaggacuccaaggacagcacguacucccucagcuccacccugacccugagcaaggccgacuacgagaagcacaaggucuacgccugcgaggugacccaccaggggcucuccagccccgugacgaaguccuucaaccgcggcgagugc

SEQ ID NO: 8764 - RNA, 810 nt, Artificial Sequence
  derived and/or modified sequence opt1 from anti-IsdB_5D1Z_Chain-D
caggugcagcugcaggagagcggccccgggcucgucaagccguccgagacccugagccugaucugcaccguguccggcgggagcaucuccagcuccagcuacuacuggggcuggauccgccagacgcccgagcggaaccucgaguggaucgggaucaucuacuucuccggcaccaccuacuacaaccccagccugcagucccgcgugagcaugucccuggaccggagcaccaaccgcuucucccuccggcugagcuccgucacggccgccgacaccgcgaucuacuacugcgccaagcccaagagccgcgaccggggcgggccgggcgacgacuacuucgggauggacguguggggccaggggaucauggugaccgucuccagcgccagcaccaagggccccuccguguucccccuggcccccagcuccaagagcacguccggcgggaccgccgcgcucggcugccuggugaaggacuacuucccggagcccgucaccgugagcuggaacuccggggcccugaccagcggcgugcacacguuccccgccguccuccaguccagcggccuguacucccugagcuccguggugaccguccccagcuccagccucgggacccagaccuacaucugcaacgugaaccacaagccguccaacacgaagguggacaagaaggucgagcccaagagcugcggcgggggcuccgggcaccaccaccaccaccaccaccaccaccacggcggcgacuacaaggaccacgacggggacuacaaggaccacgacaucgacuacaaggacgacgacgacaag

SEQ ID NO: 8765 - RNA, 810 nt, Artificial Sequence; identical to SEQ ID NO: 8764
  derived and/or modified sequence opt1 from anti-IsdB_5D1Z_Chain-F

SEQ ID NO: 8766 - RNA, 792 nt, Artificial Sequence; identical to SEQ ID NO: 8762
  derived and/or modified sequence opt1 from anti-IsdB_5D1Z_Chain-G

SEQ ID NO: 8767 - RNA, 642 nt, Artificial Sequence
  derived and/or modified sequence opt1 from anti-IsdB_5D1Z_HeavyChain
gacauccagaugacccagagccccuccuuccugagcgccuccgugggcgaccgcgucaccaucacgugccgggccagccaggggaucaccaccuaccucggcugguaccagcagcgcccggggaaggcgccccagcugcugaucuacgccgccuccagccuccaguccggcgugccgccccgguucagcggguccggcagcggcaccgaguucacgcugaccaucuccagccugcagcccgaggacuucgccaccuacuacugccagcagcucaacaccuaccccuacacguucgggcccggcacccgccuggagaucaagcggaccguggccgcgcccuccgucuucaucuucccgcccagcgacgagcagcugaaguccgggaccgccagcguggugugccuccugaacaacuucuacccccgcgaggccaagguccaguggaagguggacaacgcccugcaguccggcaacagccaggaguccgugacggagcaggacagcaaggacagcaccuacucccucagcuccacccugacccugagcaaggcggacuacgagaagcacaaggucuacgccugcgaggugacgcaccaggggcucuccagccccgugaccaaguccuucaaccggggcgagugc

SEQ ID NO: 8768 - RNA, 471 nt, Artificial Sequence
  derived and/or modified sequence opt1 from anti-IsdB_5D1Z_Chain-I
ggccccgccaaggccaccaacaacaccuacccgauccugaaccaggagcuccgcgaggcgaucaagaaccccgccaucaaggacaaggaccacagcgcccccaacucccggcccaucgacuucgagaugaagaagaaggacgggacgcagcaguucuaccacuacgccagcuccgugaagccggcccgcgucaucuucaccgacagcaagcccgagaucgagcugggccugcaguccgggcaguucuggcggaaguucgagguguacgagggcgacaagaagcuccccaucaagcuggugagcuacgacaccgucaaggacuacgcguacauccgcuucuccgugagcaacgggaccaaggccgugaagaucgucuccagcacgcacuucaacaacaaggaggagaaguacgacuacacccugauggaguucgcccagcccaucuacaacuccgccgacaaguucaagacc

SEQ ID NO: 8769 - RNA, 324 nt, Artificial Sequence
  derived and/or modified sequence opt1 from anti-HIV_b12_LightChain
gagaucgugcugacccagagccccggcacccucucccugagcccgggggagcgcgccacguucuccugccggagcucccacagcauccgcucccggcgcgucgccugguaccagcacaagcccggccaggcgccccggcuggugauccacggggugagcaaccgcgccuccggcaucagcgaccgguucuccgggagcggcuccggcaccgacuucacccucaccaucacgcgcgucgagcccgaggacuucgcccuguacuacugccagguguacggggccagcuccuacaccuucggccaggggaccaagcuggagcggaag

SEQ ID NO: 8770 - RNA, 381 nt, Artificial Sequence
  derived and/or modified sequence opt1 from anti-HIV_b12_HeavyChain
caggugcagcuggagcagagcggcgccgaggucaagaagcccggggccuccgugaaggugagcugccaggcguccggcuaccgcuucagccacuucaccguccacugggugcggcaggccccggggcagcgcuucgaguggaugggcuggaucaaccccuacaacgggaacaaggaguucuccgccaaguuccaggaccgggugaccuucacggccgacaccagcgccaacaccgcguacauggagcuccgcucccugcggagcgccgacaccgccgucuacuacugcgcccgcgugggcgaguggggcugggacgacucccccuacgacaacuacuacauggacgugugggggaagggcacgaccgucaucgugagcucc

SEQ ID NO: 8771 - RNA, 633 nt, Artificial Sequence
  derived and/or modified sequence opt1 from anti-HIV_2G12_LightChain
guggucaugacccagagccccuccacccugagcgccuccgugggcgacacgaucaccaucacgugccgcgccagccaguccaucgagaccuggcucgcgugguaccagcagaagccggggaaggcccccaagcugcugaucuacaaggccagcacccucaagaccggcgugcccucccgguucagcggguccggcagcgggaccgaguucacccugacgaucuccggccugcaguucgacgacuucgccaccuaccacugccagcacuacgccggcuacagcgcgaccuucgggcagggcacccgcgucgagaucaagcggacgguggccgcccccuccguguucaucuucccgcccagcgacgagcagcucaaguccgggaccgccagcgucgugugccugcugaacaacuucuacccccgcgaggcgaaggugcaguggaaggucgacaacgcccuccaguccggcaacagccaggaguccgugaccgagcaggacagcaaggacagcaccuacucccugagcuccacgcugacccucagcaaggccgacuacgagaagcacaagguguacgccugcgaggucacccaccaggggcuguccagccccgugaccaaguccuucaaccggggc

SEQ ID NO: 8772 - RNA, 672 nt, Artificial Sequence
  derived and/or modified sequence opt1 from anti-HIV_2G12_HeavyChain
gaggugcagcuggucgagagcggcgggggccucgugaaggccgggggcucccugauccugagcugcgggguguccaacuuccgcaucagcgcccacaccaugaacuggguccggcgcgugcccggcggcgggcucgaguggguggcguccaucagcaccuccagcacguaccgggacuacgccgacgccgucaagggccgcuucaccgugucccgggacgaccuggaggacuucguguaccugcagaugcacaagaugcgcgucgaggacaccgccaucuacuacugcgcccggaaggggagcgaccgccucuccgacaacgacccguucgacgcguggggccccgggaccguggugacggucagccccgccuccaccaagggccccagcguguucccgcuggcccccuccagcaaguccaccagcggcgggaccgccgcgcugggcugccucgugaaggacuacuuccccgagcccgucacgguguccuggaacagcggggcccugaccagcggcgugcacaccuucccggccguccugcaguccagcggccucuacucccugagcuccguggugaccguccccagcuccagccuggggacgcagaccuacaucugcaacgugaaccacaagcccuccaacaccaagguggacaagaaggucgagcccaag

SEQ ID NO: 8773 - RNA, 642 nt, Artificial Sequence
  derived and/or modified sequence opt1 from anti-HIV_4E10_LightChain
gagaucgugcugacccagagccccggcacccagucccucagcccgggggagcgggccacgcuguccugccgggccagccaguccgucggcaacaacaagcuggcgugguaccagcagcgccccgggcaggcgccccggcuccugaucuacggcgccagcucccgccccagcgggguggccgaccgguucuccggcagcggcuccgggaccgacuucacccugaccaucagccgccucgagccggaggacuucgccguguacuacugccagcaguacggccagucccugagcacguucgggcagggcaccaaggucgaggugaagcggaccguggccgcccccuccgucuucaucuucccgcccagcgacgagcagcugaaguccgggaccgccagcguggugugccuccugaacaacuucuacccccgcgaggccaagguccaguggaagguggacaacgcgcugcaguccggcaacagccaggagagcgugacggagcaggacuccaaggacagcaccuacucccucagcuccacccugacccugagcaaggccgacuacgagaagcacaaggucuacgccugcgaggugacgcaccagggccucuccagccccgugaccaaguccuucaaccgcggggag

SEQ ID NO: 8774 - RNA, 684 nt, Artificial Sequence
  derived and/or modified sequence opt1 from anti-HIV_4E10_HeavyChain
caggugcagcugguccagagcggcgccgaggugaagcgccccggguccagcgugaccgucuccugcaaggccagcggcggguccuucagcaccuacgcgcucuccugggugcggcaggccccgggccgcgggcuggaguggaugggcggcgugaucccccugcucacgaucaccaacuacgcgccccgguuccaggggcgcaucaccaucaccgccgaccggagcacguccaccgccuaccuggagcugaacagccuccgccccgaggacaccgccgucuacuacugcgcccgggagggcaccacgggguggggcuggcuggggaagccgaucggcgccuucgcccacuggggccaggggacccuggugaccguguccagcgcguccaccaagggccccagcgucuucccccucgcccccuccagcaaguccacgagcgggggcaccgccgcccugggcugccuggugaaggacuacuucccggagcccgugaccgucuccuggaacagcggggcccucaccagcggcgugcacacguuccccgcggugcugcaguccagcgggcuguacucccucagcuccgucgugaccgugcccagcuccagccugggcacccagaccuacaucugcaacgucaaccacaagccguccaacacgaagguggacaagaagguggagcccaag

SEQ ID NO: 8775 - RNA, 312 nt, Artificial Sequence
  derived and/or modified sequence opt1 from anti-HIV_VRC01_LightChain
gagaucgugcugacccagagccccggcacccucucccugagcccgggggagacggccaucaucuccugccgcaccagccaguacggcucccuggccugguaccagcagcggcccgggcaggcgccccgccucgucaucuacagcggcuccacccgggccgccgggauccccgaccgcuucagcggcucccgguggggcccggacuacaaccugaccaucagcaaccuggaguccggggacuucggcguguacuacugccagcaguacgaguucuucgggcagggcacgaaggugcaggucgacaucaagcgc

SEQ ID NO: 8776 - RNA, 363 nt, Artificial Sequence
  derived and/or modified sequence opt1 from anti-HIV_VRC01_HeavyChain
caggugcagcugguccagagcggcgggcagaugaagaagcccggcgaguccaugcgcaucagcugccgggccuccggguacgaguucaucgacugcacccucaacuggauccgccuggccccgggcaagcggcccgaguggaugggguggcugaagccccgcggcggcgcggugaacuacgcccggccccuccaggggcgcgugaccaugacgcgggacgucuacagcgacaccgccuuccuggagcugcgcucccucaccguggacgacaccgccguguacuucugcacgcggggcaagaacugcgacuacaacugggacuucgagcacugggggcgcggcaccccggucaucgugagcucc

SEQ ID NO: 8777 - RNA, 330 nt, Artificial Sequence
  derived and/or modified sequence opt1 from anti-HIV_PG9_LightChain
cagagcgcccugacccagcccgccuccgugagcggcuccccggggcagagcaucaccaucuccugcaacggcacgagcaacgacgucgggggcuacgaguccgugagcugguaccagcagcaccccgggaaggcgcccaagguggucaucuacgacguguccaagcgccccagcggcguguccaaccgguucagcggcuccaagagcgggaacaccgccucccucaccaucagcggccugcaggccgaggacgagggggacuacuacugcaagucccugaccagcacgcgccggcgcgucuucggcaccgggaccaagcucaccgugcug

SEQ ID NO: 8778 - RNA, 408 nt, Artificial Sequence
  derived and/or modified sequence opt1 from anti-HIV_PG9_HeavyChain
cagcgccugguggagagcggcgggggcgucgugcagcccggguccagccuccggcuguccugcgccgccagcggcuucgacuucucccgccaggggaugcacugggugcggcaggcgccgggccagggccuggagugggucgccuucaucaaguacgacgggagcgagaaguaccacgccgacuccguguggggccgccucagcaucucccgggacaacagcaaggacacccuguaccugcagaugaacucccuccgcguggaggacaccgccacguacuucugcguccgggaggccgggggccccgacuaccgcaacggguacaacuacuacgacuucuacgacggcuacuacaacuaccacuacauggacguguggggcaaggggaccaccgugaccgucagcucc

SEQ ID NO: 8779 - RNA, 630 nt, Artificial Sequence
  derived and/or modified sequence opt1 from anti-HIV_VRC07_LightChain
gagaucgugcugacccagagccccggcacccucucccugagcccgggggagacggccaucaucuccugccggaccagccaguacggcucccuggccugguaccagcagcggcccgggcaggcgccccgccucgucaucuacagcggcuccacccgggccgccgggauccccgaccgcuucagcggcucccgguggggcccggacuacacccugacgaucagcaaccuggaguccggggacuucggcguguacuacugccagcaguacgaguucuucgggcagggcaccaaggugcaggucgacaucaagcgcaccguggccgcccccagcguguucaucuucccgcccuccgacgagcagcucaagagcgggaccgcguccgucgugugccugcugaacaacuucuacccccgggaggccaaggugcaguggaaggucgacaacgcccuccagagcggcaacucccaggagagcgugacggagcaggacuccaaggacagcaccuacagccuguccagcacccugacccucuccaaggccgacuacgagaagcacaagguguacgcgugcgaggucacgcaccagggccugcgcagccccgugaccaaguccuucaaccgcggggagugc

SEQ ID NO: 8780 - RNA, 375 nt, Artificial Sequence
  derived and/or modified sequence opt1 from anti-HIV_VRC07_HeavyChain
caggugcagcugguccagagcggcgggcagaugaagaagcccggcgaguccaugcgcaucagcugccgggccuccggguacgaguucaucgacugcacccucaacuggauccgccuggccccgggcaagcggcccgaguggaugggguggcugaagccccgcggcggcgcggugaacuacgcccggccccuccaggggcgcgugaccaugacgcgggacgucuacagcgacaccgccuuccuggagcugcgcucccucaccagcgacgacaccgccguguacuucugcacgcggggcaaguacugcaccgcccgcgacuacuacaacugggacuucgagcacugggggcagggcaccccggugaucgucuccagc

SEQ ID NO: 8781 - RNA, 315 nt, Artificial Sequence
  derived and/or modified sequence opt1 from anti-HIV_3BNC117_LightChain
gacauccagaugacccagagccccuccagccuguccgccagcgugggcgacaccgucacgaucacgugccaggccaacggguaccucaacugguaccagcagcgccggggcaaggcgccgaagcugcugaucuacgacggguccaagcucgagcgcggcgugcccagccgguucuccgggcgccgguggggccaggaguacaaccugaccaucaacaaccugcagcccgaggacaucgccaccuacuucugccagguguacgaguucgucgugcccggcacccgccucgaccugaagcggaccguggccgccccg

SEQ ID NO: 8782 - RNA, 387 nt, Artificial Sequence
  derived and/or modified sequence opt1 from anti-HIV_3BNC117_HeavyChain
caggugcagcugcuccagagcggcgccgccgucaccaagcccggggcguccgugcgcgugagcugcgaggccuccggcuacaacauccgggacuacuucauccacugguggcgccaggccccggggcagggccugcagugggucggguggaucaaccccaagaccggccagcccaacaacccccggcaguuccagggccgcgugagccugacgcggcacgccuccugggacuucgacaccuucagcuucuacauggaccucaaggcccugcgcuccgacgacaccgcgguguacuucugcgcccggcagcgcagcgacuacugggacuucgacgucuggggguccggcacccaggugacggugagcuccgccagcaccaaggggccg

SEQ ID NO: 8783 - RNA, 324 nt, Artificial Sequence
  derived and/or modified sequence opt1 from anti-HIV_10-1074_LightChain
agcuacgugcgcccccuguccgucgcccucggcgagaccgcccggaucagcugcgggcgccaggcgcugggcucccgggccgugcagugguaccagcaccgcccggggcaggcccccauccugcucaucuacaacaaccaggaccggcccagcggcauccccgagcgcuucuccgggaccccggacaucaacuucggcacgcgggccacccugaccaucagcggcguggaggccggggacgaggcggacuacuacugccacaugugggacucccgcagcggcuucuccuggagcuucgggggcgccacccggcugacgguccuc

SEQ ID NO: 8784 - RNA, 396 nt, Artificial Sequence
  derived and/or modified sequence opt1 from anti-HIV_10-1074_HeavyChain
caggugcagcugcaggagagcggccccgggcucgucaagccguccgagacccugagcgugaccugcuccgugagcggcgacuccaugaacaacuacuacuggacguggauccgccagagccccgggaagggccuggaguggaucggguacaucuccgaccgggagagcgccaccuacaaccccucccucaacagccgcgucgugaucucccgggacaccagcaagaaccagcugucccugaagcucaacagcgugacccccgccgacacggcggucuacuacugcgccaccgcccgccggggccagcgcaucuacggcgugguguccuucggggaguucuucuacuacuacagcauggacgucuggggcaaggggaccaccgugacgguguccagc

SEQ ID NO: 8785 - RNA, 633 nt, Artificial Sequence
  derived and/or modified sequence opt1 from anti-HIV_PGT121_LightChain
agcgacaucuccguggcccccggcgagaccgcccgcaucagcugcggggagaagucccugggcagccgggcgguccagugguaccagcaccgcgccgggcaggccccgucccucaucaucuacaacaaccaggaccggcccagcggcauccccgagcgcuucuccgggagccccgacuccccguucggcaccacggccacccugaccaucaccagcguggaggccggcgacgaggcggacuacuacugccacaucugggacucccgggugcccacgaagugggucuucgggggcgggaccacccugaccgugcucggccagcccaaggccgcccccagcgugacgcuguucccgcccuccagcgaggagcugcaggccaacaaggcgacccucgucugccugaucuccgacuucuaccccggggccgugaccguggccuggaaggccgacagcucccccgucaaggccggcguggagaccacgaccccgagcaagcaguccaacaacaaguacgcggccagcagcuaccugucccucacccccgagcaguggaagucccacaagagcuacagcugccaggugacccacgagggcuccacggucgagaagaccguggcccccaccgagugcagc

SEQ ID NO: 8786 - RNA, 705 nt, Artificial Sequence
  derived and/or modified sequence opt1 from anti-HIV_PGT121_HeavyChain
cagaugcagcugcaggagagcggccccgggcucgugaagccguccgagacccugagccugaccugcuccgucagcggcgccuccaucagcgacuccuacuggagcuggauccgccggucccccgggaagggccucgaguggaucggguacgugcacaagagcggcgacacgaacuacucccccagccugaagucccgcgugaaccugagccucgacaccuccaagaaccaggucagccugucccugguggccgcgaccgccgccgacagcggcaaguacuacugcgcccggacccuccacgggcgccggaucuacggcaucguggccuucaacgagugguucacguacuucuacauggacgucugggggaacggcacccaggugaccguguccagcgcgagcaccaaggggcccuccgucuucccgcuggcccccagcuccaagagcacguccggcggcaccgccgcccuggggugccucgugaaggacuacuuccccgagcccgugaccgucagcuggaacuccggcgcgcugaccagcggggugcacacguucccggccgugcugcaguccagcggccucuacucccugagcuccgucgugaccgugcccagcuccagccugggcacccagaccuacaucugcaacgucaaccacaagcccuccaacacgaagguggacaagcgcguggagcccaagagcugc

SEQ ID NO: 8787 - RNA, 657 nt, Artificial Sequence
  derived and/or modified sequence opt1 from anti-HIV_PGDM1400_LightChain
gacuucgugcugacgcagagcccccacucccucagcgucaccccgggcgaguccgccagcaucuccugcaagagcucccacagccugauccacggggaccgcaacaacuaccuggccugguacgugcagaagcccggccggagcccccagcuccugaucuaccuggcgagcucccgcgccagcggggugcccgaccgguucuccggcagcggguccgacaaggacuucacgcucaagaucagccgcgucgagaccgaggacgugggcaccuacuacugcaugcagggccgggaguccccguggaccuucgggcagggcacgaagguggacaucaagcgcaccgucgccgcccccagcguguucaucuucccgcccuccgacgagcagcugaaguccgggaccgccagcguggucugccugcucaacaacuucuacccccgggaggcgaaggugcaguggaagguggacaacgcccugcaguccggcaacagccaggaguccgucaccgagcaggacagcaaggacuccacguacagccuguccagcacccucacccuguccaaggccgacuacgagaagcacaagguguacgccugcgaggugacccaccaggggcugagcucccccgucaccaagagcuucaaccgcggcgagugc

SEQ ID NO: 8788 - RNA, 735 nt, Artificial Sequence
  derived and/or modified sequence opt1 from anti-HIV_PGDM1400_HeavyChain
caggcccagcuggugcagagcggccccgagguccgcaagccggggaccuccgugaaggugagcugcaaggcccccggcaacacccucaagacguacgaccugcacuggguccgguccgugcccgggcagggccugcaguggaugggguggaucagccacgagggcgacaagaaggugaucgucgagcgcuucaaggcgaaggugaccaucgacugggaccgguccaccaacaccgccuaccuccagcugagcggccugacguccggggacaccgccguguacuacugcgccaagggcagcaagcaccgccuccgggacuacgcccuguacgacgacgacggggcgcugaacugggccgucgacguggacuaccucuccaaccuggaguucuggggccaggggaccgccgugaccgucagcuccgccagcacgaagggccccuccguguucccgcuggcgcccagcuccaagagcaccuccggcgggaccgccgcccucggcugccuggugaaggacuacuuccccgagcccgucaccgugagcuggaacuccggggcccugacgagcggcgugcacaccuucccggccguccuccagagcuccggccuguacagccuguccagcguggugaccguccccuccagcucccucgggacccagacguacaucugcaacgugaaccacaagcccagcaacaccaagguggacaagaaggucgagcccaaguccugcgac

SEQ ID NO: 8789 - RNA, 630 nt, Artificial Sequence
  derived and/or modified sequence opt1 from anti-HIV_N6_LightChain
uacauccacgugacccagagccccuccagccuguccgucagcaucggcgaccgggugaccaucaacugccagacgucccagggggugggcagcgaccuccacugguaccagcacaagccggggcgggcccccaagcugcugauccaccacaccuccagcgucgaggacggcgugcccucccgcuucagcggguccggcuuccacaccagcuucaaccucaccaucuccgaccugcaggccgacgacaucgcgacguacuacugccaggugcugcaguucuucggccgggggagccgccuccacaucaagcggaccgucgccgcccccuccguguucaucuucccgcccagcgacgagcagcugaaguccggcaccgccagcguggucugccugcucaacaacuucuacccccgcgaggccaaggugcaguggaagguggacaacgcgcugcaguccgggaacagccaggagagcgucaccgagcaggacuccaaggacagcacguacucccugagcuccacccucacccugagcaaggccgacuacgagaagcacaagguguacgccugcgaggugacccaccagggccuguccagccccgucacgaaguccuucaaccgcggggagugc

SEQ ID NO: 8790 - RNA, 675 nt, Artificial Sequence
  derived and/or modified sequence opt1 from anti-HIV_N6_HeavyChain
cgcgcccaccuggugcagagcggcaccgccaugaagaagcccggggcguccguccgggugagcugccagaccuccggcuacacguucaccgcccacauccucuucugguuccgccaggccccggggcggggccuggagugggugggguggaucaagccccaguacggcgccgucaacuucggcgggggcuuccgcgaccgggugacccugacccgcgacguguaccgggagaucgccuacauggacauccgcgggcucaagcccgacgacacggcggucuacuacugcgcccgggaccgcagcuacggcgacuccagcugggcccuggacgccugggggcagggcaccaccgugguggucuccgcggccagcaccaagggccccuccguguucccgcuggcccccagcuccaagagcacguccgggggcaccgccgcccucgggugccuggugaaggacuacuuccccgagcccgucaccgugagcuggaacuccggcgcgcugaccagcggcgugcacacguucccggccguccuccaguccagcgggcuguacucccugagcagcguggugaccguccccuccagcucccucggcacccagaccuacaucugcaacgugaaccacaagcccagcaacacgaagguggacaagaaggucgagcccaaguccugc

SEQ ID NO: 8791 - RNA, 1080 nt, Artificial Sequence
  derived and/or modified sequence opt1 from anti-HIV_N6_GChain
gccugggaggacgccgacaccacccuguucugcgcgagcgacgccaaggccuacuccacggagaagcacaacgugugggccacccacgccugcguccccaccgaccccgacccccaggagaucccccucgagaacgugaccgagaacuucaacauguggaagaacaacaugguggagcagaugcacgaggacaucaucagccugugggacgagucccugaagcccugcgucaugcucacgggcgggagcaccaucaagcaggcgugcccgaaggugaccuucgagcccauccccauccacuacugcgcccccgccggcuucgccauccugaagugccgcgacgaggacuucaacgggaccggcccgugcaagaacguguccacgguccagugcacccacgggaucaagcccguggugagcacccagcugcuccugaacggcucccuggcgaagggcgacaucgucauccggagcgagaaccucaccaacaacgccaaggugaucaucgugcagcugaacgagcccguccagaucgugugcauccgccccaacaacgggggcuccgggagcggcggggacauccggcaggcccacugcaacgugacgcgcggcaagugggucaacaucaccaagaacgugaaggagcagcuguggaagaucuucaacaagaccaccaacaucacguucaacaacaccaucuucaacuccccggccggcggggaccucgagaucaccacccacagcuucaacugcggcggggaguucuucuacugcaacacguccgaccuguucaacgagaccaaccugagcgccaaccacaccgacaccaacgagaacaucacgcuccagugccggaucaagcagaucgugcgcauguggcagcgggucggccaggcgauguacgccccgcccaucgccggcaacaucacgugcaucuccaacaucaccgggcugcugcucacccgcgacggcgugaacgacacccacgacaaggagaacgagaccuuccggcccaccgggggcgacaugcgcgacaacuggcggagcgagcuguacaaguacaaggugaucaagcugaag

SEQ ID NO: 8792 - RNA, 645 nt, Artificial Sequence
  derived and/or modified sequence opt1 from anti-HIV_10E8_LightChain
agcuacgagcugacccaggagaccggcguguccgucgcccucgggcgcacggugaccaucacgugccggggcgacagccugcgcucccacuacgccagcugguaccagaagaagcccgggcaggcgccgauccuccuguucuacggcaagaacaaccggcccuccggggugcccgaccgcuucagcggcuccgccagcggcaaccgggccucccugaccaucagcggggcccaggccgaggacgacgcggaguacuacugcuccagccgcgacaaguccggcagccggcuguccgucuucgggggcgggaccaagcucaccgugcugagccagcccaaggccgccccguccgugacccuguucccgcccagcuccgaggagcuccaggccaacaaggcgacccuggucugccugaucagcgacuucuaccccggcgccgugacgguggccuggaaggccgacagcucccccgucaaggccggcguggagaccaccacccccagcaagcaguccaacaacaaguacgcggccagcuccuaccucagccugacgcccgagcaguggaagucccaccgcagcuacuccugccaggugacccacgaggggagcaccgucgagaagaccguggcccccacggagugcucc

SEQ ID NO: 8793 - RNA, 708 nt, Artificial Sequence
  derived and/or modified sequence opt1 from anti-HIV_10E8_HeavyChain
gaggugcagcuggucgagagcggcgggggccucgugaagcccgggggcucccugcgccugagcugcuccgccagcggguucgacuucgacaacgccuggaugaccugggugcggcagccgcccggcaagggccucgagugggucgggcgcaucaccggccccggggagggcugguccguggacuacgcggcccccguggaggggcgguucacgaucagccgccugaacuccaucaacuuccuguaccucgagaugaacaaccugcggauggaggacagcggccuguacuucugcgcccgcaccggcaaguacuacgacuucugguccggguacccgcccggcgaggaguacuuccaggacugggggcggggcacccucgucaccgugagcuccgccagcacgaagggccccuccguguucccccuggccccgagcuccaagagcaccuccgggggcaccgcggcccuggggugccucgucaaggacuacuuccccgagcccgugaccgugagcuggaacuccggcgcccugacgagcgggguccacaccuuccccgccgugcugcagagcuccggccucuacagccuguccagcguggucaccgugccguccagcucccugggcacccagacguacaucugcaacgugaaccacaagcccagcaacaccaaggucgacaagcgcguggagcccaaguccugcgacaag

SEQ ID NO: 8794 - RNA, 333 nt, Artificial Sequence
  derived and/or modified sequence opt1 from anti-HIV_12A12_LightChain
gacauccagaugacccagagccccuccagccuguccgccagcgugggcgaccgcgucaccaucacgugccaggccgggcagggcaucggguccagccuccagugguaccagcagaagccgggcaaggcgcccaagcugcuggugcacggggccuccaaccuccaccggggcgugcccagccgcuucuccggcagcggguuccacaccaccuucucccugaccaucagcggccugcagcgggacgacuucgccacguacuucugcgccguccucgaguucuucgggcccggcaccaagguggagaucaagcgcaccguggccgcgccguccguc

SEQ ID NO: 8795 - RNA, 381 nt, Artificial Sequence
  derived and/or modified sequence opt1 from anti-HIV_12A12_HeavyChain
agccagcaccuggugcaguccggcacccaggucaagaagcccggggccagcgugcgcaucuccugccaggccagcggcuacuccuucaccgacuacgugcuccacugguggcggcaggcgccggggcagggccuggaguggaugggguggaucaagcccgucuacggcgcccgcaacuacgcccggcgcuuccagggccggaucaacuucgaccgcgacaucuaccgggagaucgccuucauggaccugagcgggcuccgcuccgacgacacggcccuguacuucugcgcgcgggacggcagcggggacgacaccuccuggcaccuggaccccuggggccaggggacccucgugaucgugagcgccgccuccaccaagggc

SEQ ID NO: 8796 - RNA, 315 nt, Artificial Sequence
  derived and/or modified sequence opt1 from anti-HIV_12A21_LightChain
gacauccagaugacccagagccccuccagccuguccgccagcgugggcgaccgcgucaccaucaacugccaggccgggcagggcaucggguccagccucaacugguaccagaagaagccgggccgggcgcccaagcugcuggugcacggggccuccaaccuccagcgcggcgugcccagccgguucuccggcagcggguuccacacgaccuucacccugaccaucuccagccugcagcccgacgacgucgccacguacuucugcgccguguuccagugguucggcccggggaccaagguggacaucaagcgcacc

SEQ ID NO: 8797 - RNA, 384 nt, Artificial Sequence
  derived and/or modified sequence opt1 from anti-HIV_12A21_HeavyChain
agccagcaccuggugcaguccggcacccaggucaagaagcccggggccagcgugcgcguguccugccaggccagcggcuacaccuucacgaacuacauccugcacugguggcggcaggcgccggggcagggccuggaguggauggggcugaucaagcccgucuucggcgccgugaacuacgcccgccaguuccagggccggauccagcucacccgcgacaucuaccgggagaucgccuuccuggaccuguccgggcuccgcagcgacgacaccgccguguacuacugcgcgcgggacgaguccggcgacgaccugaaguggcaccuccaccccugggggcagggcacccaggucaucgugagccccgccuccacgaaggggccg

SEQ ID NO: 8798 - RNA, 648 nt, Artificial Sequence
  derived and/or modified sequence opt1 from anti-HIV_35022_LightChain
cagagcgugcugacccaguccgccagcgucuccggcagccucgggcaguccgugaccaucagcugcacgggccccaacuccgugugcugcagccacaaguccaucagcugguaccaguggccgcccgggcgcgcccccacccugaucaucuacgaggacaacgagcgggcgcccggcaucuccccgcgcuucagcggguacaaguccuacuggagcgccuaccugaccaucuccgaccuccggcccgaggacgagaccacguacuacugcugcagcuacacccacaacuccggcugcgucuucggcaccgggaccaaggugagcgugcugggccaguccaaggccaaccccagcgucacgcuguucccgcccagcuccgaggagcuccaggccaacaaggccacccuggugugccugaucagcgacuucuaccccggggcggugaccgucgccuggaaggccgacuccagccccgugaaggccggcguggagaccacgacccccuccaagcagagcaacaacaaguacgcggccuccagcuaccucucccugaccccggagcaguggaagucccaccgcagcuacagcugccaggucacccacgagggguccacgguggagaagaccguggcccccaccgagugcagc

SEQ ID NO: 8799 - RNA, 729 nt, Artificial Sequence
  derived and/or modified sequence opt1 from anti-HIV_35022_HeavyChain
gagggccagcuggugcagagcggggccgagcucaagaagcccggcgccuccgugaagaucagcugcaagaccuccggguaccgcuucaacuucuaccacaucaacuggauccggcagaccgcgggccgcgggccggaguggaugggcuggaucagccccuacuccggcgacaagaaccuggcccccgccuuccaggaccgggugaucaugacgaccgacaccgaggugcccgucaccagcuucacguccaccggggccgccuacauggagauccgcaaccugaaguucgacgacaccggcaccuacuucugcgcgaaggggcuccugcgggacggcagcuccacguggcugccguaccucugggggcagggcacccugcugaccgugagcuccgccagcaccaagggccccuccguguucccccucgcccccagcuccaagagcacguccgggggcaccgccgcgcuggggugccuggucaaggacuacuucccggagcccgugaccgugagcuggaacuccggcgcccucaccagcggcguccacacguuccccgccgugcugcagagcuccgggcuguacagccucuccagcguggucaccgugcccuccagcucccugggcacccagaccuacaucugcaacgugaaccacaagccgagcaacacgaaggucgacaagcgcguggagcccaaguccugcgacaaggggcuggagguccucuuccag

SEQ ID NO: 8800 - RNA, 648 nt, Artificial Sequence
  derived and/or modified sequence opt1 from anti-HIV_3BC176_LightChain
cagagcgugcugacccagcccgccuccgucagcgccuccccgggccagagcaucaccguguccugcacggggagccgcaacgacgugggcggguacgacuucgucuccugguaccagcggcaccccggcggggugcccaagcucaucaucuacgagaucagcaagcgccccuccggcaucccgcagcgguucagcggcucccgcagcgggaacaccgcgucccugaccaucagcggccugcaggacgacgacgaggccgacuacuacugcugcuccuacgccagcuacgaccggcucaucuucgggggcgggacccgcguguccguccugcggcagcccaaggccgcccccagcgugacgcuguucccgcccuccagcgaggagcuccaggcgaacaaggccacccuggugugccugaucagcgacuucuaccccggcgccgucaccguggccuggaaggcggacggcucccccgugaaggccggggucgagaccacgaagcccagcaagcaguccaacaacaaguacgccgccagcuccuaccucagccugaccccggagcaguggaagucccaccgcagcuacuccugccaggugacccacgagggcagcaccguggagaagacggucgcccccaccgagugcucc

SEQ ID NO: 8801 - RNA, 699 nt, Artificial Sequence
  derived and/or modified sequence opt1 from anti-HIV_3BC176_HeavyChain
gagcagguccagcugaugcagagcggcgcccagcuccgcgaccccggggacucccugaagaucagcugcaaggccuccggcuacaacuucaucgacuaccacauccacugggugcggcuggcgccggggcgcggccucgaguggaugggguggaucgaccccgugggcggcaucaccaaguacgccgggcaguuccagggccggcugagccugacccgcgacacguccaccaacacccucuuccuggagcugagccggcucaccgccggggacacggccguguacuucugcgcccgcuccaugcggcccgucgaccacggcaucgacuacagcgggcuguucguguuccacuucuggggccgcggcuccgacgugcuggucagcuccgcgagcaccaaggggcccuccguguucccgcucgcccccagcuccaagagcaccuccggcgggaccgccgcccugggcugccuggugaaggacuacuuccccgagcccgucacggugagcuggaacuccggcgcgcucaccagcggggugcacaccuucccggccguccugcagagcuccggccuguacagccucuccagcguggugaccguccccuccagcucccuggggacgcagaccuacaucugcaacgugaaccacaagcccagcaacaccaagguggacaagaaggucgagcccaaguccugcgac

SEQ ID NO: 8802 - RNA, 621 nt, Artificial Sequence
  derived and/or modified sequence opt1 from anti-HIV_3BNC55_LightChain
gacauccagaugacccagagccccuccagccuguccgccagcgugggcgacaaggucaccaucacgugccagaccuccgccggguaccucaacugguaccagcagcgccggggccgcgcgccgaagcugcugauguacgacgggagccggcucgugaccggcgugcccucccgcuucagcgggcggcgcuggggcacccaguacaaccugacgaucggcucccugcagcccgaggacaucgccaccuacuacugccaggucuacgaguucuucgggcccggcacccggcucgaccugaagcgcaccguggccgccccgagcguguucaucuucccgcccuccgacgagcagcucaagagcgggacggccuccgucgugugccugcugaacaacuucuacccccgggaggcgaaggugcaguggaaggucgacaacgcccugcagagcggcaacucccaggagagcgugaccgagcaggacuccaaggacagcaccuacucccucagcagcacccugacgcuguccaaggccgacuacgagaagcacaagguguacgccugcgaggucacccaccaggggcucagcucccccgugaccaagagcuucaaccgcggcgagugc

SEQ ID NO: 8803 - RNA, 675 nt, Artificial Sequence
  derived and/or modified sequence opt1 from anti-HIV_3BNC55_HeavyChain
caggugcagcugguccagagcggcaccgccgugaagcgccccggggccuccgugcgggucagcugccaggcguccggcuacaccuucacggacuacuucaucuacugguggcgccaggccccggggcagggccucgaguggcugggguggaucaacccccugaccagccagcccuccuaccccagccgguuccagggccgccucacccugacccgggacacguucgacgagaugcuguacauggaccuccgcggccugcgguccgacgacaccgggaucuacuucugcgcccgccggcacagcgacuacugcgacuucgacaucuggggcuccgggacccagaucaucgugagcuccgccagcaccaagggcccguccguguucccccuggcccccagcuccaagagcacguccgggggcaccgcggcccucggcugccuggucaaggacuacuuccccgagccggugaccgugagcuggaacuccggggcccugaccagcggcguccacacguuccccgccgugcuccagagcuccgggcuguacagccuguccagcguggucaccgugcccuccagcucccucggcacccagaccuacaucugcaacgugaaccacaagcccagcaacacgaaggucgacaagcgcguggagccgaaguccugcgacaagacc

SEQ ID NO: 8804 - RNA, 618 nt, Artificial Sequence
  derived and/or modified sequence opt1 from anti-HIV_3BNC60_LightChain
gacauccagaugacccagagccccuccagccuguccgcccgcgugggcgacaccgucacgaucacgugccaggccaacggguaccucaacugguaccagcagcggcgcggcaaggcgccgaagcugcugaucuacgacgggagcaagcucgagcggggcgugcccgcccgcuucuccgggcggcgcuggggccaggaguacaaccugaccaucaacaaccugcagcccgaggacguggccaccuacuucugccaggucuacgaguucaucgugcccggcacgcggcucgaccugaagcgcaccguggccgccccgagcgucuucaucuucccgcccuccgacgagcagcucaagagcgggaccgcguccguggugugccugcugaacaacuucuacccccgggaggccaagguccaguggaagguggacaacgcccugcagagcggcaacucccaggagagcgugaccgagcaggacuccaaggacagcacguacucccucagcuccacccugacccugagcaaggccgacuacgagaagcacaaggucuacgcgugcgaggugacccaccaggggcucuccagccccgugaccaagagcuucaaccgcggcgagugc

SEQ ID NO: 8805 - RNA, 687 nt, Artificial Sequence
  derived and/or modified sequence opt1 from anti-HIV_3BNC60_HeavyChain
caggugcaccugagccaguccggcgccgccgucaccaagcccggggcgagcgugcgcguguccugcgaggccagcggcuacaagaucuccgaccacuucauccacugguggcggcaggccccggggcagggccuccagugggucggguggaucaaccccaagaccggccagcccaacaacccccgccaguuccagggccgggugagccugacgcgccaggccuccugggacuucgacaccuacagcuucuacauggaccugaaggccgugcgguccgacgacaccgcgaucuacuucugcgcccgccagcggagcgacuucugggacuucgacgucuggggguccggcacccaggugacggugagcuccgccagcaccaaggggccguccgucuucccccucgcccccagcuccaagagcaccuccggcgggaccgcggcccugggcugccuggugaaggacuacuuccccgagccggugacggucagcuggaacagcggcgcccucaccuccggggugcacaccuuccccgccgugcugcagagcuccggccuguacagccucuccagcgucgugaccgugcccuccagcucccuggggacgcagaccuacaucugcaacgucaaccacaagcccagcaacaccaagguggacaagcgcguggagccgaaguccugcgacaagacc

SEQ ID NO: 8806 - RNA, 687 nt, Artificial Sequence
  derived and/or modified sequence opt1 from anti-HIV_3BNC60_HeavyChain
gaggugcaccugagccaguccggcgccgccgucaccaagcccggggcgagcgugcgcguguccugcgaggccagcggcuacaagaucuccgaccacuucauccacugguggcggcaggccccggggcagggccuccagugggucggguggaucaaccccaagaccggccagcccaacaacgcccgccaguuccagggccgggugagccugacgcgccaggccuccugggacuucgacaccuacagcuucuacauggaccugaaggcggugcgguccgacgacaccgccaucuacuucugcgcccgccagcggagcgacuucugggacuucgacgucuggggguccggcacccaggugacggugagcuccgccagcaccaaggggcccuccgucuucccgcucgcgcccagcuccaagagcaccuccggcgggaccgccgcccugggcugccuggugaaggacuacuuccccgagcccgugacggucagcuggaacagcggcgcccucaccuccggggugcacaccuucccggccgugcugcagagcuccggccuguacagccucuccagcgucgugaccgugcccuccagcucccuggggacgcagaccuacaucugcaacgucaaccacaagcccagcaacaccaagguggacaagcgcguggagcccaaguccugcgacaagacc

SEQ ID NO: 8807 - RNA, 648 nt, Artificial Sequence
  derived and/or modified sequence opt1 from anti-HIV_447-52D_LightChain
cagagcgugcugacccagcccccguccgucagcgccgcccccggccagaaggugaccaucuccugcagcggguccagcuccaacaucggcaacaacuacgugcucugguaccagcaguuccccgggacggcgcccaagcugcugaucuacggcaacaacaagcgcccgagcgggauccccgaccgguucuccggcagcaaguccggcaccagcgccacccucgggaucaccggccugcagacgggggacgaggccgacuacuucugcgccaccugggacuccggccugagcgccgacugggucuucgggggcggcaccaagcucaccgugcugucccagcccaaggcggcccccagcgugacgcuguucccgcccuccagcgaggagcuccaggccaacaaggccacccuggucugccugaucuccgacuucuaccccggggcggugaccguggccuggaaggccgacagcagccccgucaaggccggcguggagaccacgaccccguccaagcagagcaacaacaaguacgccgcguccagcuaccucucccugacccccgagcaguggaagucccaccgcagcuacagcugccaggugacccacgagggguccacggucgagaagaccguggcccccaccgagugc

SEQ ID NO: 8808 - RNA, 693 nt, Artificial Sequence
  derived and/or modified sequence opt1 from anti-HIV_447-52D_HeavyChain
gaggugcagcuggucgagagcggcgggggccucgugaagcccgggggcucccugcgccugaccugcguggccagcggguucaccuucuccgacgucuggcucaacugggugcggcaggccccgggcaagggccuggaguggguggggcgcaucaagagccggaccgacggcgggaccaccgacuacgcggccuccgucaagggccgcuucaccaucagccgggacgacuccaagaacacgcuguaccuccagaugaacagccugaagaccgaggacaccgccguguacuccugcaccacggacggguucaucaugauccgcggcgugagcgaggacuacuacuacuacuacauggacgucuggggcaaggggaccaccgugaccguguccagcgccuccacgaagggccccagcgucuucccccuggcccccugcucccggagcaccuccgggggcaccgcggcccucggcugccuggugaaggacuacuucccggagcccgugaccgucagcuggaacuccggggcccugacgagcggcgugcacaccuuccccgccgugcuccagagcuccgggcuguacagccuguccagcgucgugaccgugcccuccagcucccucggcacccagacguacacgugcaacgucaaccacaagccgagcaacaccaagguggacaagcgcguggagcug

SEQ ID NO: 8809 - RNA, 645 nt, Artificial Sequence
  derived and/or modified sequence opt1 from anti-HIV_447-52D_LightChain
cagagcgugcugacccagcccccguccgucagcgccgcccccggccagaaggugaccaucuccugcagcggguccagcuccaacaucggcaacaacuacgugcucugguaccagcaguuccccgggacggcgcccaagcugcugaucuacggcaacaacaagcgcccgagcgggauccccgaccgguucuccggcagcaaguccggcaccagcgccacccucgggaucaccggccugcagacgggggacgaggccgacuacuucugcgccaccugggacuccggccugagcgccgacugggucuucgggggcggcaccaagcucaccgugcugucccagcccaaggcggcccccagcgugacgcuguucccgcccuccagcgaggagcuccaggccaacaaggccacccuggucugccugaucuccgacuucuaccccggggcggugaccguggccuggaaggccgacagcagccccgucaaggccggcguggagaccacgaccccguccaagcagagcaacaacaaguacgccgcguccagcuaccucucccugacccccgagcaguggaagucccaccgcagcuacagcugccaggugacccacgagggguccacggucgagaagaccguggcccccaccgag

SEQ ID NO: 8810 - RNA, 705 nt, Artificial Sequence
  derived and/or modified sequence opt1 from anti-HIV_447-52D_HeavyChain
gaggugcagcuggucgagagcggcgggggccucgugaagcccgggggcucccugcgccugaccugcguggccagcggguucaccuucuccgacgucuggcucaacugggugcggcaggccccgggcaagggccuggaguggguggggcgcaucaagagccggacggacggcgggaccaccgacuacgcggccuccgucaagggccgcuucaccaucagccgggacgacuccaagaacacgcuguaccuccagaugaacagccugaagaccgaggacaccgccguguacuccugcaccacggacggguucaucaugauccgcggcgugagcgaggacuacuacuacuacuacauggacgucuggggcaaggggaccaccgugaccguguccagcgccuccacgaagggccccagcgucuucccccuggcccccugcucccggagcaccuccgggggcaccgcggcccucggcugccuggugaaggacuacuucccggagcccgugaccgucagcuggaacuccggggcccugacgagcggcgugcacaccuuccccgccgugcuccagagcuccgggcuguacagccuguccagcgucgugaccgugcccuccagcucccucggcacccagacguacacgugcaacgucaaccacaagccgagcaacaccaagguggacaagcgcguggagcugaagacccccacc

SEQ ID NO: 8811 - RNA, 624 nt, Artificial Sequence
  derived and/or modified sequence opt1 from anti-HIV_5H/I1-BMV-D5_LightChain
gacauccagaugacccagagccccuccacccugagcgccuccaucggcgaccgcgugacgaucacgugccgggccagcgaggggaucuaccacuggcucgcgugguaccagcagaagccgggcaaggcccccaagcugcugaucuacaaggccuccagccucgccuccggggcccccagccgcuucuccggcagcggguccggcaccgacuucacccugaccaucagcucccugcagcccgacgacuucgcgaccuacuacugccagcaguacagcaacuacccgcucaccuucggcgggggcaccaagcuggagaucaagcggacggucgccgcccccuccguguucaucuucccgcccagcgacgagcagcugaaguccgggaccgccagcguggucugccuccugaacaacuucuacccccgcgaggcgaaggugcaguggaagguggacaacgcccugcaguccggcaacagccaggagagcgucaccgagcaggacuccaaggacagcaccuacucccucagcuccacgcugacccugagcaaggccgacuacgagaagcacaagguguacgccugcgaggugacccaccaggggcucuccagccccgucaccaagucc

SEQ ID NO: 8812 - RNA, 651 nt, Artificial Sequence
  derived and/or modified sequence opt1 from anti-HIV_5H/I1-BMV-D5_HeavyChain
caggugcagcugguccagagcggcgccgaggugcgcaagcccggggccuccgugaaggucagcugcaaggcguccggcgacaccuucagcuccuacgccaucagcugggugcggcaggccccggggcagggccucgaguggaugggcgggaucauccccaucuucggcaccgccaacuacgcccaggcguuccaggggcgcgugacgaucaccgccaacgaguccaccagcaccgccuacauggagcuguccagccugcgguccgaggacacggccaucuacuacugcgcgcgcgacaaccccacccuccugggcagcgacuacuggggcgccgggacccuggucaccguguccagcgccuccacgaaggggcccagcguguucccgcucgcccccugcucccggagcaccuccggcggcaccgccgcgcuggggugccuggucaaggacuacuuccccgagcccgugaccgugagcuggaacagcggcgcccucacguccgggguccacaccuucccggccgugcugcagagcuccggccuguacagccucuccagcguggucaccgugcccuccagcucccugggcacccagacguacaucugcaacgugaaccacaagcccagcaacaccaaggucgacaagcgcgug

SEQ ID NO: 8813 - RNA, 657 nt, Artificial Sequence
  derived and/or modified sequence opt1 from anti-HIV_5H/I1-BMV-D5_A-Chain
augcagcugcucagcggcaucgugcagcagcagaacaaccugcugcgcgcgaucgaggcccagcagcaccuccugcagcugaccgucugggggaucaagcagcuccaggcgcggauccuggccggcggguccggcgggcacaccacguggauggagugggaccgcgagaucaacaacuacaccagccugauccacucccucaucgaggagagccagaaccagcaggagaagaacgagcaggagcugcuggagggcuccagcggcgggcagcuccuguccggcaucgugcagcagcagaacaaccugcuccgggccaucgaggcccagcagcaccuccugcagcugaccgugugggggaucaagcagcugcaggcccgcauccuggcgggcgggagcggcggccacaccacguggauggagugggaccgggagaucaacaacuacaccucccucauccacagccugaucgaggagucccagaaccagcaggagaagaacgagcaggagcugcucgaggggagcuccggcgggcagcugcugagcggcaucguccagcagcagaacaaccuccugcgcgccaucgaggcccagcagcaccuccugcagcugaccguguggggcaucaagcagcugcaggcccggauccucgccgggggc

SEQ ID NO: 8814 - RNA, 390 nt, Artificial Sequence
  derived and/or modified sequence opt1 from anti-HIV_8ANC195_LightChain
gacauccagaugacccagagccccuccacccugagcgccuccaucggcgacacggugcgcaucagcugccgggccucccagagcaucaccgggaacugggucgcgugguaccagcagcgccccggcaaggcgccccggcuccugaucuaccgcggggccgcccugcucggcggggugcccucccgguucagcggcuccgccgccggcaccgacuucacccugacgaucgggaaccugcaggccgaggacuucggcaccuucuacugccagcaguacgacaccuaccccgggaccuucggccaggggacgaagguggaggucaagcgcaccguggccgccccgagcguguucaucuucccgcccuccgacgagcagcucaagagcggcacc

SEQ ID NO: 8815 - RNA, 423 nt, Artificial Sequence
  derived and/or modified sequence opt1 from anti-HIV_8ANC195_HeavyChain
cagauccaccuggugcagagcggcaccgaggucaagaagcccggguccagcgugaccguguccugcaaggccuacggcgucaacacguucgggcucuacgccgugaacugggugcgccaggcgcccggccagagccuggaguacaucgggcagaucuggcgguggaaguccagcgccucccaccacuuccgcggccggguccugaucagcgccguggaccucaccggcuccagcccgcccaucuccagccuggagaucaagaaccugaccuccgacgacaccgccguguacuucugcacgaccaccagcaccuacgacaagugguccgggcuccaccacgacggcgucauggccuucagcuccugggggcagggcacgcugaucagcguguccgcggccagcaccaaggggcccagcguguuc

SEQ ID NO: 8816 - RNA, 333 nt, Artificial Sequence
  derived and/or modified sequence opt1 from anti-HIV_CAP256-VRC26.01_LightChain
cagagcgugcugacccagcccccguccgucagcgccgcccccggccagaaggugaccaucuccugcagcggguccagcuccacgaucggcaacaacuacgugagcugguaccgccuccugcccgggaccgcgcccaagcugcucaucuacaagaacgacaaccggccguccggcauccccgaccgcuucagcggguccaagagcggcaccuccgccacccugggcaucagcgggcugcagacgggcgacgaggccgacuacuacugcgggaccugggacaccucccucagcggcgggggcgucuucggcaccgggacgaaggugaccgugcug

SEQ ID NO: 8817 - RNA, 432 nt, Artificial Sequence
  derived and/or modified sequence opt1 from anti-HIV_CAP256-VRC26.01_HeavyChain
gaggugcaggucguggagagcggcgggggcgugguccagcccgggcgcucccugcggcucagcugcaccgccuccggcuucaccuucagcaacuucgccauggggugggugcgccaggcgccgggcaagggccuggaguggguggccuucaucuccagcgacggguccaacaagaacuacggcgacagcgucaaggggcgguucacgaucucccgcgacaacagcaagaacaccguguuccugcagaugaacucccuccggguggaggacaccgcccuguacuacugcgccaaggacgucggcgacuacaagagcgacgagugggggaccgaguacuacgacaucuccaucagcuaccccauccaggacccccgcgccauggugggcgcguucgaccuguggggccaggggacgauggugaccgucuccccc

SEQ ID NO: 8818 - RNA, 324 nt, Artificial Sequence
  derived and/or modified sequence opt1 from anti-HIV_CAP256-VRC26.02_LightChain
cagagcgugcugacccagcccccguccgucagcgccgcccccggccagaaggugaccaucuccugcagcggguccaacagcaacaucggcaacaaggacguguccugguaccagcagauccccgcgacggcccccaagcuccugaucuacgagaacaacaagcgcccgagcgggaucuccgaccgguucagcggcuccaagagcgggaccuccgccacccuggccaucaccggccuccagacgggcgacgaggccgacuacuacugcgcgaccugggacgggcgcgucagcgugaucggcaccgggaccaacgugaucguccug

SEQ ID NO: 8819 - RNA, 432 nt, Artificial Sequence
  derived and/or modified sequence opt1 from anti-HIV_CAP256-VRC26.02_HeavyChain
gaggugcagcuggucgagagcggcgggggcguggugcagcccgggcgcucccuccggcugagcugcgccgccucccaguucagcuucggcaacuacgggaugcacuggguccgccaggcgccgggcaagggccuggaguggguggccgccaucuccuucgccgggaccaagaccaacuacgccgacagcgugaagggccgguucacgaucucccgcgacaacagcaagaacaccgucuaccuccagaugaacucccugcgggcggaggacaccgcccuguacuucugcgccaaggacauccgcgaguacgagugcgaguacuggaccagcgacuacuacgacuucgggcggccccagcccugcaucgacucccgcggcgugguggggacguucgacgucuggggccagggcaccauggugaccgugagcucc

SEQ ID NO: 8820 - RNA, 333 nt, Artificial Sequence
  derived and/or modified sequence opt1 from anti-HIV_CAP256-VRC26.03_LightChain
cagagcgugcugacccagcccccguccgucagcgccgcccccggccagaaggugaccaucuccugcagcggguccagcuccaacaucggcaacaacuucgugagcugguaccagcagcgccccgggacggcgcccaagauccucaucuacgagaacaacaagcggccguccgagacccccgaccgcuucagcggcuccaagagcgggaccuccgccacccuggccaucacgggccugcagaccgccgacgaggccgaguacuacugcgcgaccuggagcgccucccucagcuccgcccgggucuucggcaccgggacgcgcaucaccgugcug

SEQ ID NO: 8821 - RNA, 432 nt, Artificial Sequence
  derived and/or modified sequence opt1 from anti-HIV_CAP256-VRC26.03_HeavyChain
gaggugcagcuggucgagagcggcgggggcguggugcagcccgggaagucccuccggcugagcugcgccgccucccgguucagcuucaaccgcuacggcaugcacuggguccggcaggcgccggggaagggccuggaguggguggccgccaucuccuacgacggcaccgacaaguaccacgccgacaaggugugggggcgcuucaccaucagccgggacaacuccaagaacacgcucuaccugcagaugaacagccugcgcgccgaggacaccgcgcucuacuacugcgccaaggaccugcgggaggacgagugcgaggaguggugguccgacuacuacgacuucggcaagcagcugcccugccgcaagagccgcggggucgccggcaucuucgacggguggggccagggcaccauggugaccguguccagc

SEQ ID NO: 8822 - RNA, 333 nt, Artificial Sequence
  derived and/or modified sequence opt1 from anti-HIV_CAP256-VRC26.04_LightChain
cagcccgugcugacccagccgcccagcgucuccgccgcccccggccagaaggugaccaucagcugcuccgggagcuccagcaacaucggcaacaacuucguguccugguaccagcagcgccccgggacggcgccgagccuccugaucuacgagaccaacaagcggcccuccggcauccccgaccgcuucagcggguccaagagcgccaccuccgccacccuggccaucacgggccuccagaccggcgacgaggccgacuacuacugcgcgaccugggccgccagccugaccuccgcccgggucuucgggacgggcaccaaggugaucgugagc

SEQ ID NO: 8823 - RNA, 432 nt, Artificial Sequence
  derived and/or modified sequence opt1 from anti-HIV_CAP256-VRC26.04_HeavyChain
gaggugcagcuggucgagagcggcgggggcguggugcagcccgggaagucccuccgccugagcugcgccgccucccaguucagcuucaaccgguacggcaugcacuggguccgccaggcgccggggaagggccuggaguggguggccgccaucuccuacgacggcaccgacaaguaccacgccgacaaggugugggggcgguucaccaucagccgcgacaacuccaagaacacgcucuaccugcagaugaacagccugcgggccgaggacaccgcgcucuacuacugcgccaaggaccugcgcgaggacgagugcgaggaguggugguccgacuacuacgacuucggcaagcagcugcccugccggaagucccgcggggucgccggcaucuucgacaagugggggcagggcaccauggugaucgugagcagc

SEQ ID NO: 8824 - RNA, 324 nt, Artificial Sequence
  derived and/or modified sequence opt1 from anti-HIV_CAP256-VRC26.05_LightChain
cagagcgcccugacccagcccccguccgugagcgccgcgcccggccagaaggucaccaucuccugcagcgggaacaucggcaacaacuacguguccugguaccagcagguccccgggacggcccccaagcuccugaucuacgagaacaacaagcgcccgagcggcauccccgaccgguucuccgggagcaaguccggcaccagcgccacccuggugaucaccggccuccagacgggggacgaggccgacuucuacugcggcaccuggggcgggucccugcgcaccgggggcgugcugggcaccgggacgcgggugaccguccuc

SEQ ID NO: 8825 - RNA, 432 nt, Artificial Sequence
  derived and/or modified sequence opt1 from anti-HIV_CAP256-VRC26.05_HeavyChain
gaggugcagcuggucgagagcggcgggggcguggugcagcccgggcgcucccuccggcugagcugcgccgccucccacuucagccuguccagcuacggcaugcacuggguccgccaggcgccggggaagggccucgagugggugaccggcaucuccuucgccgggaccaagacguacuacggcgacagcgugcgggggcgcuucaccgucucccgggacaucagcaagaacacccuguuccugcagaugaacucccuccgccccgacgacaccgccauguacuacugcgcccgggaccagcgcuacuacgagugcgaggagugggccagcgacuacuacgacuucggccgggagcagcccugccuggacccccgcgggguggugggcaucuucgaccuguggggccaggggacgauggucaccguguccagc

SEQ ID NO: 8826 - RNA, 324 nt, Artificial Sequence
  derived and/or modified sequence opt1 from anti-HIV_CAP256-VRC26.06_LightChain
cagagcgugcugacccagcccccguccgucagcgccgcccccggccagaaggugaccaucuccugcagcggguccacgagcaagaucggccagaacuccgugagcugguaccagcagcuccccgggaccgcgcccaagcugcugaucuacgagaacgaccgccggccguccggcacccccgaccgcuucagcggguccaagagcggcaccuccgccacgcucgccaucaccggccugcagaccggggacgaggccgaguacuacugcgagaccugggacggcagcgggggcgucuucgggacgggcaccaaggugaccgugcug

SEQ ID NO: 8827 - RNA, 435 nt, Artificial Sequence
  derived and/or modified sequence opt1 from anti-HIV_CAP256-VRC26.06_HeavyChain
gaggugcagcugaucgagagcggcgggggcgucgugcagcccgggcggucccuccggcugagcugcggcgccuccggguucagcuucaacaacuacggcaugcacugggugcgccaggccccgggcaaggggcuggagugggucgcgggcaucuccuucgccgggaucaagaaguacuacggcaccagcgugaaggggcgguucaccaucucccgcgacaacagcaagaacaacuucuaccuccagaugaacucccugcggguggaggacacggcccuguacuacugcgcccgcgaccuccgggagcuggagugcgaggaguggacccuguacaacuacuacgacuucggcagccgcggccccugcgucgacccccgcgggguggccggcuccuucgacgugugggggcagggcaccauggucaccgugagcucc

SEQ ID NO: 8828 - RNA, 333 nt, Artificial Sequence
  derived and/or modified sequence opt1 from anti-HIV_CAP256-VRC26.07_LightChain
caggccgugcugacccagcccccgagcgucuccgccgcgcccggccagaacgugaccaucagcugcuccgggagcggcuccaacaucgggaacaacuucgugagcugguaccagcagcgccccggcacggcccccaagcuccugaucuacgaguccaacaagcggccgagcgggauccccgaccgcuucuccggcagcaaguccggcaccagcgccacccuggccaucaccgggcuccagacgggcgacgaggccuacuacuacugcgcgaccugggccgcccggcugaacuccgcccgcgucuucgggaccggcaccauggugacggugcug

SEQ ID NO: 8829 - RNA, 432 nt, Artificial Sequence
  derived and/or modified sequence opt1 from anti-HIV_CAP256-VRC26.07_HeavyChain
gaggugcagcuggucgagagcggcgggggcguggugcagcccgggcgcucccuccggcugagcugcgucggcucccaguucagcuucaaccgcuacgggaugcacugggugcggcaggccccgggcaagggccuggaguggguggccgggaucuccuucgacggcaccgaccgcuaccacgcggacaacgucugggggcgguucaccaucagccgcgacaacuccaagaacacgcucuaccugcagaugagcucccugcgggccgaggacaccgcccucuacuacugcgccaaggaccugcgcgaggacgagugcgaggagugguggagcgacuacuacgacuucggcaagaagcugcccugccggaagucccgcgggguggccggcguguucgacaaguggggccaggggaccauggucaccgugagcucc

SEQ ID NO: 8830 - RNA, 333 nt, Artificial Sequence
  derived and/or modified sequence opt1 from anti-HIV_CAP256-VRC26.08_LightChain
cagagcgcccugacccagcccccguccgugagcgccgcgcccggccagaaggucaccaucuccugcagcgggaacuccagcaacaucggcaacaacuucguguccugguaccagcagguccccgggacggcccccaagcuccugcuguacgagaccuaccgccggccgagcggcauccccgaccgcuucuccgggagcaaguccggcaccagcgccacccucgccaucacgggccugcagaccggggacgaggccgacuacuacugcaccguguggggcgugcggaagggggugggcgcggucuucgggaccggcacgaaggugaccgugcug

SEQ ID NO: 8831 - RNA, 438 nt, Artificial Sequence
  derived and/or modified sequence opt1 from anti-HIV_CAP256-VRC26.08_HeavyChain
gaggugcagcuggucgagagcggcgggggcguggugcagcccgggcgcucccucacccugagcugcgccgccucccaguucaccuucagcaacuacggcaugcacuggguccggcaggcgccggggaagggccuggaguggguggccuccgugagcaacgacggcacgaagaaguaccacggggacuccgucuggggccgcuucaccaucagccgggacaacuccaagaacacccucuuccugcagaugagcucccugcgcgccgaggacaccgccguguacuucugcgugcgggaccagcgcgaggacgagugcgaggagugguggagcgacuacuacgacuucgggcgggagcuccccugccgcaaguuccggggccuggggcuggccggcaucuucgacaucuggggccacgggacgauggucaccguguccagc

SEQ ID NO: 8832 - RNA, 333 nt, Artificial Sequence
  derived and/or modified sequence opt1 from anti-HIV_CAP256-VRC26.09_LightChain
cagagcgcccugacccagcccccguccgugagcgccgcgcccggccagaaggucaccaucuccugcagcgggaacuccagcaacaucggcaacaacuucguguccugguaccagcagcuccccgggacggcccccaagcugcugaucuacgagaacaaccgccggccgagcggcauccccgaccgcuucuccgggagcaaguccggcaccagcgccacccucgccaucuccggccugcagaccggggacgaggccgacuacuggugcgcgguguggggcguccggcgcggggccggcgccguguucggggccggcacgaaggugaccguccug

SEQ ID NO: 8833 - RNA, 438 nt, Artificial Sequence
  derived and/or modified sequence opt1 from anti-HIV_CAP256-VRC26.09_HeavyChain
gaggugcagcuggucgagagcggcgggggcguggugcagcccgggcgcucccucacccugagcugcgccgccucccaguucaacuucgcgaacuacggcaugcacuggguccggcaggccccggggaagggccuggaguggguggccagcaucuccaacgacggcaccaagaaguaccacgaggagagcgugugggggcgcuucacgaucuccaaggacaacagcaaguccacccucuuccugcagaugaacagccugcggaucgaggacaccgcccucuacuucugcgucaaggaccagcgcgaggacgagugcgaggaguggugguccgacuacuacgacuucggccgggagcugcccugccgcaagagccgggggcugggccucgccgggaucuucgacauguggggccacggcaccauggugacgguguccagc

SEQ ID NO: 8834 - RNA, 333 nt, Artificial Sequence
  derived and/or modified sequence opt1 from anti-HIV_CAP256-VRC26.10_LightChain
cagagcgugcugacccagcccccguccgucagcgccgcccccggccagaaggugaccaucuccugcagcggguccagcuccaacaucggcgacaacuacgugagcugguaccagcaccuccccgggacggcgcccaagcugcugaucuacgagaacacccgccggccguccggcauccccgaccgcuucagcggguccaagagcggcaccuccgccacccucgccaucacgggccugcagaccggggacgaggccgacuacuacugcggcaccugggacguccggcccaaccgcggggccguguucggcaccgggacgaaggugaccguccug

SEQ ID NO: 8835 - RNA, 432 nt, Artificial Sequence
  derived and/or modified sequence opt1 from anti-HIV_CAP256-VRC26.10_HeavyChain
caggccauccugguggagagcggcgggggcgucgugcagcccgggcgcucccuccggcugagcugcgccgcgucccaguucaccuucagcggccacgggcugcacugggugcgccaggccccgggcaagggccucgagugggucgccuccaucagcuucgccgggaccaagauggacuacgccgacuccgugaagggccgguucgcgaucagccgcgacaacuccaagaacacgcuguaccugcagaugaacagccuccggguggaggacaccgcccuguacuacugcgccaaggacaugcgcgaguacgagugcgaguacuggaccuccgacuacuacgacuucgggcggccccagcccugcaucgaccgccggggcgucguggggaucuucgacauguggggccagggcaccauggugacggucagcacc

SEQ ID NO: 8836 - RNA, 321 nt, Artificial Sequence
  derived and/or modified sequence opt1 from anti-HIV_CAP256-VRC26.11_LightChain
cagagcgugcugacccagcccccguccgucagcgccgcccccggccagaacgugaccaucuccugcagcgggccgcccucccacaucgagaagaacgacgugagcugguaccagcgccuccccggcauggcgcccaagauggucaucuacgaguccaagcggcgcccccuggggauccccgugcgguucagcgccucccgcagcggcuccagcgccacgcuggugaucaccgggcuccagaccgccgacgaggccgacuacuacugcggcaccugggacggccggaugaacuucgggacgggcaccaccgucuccgugcug

SEQ ID NO: 8837 - RNA, 429 nt, Artificial Sequence
  derived and/or modified sequence opt1 from anti-HIV_CAP256-VRC26.11_HeavyChain
gaggugcagcuggucgagagcggcgggggcguggugcccccggggaagucccucacccugagcugcgucgccucccgcuucaccuucagcgccuucggcaugcacugggugcggcaggcgcccgggaagggccuggaguggguggccuccaucagcuucgccggcaucaagaaguacuacgccgacuccgucaaggggcgcuucagcaucucccgggacaacagcaacacccucuuccugcagaugaacggccugcgcggggaggacacgggccucuaccacugcgugaaggacaugcgggagcuggagugcgaggagugggccuccgacuacuacgacuucgggaagccccagcccugccuggaccgccggggcgugagcggcaucuccgcguggugggggccgggcaccauggucaccgugagcucc

SEQ ID NO: 8838 - RNA, 321 nt, Artificial Sequence
  derived and/or modified sequence opt1 from anti-HIV_CAP256-VRC26.12_LightChain
cagagcgugcugacccagcccccguccgucagcaccgcccccggccagacggugaccguguccugcagcgggggcaccuccaacaccgggaacaacuucgucagcugguaccagcaccuccccggcacggcccccaagcugcugaucuacgagaacaacaagcgcccgcucggggugcccgaccgguucuccggcgccaagagcggcaccuccgcgacccuggccaucaccgggcugcagacgggcgacgagggggacuacuacugcgccaccuggagcggcucccucaacaucgggaccggcaccaaggugagcguccug

SEQ ID NO: 8839 - RNA, 432 nt, Artificial Sequence
  derived and/or modified sequence opt1 from anti-HIV_CAP256-VRC26.12_HeavyChain
gaggugcagcugguccagagcggcgggggcguggugcagcccgggcgcucccuccggcugagcugcgccgccccguacuucgaguucggccgcuacggguuccacuggguccggcaggcgcccggcaagggccuggaguggguggccuccaucagcuucgccgggcgcgacuacuaccacucccccagcguguggggccgguucaccaucucccgcgacaacagcaagaacacccucuaccugcagaugaacucccugcggaucgaggacacggcccucuacuucugcgcccgcgaccugcgggagagcgagugcgaggagugggaguccgacuacuacgacuucgggaagaagggccccugcgucaagccgcgcgggguggcgggcggccuggaccucugggggcagggcaccauggugaucgucagcucc

SEQ ID NO: 8840 - RNA, 333 nt, Artificial Sequence
  derived and/or modified sequence opt1 from anti-HIV_CAP256-VRC26.I1_LightChain
cagagcgugcugacccagcccccguccgucagcgccgcccccggccagaaggugaccaucuccugcagcggguccagcuccaacaucggcaacaacuacgugagcugguaccagcagcuccccgggacggcgcccaagcugcugaucuacaagaacaacgagcgcccguccggcauccccgaccgguucagcggguccaagagcggcaccuccgccacccucggcaucaccgggcugcagacgggcgacgaggccgacuacuacugcgggaccugggacaccagccuguccgccggcggggucuucggcaccggcacgaaggugaccgugcuc

SEQ ID NO: 8841 - RNA, 432 nt, Artificial Sequence
  derived and/or modified sequence opt1 from anti-HIV_CAP256-VRC26.I1_HeavyChain
caggugcagcuggucgagagcggcgggggcguggugcagcccgggcgcucccuccggcugagcugcgccgccuccggcuucaccuucagcaacuacgcgauggacuggguccgccaggccccggggaagggccuggaguggguggccgugaucuccagcgacggcuccaacaagaacuacgccgacagcgucaaggggcgguucaccaucucccgcgacaacagcaagaacacgcucuaccugcagaugaacucccugcgggccgaggacaccgcgguguacuacugcgccaaggaccucggcgagaacaagaacgacgagugggccaccgacuacuacgaccugagcaucgccuaccccgugcaggacccccgcgcggucgugggggccuucgacaucuggggccaggggaccauggugacggucuccagc

SEQ ID NO: 8842 - RNA, 333 nt, Artificial Sequence
  derived and/or modified sequence opt1 from anti-HIV_CAP256-VRC26.I2_LightChain
cagagcgugcugacccagcccccguccgucagcgccgcccccggccagaaggugaccaucuccugcagcggguccagcuccacgaucggcaacaacuacgugagcugguaccagcuccugcccgggaccgcgcccaagcugcucaucuacaagaacgacaagcgcccguccggcauccccgaccgguucagcggguccaagagcggcaccuccgccacccugggcaucacggggcugcagaccggcgacgaggccgacuacuacugcgggaccugggacaccagccucuccgccggcggggucuucggcacgggcaccaaggugaccgugcug

SEQ ID NO: 8843 - RNA, 432 nt, Artificial Sequence
  derived and/or modified sequence opt1 from anti-HIV_CAP256-VRC26.I2_HeavyChain
caggugcagcuggucgagagcggcgggggcguggugcagcccgggcgcucccuccggcugagcugcgccgccuccggcuucaccuucagcaacuucgcgaugggguggguccgccaggccccgggcaagggccuggaguggguggccuucaucuccagcgacggguccaacaagaacuacggcgacagcgugaaggggcgguucaccaucucccgcgacaacagcaagaacacccucuuccugcagaugaacucccugcgggccgaggacacggcccucuacuacugcgcgaaggacgucggcgaguacaagagcgacgagugggccaccgacuacuacgaccuguccaucgccuaccccauccaggacccccgcgccauggugggggcguucgacaucuggggccagggcaccauggugacggucagcucc

SEQ ID NO: 8844 - RNA, 333 nt, Artificial Sequence
  derived and/or modified sequence opt1 from anti-HIV_CAP256-VRC26.UCA_LightChain
cagagcgugcugacccagcccccguccgucagcgccgcccccggccagaaggugaccaucuccugcagcggguccagcuccaacaucggcaacaacuacgugagcugguaccagcagcuccccgggacggcgcccaagcugcugaucuacgagaacaacaagcgcccguccggcauccccgaccgguucagcggguccaagagcggcaccuccgccacccucggcaucaccgggcugcagacgggcgacgaggccgacuacuacugcgggaccugggacagcucccugagcgccggcggggucuucggcaccggcaccaaggugacggugcuc

SEQ ID NO: 8845 - RNA, 432 nt, Artificial Sequence
  derived and/or modified sequence opt1 from anti-HIV_CAP256-VRC26.UCA_HeavyChain
caggugcagcuggucgagagcggcgggggcguggugcagcccgggcgcucccuccggcugagcugcgccgccuccggcuucaccuucagcuccuacgggaugcacuggguccgccaggcgccgggcaagggccuggaguggguggccgugaucagcuacgacggguccaacaaguacuacgccgacagcgucaagggccgguucaccaucucccgcgacaacagcaagaacacgcucuaccugcagaugaacucccugcgggccgaggacaccgccguguacuacugcgcgaaggaccucggggagagcgagaacgaggagugggccaccgacuacuacgacuucuccaucggcuaccccgggcaggacccccgcggcguggucggcgccuucgacaucugggggcagggcaccauggugacggugagcucc

SEQ ID NO: 8846 - RNA, 324 nt, Artificial Sequence
  derived and/or modified sequence opt1 from anti-HIV_CH01_LightChain
gagaucgugcuggcccagagccccggcacccucucccugagcccgggggagcgcgccacccuguccugccgggcgagccacaacguccaccccaaguacuucgccugguaccagcagaagcccggccagagcccccgccuccugaucuacgggggcuccacgcgggccgccgggaucccgggcaaguucuccggcagcggguccggcaccgacuucacccugaccaucagccgcguggaccccgaggacuucgccguguacuacugccagcaguacgggggcucccccuacacguucgggcagggcaccaaggucgagaucaag

SEQ ID NO: 8847 - RNA, 399 nt, Artificial Sequence
  derived and/or modified sequence opt1 from anti-HIV_CH01_HeavyChain
gaggugcagcuggucgagagcggcgccaacguggugcgccccgggggcucccuccggcugagcugcaaggccuccggguucaucuucgagaacuucggcuucagcuggguccgccaggcgccggggaagggccugcaguggguggccggccucaacuggaacgggggcgacacccgguacgccgacuccgugaaggggcgcuuccggaugagccgcgacaacucccggaacuucgucuaccuggacauggacaaggugggcguggacgacaccgccuucuacuacugcgcccgcgggacggacuacaccaucgacgacgcgggcauccacuaccagggcagcgggaccuucugguacuucgaccuguggggccgggggacccucgucuccgugagcucc

SEQ ID NO: 8848 - RNA, 324 nt, Artificial Sequence
  derived and/or modified sequence opt1 from anti-HIV_CH02_LightChain
gagaucgugcugacccagagccccgccacccucuccgucagcccgggcgagcgcgccacgcuguccugccgggcgagccagaacgugcacccccgcuacuucgccugguaccagcagaagcgggggcagagcccccgccugcucauccacuccggcuccacccgggccgccgggaucgccgaccgcuucagcggcgggggcuccggcaugcacuucacccugaccaucacgcggguggagcccgaggacuucgcggucuacuucugccagcaguacgggggcagcccguacaccuucgggcagggcacccgcguggagcugcgg

SEQ ID NO: 8849 - RNA, 399 nt, Artificial Sequence
  derived and/or modified sequence opt1 from anti-HIV_CH02_HeavyChain
gaggugcagcuggucgagagcggcggguccguggugcgccccggcgggagccuccggcuguccugccgcgccagcggcuucaucuucgagaacuacgggcugaccuggguccgccaggugccgggcaagggccuccacuggguguccgggaugaacuggaacggcggggacacccgguacgccgacagcguccggggccgcuucuccaugagccgggacaacuccaacaacaucgcguaccugcagaugaacaaccugcgcguggaggacacggcccucuacuacugcgcccgggggaccgacuacaccaucgacgaccagggccgcuucuaccagggcagcgggaccuucugguacuucgacuucuggggccgggggacgcuggugaccgucuccagc

SEQ ID NO: 8850 - RNA, 324 nt, Artificial Sequence
  derived and/or modified sequence opt1 from anti-HIV_CH03_LightChain
gagaucgugcugacccagagccccgccacccucucccugagcccgggcgagcgcgccacgcuguccugccgggcgagccaguccguccaccccaaguacuucgccugguaccagcagaagcccgggcagagcccccgccuccugaucuacuccggcagcacccgggccgccgggaucgccgaccgcuucuccggcgggggcagcggcauccacuucacccugaccaucacgcggguggagccggaggacuucgcgguguacuucugccagcaguacgggggcucccccuacaccuucgggcagggcaccaaggucgagcuccgc

SEQ ID NO: 8851 - RNA, 399 nt, Artificial Sequence
  derived and/or modified sequence opt1 from anti-HIV_CH03_HeavyChain
gaggugcagcuggucgagagcggcgggggcguggugcgccccgggggcucccuccggcugagcugcgccgccuccggguucaucuucgagaacuacggccugaccuggguccgccaggugccgggcaaggggcuccacugggugagcggcaugaacuggaacgggggcgacacccgguacgcggacuccguccgcgggcgguucagcaugucccgcgacaacagcaacaacaucgccuaccugcagaugaagaaccugcggguggacgacacggcccucuacuacugcgcccgcggcaccgacuacaccaucgacgaccagggcaucuucuacaagggguccggcaccuucugguacuucgaccugugggggcggggcacgcuggugaccgucagcucc

SEQ ID NO: 8852 - RNA, 324 nt, Artificial Sequence
  derived and/or modified sequence opt1 from anti-HIV_CH04_LightChain
gagaucgugcugacccagagccccgacacccucucccugagcccgggcgagcgcgccacgcuguccugccgggccagccaguccguccacagccgcuacuucgcgugguaccagcacaagcccgggcagccgccccggcuccugaucuacggcggguccacccgcgccaccggcauccccaaccgguucagcgccgggggcuccggcacccaguucacgcugaccgugaaccgccucgaggccgaggacuucgccguguacuacugccagcaguacgggcggagccccuacaccuucggccaggggaccaaggucgagauccgc

SEQ ID NO: 8853 - RNA, 399 nt, Artificial Sequence
  derived and/or modified sequence opt1 from anti-HIV_CH04_HeavyChain
gaggugcagcuggucgagagcggcgggggccucauccgccccgggggcucccugcggcugagcugcaagggguccggcuucaucuucgagaacuucggcuucgggugggugcgccagggcccggggaagggccucgagugggugagcgggaccaacuggaacggcggcgacucccgguacggggacagcgucaagggccgcuucaccaucucccgggacaacagcaacaacuucguguaccugcagaugaacucccugcgccccgaggacacggccaucuacuacugcgcccgggggaccgacuacaccaucgacgaccagggcauccgcuaccagggcagcgggaccuucugguacuucgacguguggggccgggggacgcucgucaccguguccagc

SEQ ID NO: 8854 - RNA, 627 nt, Artificial Sequence
  derived and/or modified sequence opt1 from anti-HIV_CH103_LightChain
uacgagcugacccagcccccgagcguguccgucagccccggccagaccgccacgaucacgugcuccggggccagcaccaacgugugcugguaccaggugaagcccggccagucccccgaggucgugaucuucgagaacuacaagcgcccgagcgggauccccgaccgguucuccggcagcaaguccgggagcaccgcgacgcucaccauccgcggcacccaggccaucgacgaggccgacuacuacugccaggugugggacuccuucagcaccuucgucuucggcuccgggacccaggugaccgugcugcggcagcccaaggccaaccccaccgucacccuguucccgcccagcuccgaggagcuccaggccaacaaggcgacgcuggugugccugaucagcgacuucuaccccggcgccgugaccgucgccuggaaggccgacuccagccccgugaaggcggggguggagaccaccacgccguccaagcagagcaacaacaaguacgccgccagcuccuaccucagccugacccccgagcaguggaagucccaccgcagcuacuccugccaggucacccacgagggcagcaccguggagaagacgguggcccccaccgagugcucc

SEQ ID NO: 8855 - RNA, 678 nt, Artificial Sequence
  derived and/or modified sequence opt1 from anti-HIV_CH103_HeavyChain
caggugcagcugcaggagagcggccccggggucgugaaguccagcgagacccucucccugaccugcacggugagcggcggguccaugggcgggaccuacuggagcuggcugcgccucuccccgggcaagggccuggaguggaucggguacaucuuccacaccggcgagaccaacuacagccccucccugaaggggcgggucagcaucuccguggacacgagcgaggaccaguucucccuccgccugcggagcgugaccgccgccgacaccgcggucuacuucugcgccucccugccccgcggccagcucgugaacgccuacuuccggaacugggggcgcggcagccugguguccgucaccgccgccagcacgaagggccccuccguguucccgcuggcgcccagcagcaaguccaccagcgggggcaccgccgcccucgggugccuggugaaggacuacuuccccgagcccgucaccguguccuggaacagcggcgcccugacguccggcgugcacaccuucccggcgguccuccagagcuccgggcuguacagccuguccagcguggugaccguccccuccagcucccucggcacccagacguacaucugcaacgugaaccacaagcccagcaacaccaagguggacaagaaggucgagcccaaguccugcgacaag

SEQ ID NO: 8856 - RNA, 321 nt, Artificial Sequence
  derived and/or modified sequence opt1 from anti-HIV_M66.6_LightChain
gacauccagcugacccagagccccuccagccucuccgccagcgugggcgaccgcgucaccaucacgugccgggccucccagagcaucggguccuaccugaacugguaccagcagaagccgggcaaggcgcccaagcugcucaucuacgccgccagcacccugcaguccggggugcccagccgcuucuccggcagcggguccggcaccgacuucacccugacgaucagcucccuccagcccgaggacagcgccaccuacuacugccagcaguccuacagcaccccguucaccuucggccccgggacgaagguggacauccgg

SEQ ID NO: 8857 - RNA, 390 nt, Artificial Sequence
  derived and/or modified sequence opt1 from anti-HIV_M66.6_HeavyChain
caggugcagcugguccagagcggcgccgaggugaagaagcccggggagucccucaagaucagcugcaagguguccggcuacaacuucgccagcgaguggaucggguggguccgccagaugccgggcaaggggcuggaguggaugggcaucaucuaccccggcgacuccgacaccaaguacagccccuccuuccagggccaggugaucaucagcgcggacaaguccaucaacaccgccuaccugcaguggagcucccucaaggccagcgacacggccaucuacuacugcgcccggcagaaccacuacggguccgggagcuacuucuaccgcaccgcguacuacuacgccauggacguguggggccaggggaccaccgucacgguguccagc

SEQ ID NO: 8858 - RNA, 327 nt, Artificial Sequence
  derived and/or modified sequence opt1 from anti-HIV_NIH45-46_LightChain
gagaucgugcugacccagagccccgccacccucucccugagcccgggcgagacggccaucaucuccugccgcaccagccaguccgggagccuggcgugguaccagcagcggcccggccaggcgccccgccucgucaucuacuccgggagcacccgggccgccggcauccccgaccgcuucuccgggagccgguggggcgccgacuacaaccuguccaucagcaaccuggaguccggcgacuucgggguguacuacugccagcaguacgaguucuucggccaggggaccaaggugcaggucgacaucaagcgcacgguggccgccccg

SEQ ID NO: 8859 - RNA, 399 nt, Artificial Sequence
  derived and/or modified sequence opt1 from anti-HIV_NIH45-46_HeavyChain
caggugcgccugagccaguccggcgggcagaugaagaagcccggcgagagcaugcggcucuccugccgcgccagcggguacgaguuccugaacugcccgaucaacuggauccggcuggcccccggccgccggcccgaguggaugggguggcucaagccccgcggcggcgcggucaacuacgcccggaaguuccaggggcgcgugaccaugacccgggacguguacuccgacacggccuuccuggagcugcgcagccucaccuccgacgacaccgccgucuacuucugcacccggggcaaguacugcacggcccgcgacuacuacaacugggacuucgagcacugggggcggggcgcgccggugaccgugagcuccgccagcaccaaggggcccuccguc

SEQ ID NO: 8860 - RNA, 330 nt, Artificial Sequence
  derived and/or modified sequence opt1 from anti-HIV_PG16_LightChain
cagagcgcccugacccagcccgccuccgugagcggcuccccggggcagaccaucacgaucagcugcaacggcaccuccagcgacgucgggggcuucgacuccgugagcugguaccagcagucccccgggaaggcgcccaaggugauggucuucgacgugagccaccgccccuccggcaucagcaaccgguucuccggcagcaaguccgggaacaccgccagccucaccaucuccggccugcacaucgaggacgagggggacuacuucugcagcucccugacggaccgcagccaccggaucuucggcgggggcaccaaggugaccguccuc

SEQ ID NO: 8861 - RNA, 411 nt, Artificial Sequence
  derived and/or modified sequence opt1 from anti-HIV_PG16_HeavyChain
caggagcagcugguggagagcggcgggggcgucgugcagcccgggggcucccuccgccugagcugccuggccuccggguucaccuuccacaaguacggcaugcacugggugcggcaggccccgggcaaggggcucgagugggucgcgcugaucagcgacgacggcaugcgcaaguaccacuccgacagcaugugggggcgggugaccaucucccgcgacaacagcaagaacacgcuguaccuccaguucuccagccugaagguggaggacaccgccauguucuucugcgcccgggaggccggcgggcccaucuggcacgacgacgucaaguacuacgacuucaacgacggcuacuacaacuaccacuacauggacguguggggcaaggggaccaccgugacggucuccagc

SEQ ID NO: 8862 - RNA, 315 nt, Artificial Sequence
  derived and/or modified sequence opt1 from anti-HIV_PGT122_LightChain
accuucgugagcgucgcccccggccagaccgcccgcaucacgugcggggaggagucccugggcagccgguccgugaucugguaccagcagcgcccggggcaggcgcccagccucaucaucuacaacaacaacgaccggcccuccggcauccccgaccgcuucagcggguccccgggcagcaccuucggcaccaccgccacgcugaccaucaccuccguggaggccggggacgaggccgacuacuacugccacaucugggacagccggcgccccaccaacugggucuucggcgaggggacgacccugaucgugcuc

SEQ ID NO: 8863 - RNA, 396 nt, Artificial Sequence
  derived and/or modified sequence opt1 from anti-HIV_PGT122_HeavyChain
caggugcaccuccaggagagcggccccgggcuggucaagccguccgagacccugagccugaccugcaacguguccggcacgcucgugcgcgacaacuacuggagcuggauccggcagccccuggggaagcagcccgaguggaucggcuacguccacgacuccggggacaccaacuacaaccccagccugaagucccgcgugcaccucagccuggacaaguccaagaaccuggugagccuccggcugaccggcgucaccgccgccgacuccgcgaucuacuacugcgccacgaccaagcacggccgccggaucuacggggugguggccuucaaggagugguucaccuacuucuacauggacgucuggggcaaggggaccagcgugacgguguccagc

SEQ ID NO: 8864 - RNA, 315 nt, Artificial Sequence
  derived and/or modified sequence opt1 from anti-HIV_PGT123_LightChain
agcuccaugagcgugucccccggcgagaccgccaagaucagcugcgggaaggaguccaucggcagccgcgccguccagugguaccagcagaagccggggcagccgcccucccugaucaucuacaacaaccaggaccggcccgcgggcgugcccgagcgcuucagcgccucccccgacuuccggcccgggaccacggccacccucaccaucaccaacguggacgccgaggacgaggccgacuacuacugccacaucuacgacgcgcgcggcggcacgaacugggucuucgaccgggggaccacccugaccgugcug

SEQ ID NO: 8865 - RNA, 396 nt, Artificial Sequence
  derived and/or modified sequence opt1 from anti-HIV_PGT123_HeavyChain
cagcugcaccuccaggagagcggccccgggcuggugaagccgcccgagacccugucccugaccugcagcgucuccggcgccagcaucaacgacgccuacugguccuggauccgccagagccccgggaagcggcccgagugggugggcuacgugcaccacuccggggacacgaacuacaacccgagccucaagcgccgggucaccuucucccuggacaccgcgaagaacgaggugagccucaagcugguggaccugaccgccgccgacuccgccacguacuucugcgcccgcgcgcuccacggcaagcggaucuacggcaucgucgcccugggggagcuguucaccuacuucuacauggacguguggggcaaggggaccgccgugaccgucagcucc

SEQ ID NO: 8866 - RNA, 315 nt, Artificial Sequence
  derived and/or modified sequence opt1 from anti-HIV_PGT125_LightChain
cagagcgcccugacccagcccccguccgccagcggcucccccgggcagagcaucaccaucuccugcaacggcacggcgaccaacuucgugagcugguaccagcaguuccccgacaaggcccccaagcucaucaucuucggggucgacaagcgcccgcccggcgugcccgaccgguucuccgggagccgcuccggcaccaccgccagccugacggugucccggcugcagaccgacgacgaggccgucuacuacugcggcagccucguggggaacugggacgugaucuucggcgggggcaccacccugacgguccug

SEQ ID NO: 8867 - RNA, 411 nt, Artificial Sequence
  derived and/or modified sequence opt1 from anti-HIV_PGT125_HeavyChain
cagagccagcugcaggaguccggcccccgccucguggaggccagcgagacccugucccugaccugcaacgucagcggggaguccacgggcgccugcaccuacuucugggggugggugcggcaggcgccgggcaaggggcucgaguggaucggcagccugucccacugccagagcuucuggggcuccggguggaccuuccacaaccccagccugaagucccgccucaccaucagccuggacacgcccaagaaccagguguuccugaagcucaccucccugaccgccgccgacaccgccacguacuacugcgcccgguucgacggcgagguccugguguacaaccacuggcccaagccggcguggguggaccucugggggcgcggcauccccgucaccgugaccgugagcucc

SEQ ID NO: 8868 - RNA, 315 nt, Artificial Sequence
  derived and/or modified sequence opt1 from anti-HIV_PGT126_LightChain
cagagcgcccugacccagcccccguccgccagcggcucccccgggcagagcaucuccaucagcugcaccggcacguccaaccgcuucgugagcugguaccagcagcaccccgggaaggcgcccaagcucgucaucuacggcgugaacaagcggccguccggggugcccgaccgcuucagcggcuccaagagcggcaacaccgccucccugaccgucagcgggcugcagaccgacgacgaggccguguacuacugcuccagccucgugggcaacugggacgucaucuucgggggcgggacgaagcugaccgugcug

SEQ ID NO: 8869 - RNA, 411 nt, Artificial Sequence
  derived and/or modified sequence opt1 from anti-HIV_PGT126_HeavyChain
cagccccagcugcaggagagcggcccggggcucguggaggccuccgagacccugagccugaccugcacggucuccggcgacagcaccgccgcgugcgacuacuucugggggugggugcgccagccgcccggcaaggggcucgaguggaucggcggccugucccacugcgccggguacuacaacaccggcuggaccuaccacaaccccagccugaagucccggcucacgaucagccuggacacccccaagaaccagguguuccugaagcucaacuccgucaccgccgccgacaccgccaucuacuacugcgcgcgcuucgacggggaggugcugguguaccacgacuggcccaagcccgccugggucgaccuguggggccgggggacgcucgugaccgugaccgucagcucc

SEQ ID NO: 8870 - RNA, 315 nt, Artificial Sequence
  derived and/or modified sequence opt1 from anti-HIV_PGT127_LightChain
cagagcgcccugacccagcccccguccgccagcggcucccccgggcagagcaucaccaucuccugcacgggcaccagcaacaacuucguguccugguaccagcaguaccccgggaaggcgcccaagcucgucaucuacgaggugaacaagcgcccgagcggcgugcccgaccgguucuccgggagcaaguccggcagcaccgccucccugaccgucagcggccugcaggccgacgacgaggggguguacuacugcuccagccucgugggcaacugggacgucaucuucgggggcgggacgaagcugaccgugcug

SEQ ID NO: 8871 - RNA, 405 nt, Artificial Sequence
  derived and/or modified sequence opt1 from anti-HIV_PGT127_HeavyChain
cagccccagcugcaggagagcggcccggggcucguggaggccuccgagacccugagccugaccugcacggucuccggcgacagcaccgggcgcugcaacuacuucuggggcugggugcggcagccgcccgggaagggccucgaguggaucggcucccugagccacugccgcuccuacuacaacaccgacuggaccuaccacaaccccagccugaagucccggcucacgaucagccuggacacccccaagaaccagguguuccugcgccucaccuccgucaccgccgcggacacggccaccuacuacugcgcccgguucgggggcgaggugcugguguaccgcgacuggcccaagcccgccugggucgaccugugggggcggggcacccucgugaccgugagcucc

SEQ ID NO: 8872 - RNA, 315 nt, Artificial Sequence
  derived and/or modified sequence opt1 from anti-HIV_PGT128_LightChain
cagagcgcccugacccagcccccguccgccagcggcucccccgggcagagcaucaccaucuccugcacgggcaccagcaacaacuucguguccugguaccagcagcacgcggggaaggcccccaagcucgucaucuacgacgugaacaagcgccccagcggcgugccggaccgguucuccgggagcaaguccggcaacaccgccagccugaccgucuccggccugcagacggacgacgaggccguguacuacugcgggagccucgugggcaacugggacgucaucuucgggggcgggaccaagcugaccgugcug

SEQ ID NO: 8873 - RNA, 405 nt, Artificial Sequence
  derived and/or modified sequence opt1 from anti-HIV_PGT128_HeavyChain
cagccccagcugcaggagagcggcccgacccucguggaggccuccgagacccugagccugacgugcgccgucuccggggacagcaccgcggccugcaacuccuucuggggcugggugcgccagccgcccgggaagggccucgaguggguggggagccugucccacugcgccagcuacuggaaccggggcuggaccuaccacaaccccucccucaagagccgccugacccuggcccuggacacgcccaagaaccucgucuuccugaagcugaacuccgugaccgccgcggacaccgccaccuacuacugcgcccgguucggcggggaggugcuccgcuacacggacuggcccaagcccgccugggucgaccuguggggccgggggacccuggugaccgugagcucc

SEQ ID NO: 8874 - RNA, 330 nt, Artificial Sequence
  derived and/or modified sequence opt1 from anti-HIV_PGT130_LightChain
cagagcgcccugacccagcccccguccgccagcggcucccucgggcagagcgugaccaucuccugcaacggcacgagcuccgacaucgggggcuggaacuucgucagcugguaccagcaguuccccgggcgcgcgccccggcugaucaucuucgaggugaacaagcgccccuccggcgugccgggccgguucagcggguccaagagcggcaacuccgccagccugaccgucuccgggcuccagagcgacgacgagggccaguacuucugcuccagccuguucgggcgcugggacgugguguucggcggcgggaccaagcugaccguccuc

SEQ ID NO: 8875 - RNA, 387 nt, Artificial Sequence
  derived and/or modified sequence opt1 from anti-HIV_PGT130_HeavyChain
caggugcagcugcaggagagcggccccgggcucgucaagccggccgagacccugucccugaccugcagcguguccggcgagagcaucaacacggggcacuacuacuggggcugggugcgccagguccccgggaagggccucgaguggaucggccacauccacuacaccaccgccgugcugcacaaccccucccucaagagccggcugaccaucaagaucuacacgcugcgcaaccagaucacccugcggcucuccaacgugaccgcggccgacaccgccgucuaccacugcgugcgcagcgggggcgacauccuguacuacuacgaguggcagaagccccacugguucuccccgugggggcccggcauccacgugacggucagcucc

SEQ ID NO: 8876 - RNA, 330 nt, Artificial Sequence
  derived and/or modified sequence opt1 from anti-HIV_PGT131_LightChain
cagagcgcccugacccagcccccguccgccagcggcucccucgggcagagccugaccaucuccugcagcggcacgggguccgacaucggcagcuggaacuucguguccugguaccagcaguuccccgggcgcgcgcccaaccugaucaucuucgaggucaaccggcgccggagcggcgugcccgaccgcuucuccggcagcaaguccgggaacaccgccagccucaccguguccggccugcggagcgaggacgaggccgaguacuucugcuccagccuguccgggcgcugggacaucgucuucggcgggggcaccaaggugacggugcuc

SEQ ID NO: 8877 - RNA, 387 nt, Artificial Sequence
  derived and/or modified sequence opt1 from anti-HIV_PGT131_HeavyChain
caggugcagcugcaggagagcggccccgggcucgucaagccguccgagacccugagccugaccugcacgguguccggcgacagcaucaacaccgggcaccacuacuggggcugggugcgccagguccccgggaagggccccgaguggaucgcccacauccacuacaacaccgccgugcuccacaaccccgcgcugaagucccgggugaccaucagcaucuucacgcugaagaaccucaucacccugucccugagcaacgucaccgccgccgacaccgccguguacuucugcgugcgcuccggcggggacauccucuacuacaucgaguggcagaagccgcacugguucuaccccuggggccccgggauccuggucacggugagcucc

SEQ ID NO: 8878 - RNA, 321 nt, Artificial Sequence
  derived and/or modified sequence opt1 from anti-HIV_PGT135_LightChain
gagaucgugaugacccagagccccgacacccuguccgucagcccgggcgagacggugacccucuccugccgcgccagccagaacaucaacaagaaccuggccugguaccaguacaagcccgggcagagcccccggcuggugaucuucgagaccuacuccaagaucgcggccuuccccgcccgcuucgucgccuccggcagcgggaccgaguucacgcucaccaucaacaacaugcaguccgaggacguggccguguacuacugccagcaguacgaggaguggccgcggaccuucggccaggggaccaaggucgacaucaag

SEQ ID NO: 8879 - RNA, 399 nt, Artificial Sequence
  derived and/or modified sequence opt1 from anti-HIV_PGT135_HeavyChain
cagcugcagaugcaggagagcggccccgggcucgugaagccguccgagacccugagccuguccugcaccgucagcggcgacuccauccgcgggggcgaguggggcgacaaggacuaccacugggggugggugcggcacagcgccggcaaggggcucgaguggaucggcuccauccacuggcgcgggacgacccacuacaaggagagccugcggcgccggguguccaugagcaucgacaccucccgcaacugguucagccugcggcucgccuccgucaccgcggccgacacggccguguacuucugcgcccgccaccggcaccacgacguguucaugcugguccccaucgccggcugguucgacgugugggggcccggcgugcaggucaccgugagcucc

SEQ ID NO: 8880 - RNA, 321 nt, Artificial Sequence
  derived and/or modified sequence opt1 from anti-HIV_PGT136_LightChain
gagaucgugaugacccagagcccgcccacccuguccgucagccccggcgagacggccacccucuccugccgcgccagccagaacgugaagaacaaccuggccugguaccagcugaagcccgggcaggcgccccggcuccugaucuucgacgccuccagccgcgccggcgggaucccggaccgguucuccggcagcggguacggcaccgacuucacccugacggugaacuccguccagagcgaggacuucggcgacuacuucugccagcaguacgaggaguggccccgcaccuucgggcagggcaccaagguggacaucaag

SEQ ID NO: 8881 - RNA, 402 nt, Artificial Sequence
  derived and/or modified sequence opt1 from anti-HIV_PGT136_HeavyChain
cagcugcagcuccaggagagcggccccgggcuggugaagccguccgagacccugagccugaccugcacggucuccggcgggagcaugcgcggcaccgacuggggcgagaacgacuuccacuacggguggauccggcaguccagcgccaagggccucgaguggaucggguccauccacuggcgcggccggaccacccacuacaagacgagcuuccgcucccgggccacccugagcaucgacaccuccaacaaccgcuucagccucaccuucuccuucgugacggcggccgacaccgccguguacuacugcgcccggcacaaguaccacgacaucuuccgcgucgugcccguggccgggugguucgaccccuggggccaggggcugcuggucaccgugagcucc

SEQ ID NO: 8882 - RNA, 321 nt, Artificial Sequence
  derived and/or modified sequence opt1 from anti-HIV_PGT137_LightChain
gagaucaugaugacccagagccccgccauccuguccgugagcccgggcgaccgcgccacccucuccugccgggcgagccaguccgucaagaacaaccuggccugguaccagaagcgccccgggcaggcgccccggcugcucaucuucgacacgagcucccgcgccagcggcauccccgcccgguucuccgggggcgggagcggcaccgaguucacccugaccgugaacuccaugcagagcgaggacuucgccacguacuacugccagcaguacgaggaguggccgcgcaccuucggccaggggaccaagguggagaucaag

SEQ ID NO: 8883 - RNA, 399 nt, Artificial Sequence
  derived and/or modified sequence opt1 from anti-HIV_PGT137_HeavyChain
gaggugcaccuggaggagagcggccccgggcugguccgcccguccgagacccugagccugaccugcacggccuccggcgggagcauccggggcggggaguggggcgacuccgacuaccacuggggcugggugcgccacagccccgagaaggggcucgaguggaucggcuccauccacuggcgggggaccacccacuacaacgcccccuuccgcggccgggggcgccugagcaucgaccugucccggaaccaguucagccuccgccugaccuccgugacggcggaggacaccgccgucuacuacugcgugaagcacaaguaccacgacaucgugauggucgugcccaucgccggcugguucgacccguggggccaggggcuccaggugaccgucagcucc

SEQ ID NO: 8884 - RNA, 336 nt, Artificial Sequence
  derived and/or modified sequence opt1 from anti-HIV_PGT141_LightChain
gacaccguggucacccagagcccccugucccucccggugacgcccggcgaggccgccagcauguccugcagcuccacccagagccugcgccacuccaacggggcgaacuaccuggccugguaccagcacaagcccggccagagcccccggcuccugauccgccuggggucccagcgggccagcggcgugccggaccgcuucuccgggagcggcuccggcacccacuucacccucaagaucagccgggucgaggccgaggacgccgcgaucuacuacugcaugcaggggcugaaccgccccuggacguucggcaaggggaccaagcuggagaucaag

SEQ ID NO: 8885 - RNA, 423 nt, Artificial Sequence
  derived and/or modified sequence opt1 from anti-HIV_PGT141_HeavyChain
caggugcagcugguccagagcggccccgaggugaagaagccgggguccagcgugaaggucuccugcaaggccagcggcaacaccuucuccaaguacgacgugcacugggugcgccaggccaccgggcagggccucgagugggucggguggaugagccacgagggcgacaagacggaguccgcgcagcgguucaagggccgcgugaccuucacccgggacaccagcgccuccacggccuacauggagcugcgcgggcugaccagcgacgacaccgccaucuacuacugcacccggggcuccaagcaccgccuccgggacuacgugcuguacgacgacuacgggcugaucaacuaccaggaguggaacgacuaccucgaguuccuggacgucuggggccacgggacggccgugaccgugagcucc

SEQ ID NO: 8886 - RNA, 336 nt, Artificial Sequence; identical to SEQ ID NO: 8884
  derived and/or modified sequence opt1 from anti-HIV_PGT142_LightChain

SEQ ID NO: 8887 - RNA, 423 nt, Artificial Sequence
  derived and/or modified sequence opt1 from anti-HIV_PGT142_HeavyChain
caggugcagcugguccagagcggccccgaggugaagaagccgggguccagcgugaaggucuccugcaaggccagcggcaacaccuucuccaaguacgacgugcacugggugcgccaggccaccgggcagggccucgagugggucggguggaucagccacgagcgggacaagacggaguccgcgcagcgcuucaagggccgggugaccuucacccgcgacaccagcgccacgaccgccuacauggagcugcggggccugaccuccgacgacaccgccaucuacuacugcacgcgcgggagcaagcaccggcuccgcgacuacgugcuguacgacgacuacggccugaucaacuaccaggaguggaacgacuaccucgaguuccuggacgucugggggcacggcaccgccgugaccguguccagc

SEQ ID NO: 8888 - RNA, 336 nt, Artificial Sequence
  derived and/or modified sequence opt1 from anti-HIV_PGT143_LightChain
gacaccguggucacccagagcccccugucccucccggugacgcccggcgaggccgccagcauguccugcaccagcacccagucccugcgccacagcaacggggcgaacuaccuggccugguaccagcacaagcccggccagagcccccggcuccugauccgccuggggucccagcgggccuccggcgugccggaccgcuucagcggguccggcagcggcacccacuucacgcucaagaucucccgggucgagcccgaggacgccgccaucuacuacugcaugcaggggcugaaccgccccuggaccuucggcaaggggaccaagcuggagaucaag

SEQ ID NO: 8889 - RNA, 423 nt, Artificial Sequence
  derived and/or modified sequence opt1 from anti-HIV_PGT143_HeavyChain
caggugcagcuggagcagagcggcgccgaggucaagaagcccggguccagcgugaagguguccugcaaggccagcggcaacaccuucuccaaguacgacguccacugggugcgccaggcgaccgggcagggccucgagugggugggguggaugagccacgagggcgacaagacggaguccgcccagcgguucaagggccgcgucaccuucacccgggacaccagcgccuccacggccuacauggagcugcgcgggcugaccagcgacgacaccgccaucuacuacugcacccggggcuccaagcaccgccuccgggacuacgugcuguacgacgacuacgggcugaucaacuaccaggaguggaacgacuaccucgaguuccuggacguguggggccacgggacggcggucaccgugagcucc

SEQ ID NO: 8890 - RNA, 336 nt, Artificial Sequence
  derived and/or modified sequence opt1 from anti-HIV_PGT144_LightChain
gacaccguggucacccagagcccccugucccucagcgugacgccgggcgaggccgccuccaugagcugcaccuccacccagagccugcgccacuccaacggggcgaacuaccuggccugguaccagcacaagcccggccagagcccccggcuccugauccgccuggggucccagcgggccagcggcgugcccgaccgcuucuccgggagcggcuccggcacccacuucacgcucaagaucagccgggucgaggccgacgacgccgcgaucuacuacugcaugcaggggcugaaccgcccguggaccuucggcaaggggaccaagcuggagaucaag

SEQ ID NO: 8891 - RNA, 423 nt, Artificial Sequence
  derived and/or modified sequence opt1 from anti-HIV_PGT144_HeavyChain
caggugcagcugguccagagcggcgccgaggugaagaagcccggguccagcgugaaggucuccugcaaggccagcggcaacaccuuccgcaaguacgacgugcacugggugcggcaggcgaccgggcagggccucgagugggucggguggaugucccacgagggcgacaagacggagagcgcccagcgcuucaagggccggguguccuucacccgcgacaacagcgccuccaccgccuacaucgagcugcgggggcugaccagcgacgacacggccaucuacuacugcaccggcggguccaagcaccgccuccgggacuacgugcuguacgacgacuacggccugaucaaccagcaggaguggaacgacuaccucgaguuccuggacgucugggggcacggcaccgcggugaccgugagcucc

SEQ ID NO: 8892 - RNA, 336 nt, Artificial Sequence
  derived and/or modified sequence opt1 from anti-HIV_PGT145_LightChain
gagguggucaucacccagagcccccuguuccucccggugacccccggcgaggccgccucccugagcugcaagugcucccacagccugcagcacuccacgggggcgaacuaccucgccugguaccugcagcgccccggccagacgccccggcugcucauccaccuggccacccaccgcgccagcggggugccggaccgguucuccggcagcggguccggcaccgacuucacccugaagaucagccgcgucgaguccgacgacgugggcaccuacuacugcaugcaggggcuccacagccccuggaccuucggccaggggaccaagguggagaucaag

SEQ ID NO: 8893 - RNA, 420 nt, Artificial Sequence
  derived and/or modified sequence opt1 from anti-HIV_PGT145_HeavyChain
caggugcagcugguccagagcggcgccgaggugaagaagcccggguccagcgugaaggucuccugcaaggccagcggcaacuccuucagcaaccacgacgugcacugggugcgccaggcgaccgggcagggccucgaguggaugggguggaugucccacgagggcgacaagaccggccuggcccagaaguuccaggggcgggucacgaucacccgcgacagcggcgccuccaccguguacauggagcugcgggggcucaccgccgacgacacggccaucuacuacugccugaccggcagcaagcaccgccugcgggacuacuuccucuacaacgaguacgggccgaacuacgaggaguggggcgacuaccuggcgacccuggacguguggggccacgggaccgccgucacgguguccagc

SEQ ID NO: 8894 - RNA, 657 nt, Artificial Sequence
  derived and/or modified sequence opt1 from anti-HIV_PGT151_LightChain
gacaucgugaugacccagacgccccugagccucuccgucaccccgggccagcccgccagcaucuccugcaagagcuccgagagccugcgccaguccaacgggaagaccagccuguacugguaccggcagaagcccggccagagcccccagcuccugguguucgagguguccaaccgcuucuccggggucagcgaccgguucgugggcuccgggagcggcaccgacuucacccugcgcaucucccggguggaggccgaggacgucggcuucuacuacugcaugcagagcaaggacuucccgcucacguucgggggcgggaccaagguggaccugaagcgcaccguggcggcccccuccgucuucaucuucccgcccagcgacgagcagcugaaguccggcaccgccagcguggugugccuccugaacaacuucuacccccgggaggccaagguccaguggaagguggacaacgcccugcagagcgggaacucccaggagagcgugacggagcaggacuccaaggacagcaccuacucccucagcuccacccugacccugagcaaggcggacuacgagaagcacaaggucuacgccugcgaggugacgcaccagggccucuccagccccgugaccaaguccuucaaccgcggcgagugc

SEQ ID NO: 8895 - RNA, 720 nt, Artificial Sequence
  derived and/or modified sequence opt1 from anti-HIV_PGT151_HeavyChain
cgcgugcagcuggucgagagcggcgggggcguggugcagcccgggaaguccguccggcucagcugcgugguguccgacuucccguucagcaaguaccccauguacuggguccgccaggcccccggcaaggggcuggaguggguggccgcgaucuccggcgacgccuggcacguggucuacagcaacuccgugcagggccgguuccuggugagccgcgacaacgucaagaacacccucuaccuggagaugaacucccugaagaucgaggacaccgccguguaccggugcgcccgcauguuccaggagagcgggcccccgcggcucgaccgcugguccggccggaacuacuacuacuacagcgggauggacguguggggccaggggacgaccgucaccguguccagcgccuccaccaagggccccagcguguucccccuggcgcccuccagcaaguccacgagcggcgggaccgccgcccugggcugccucgucaaggacuacuucccggagcccgugaccgugagcuggaacuccggggcccugaccagcggcguccacacguuccccgcggugcugcaguccagcggccucuacucccugagcuccguggucaccgugcccagcuccagccuggggacccagaccuacaucugcaacgucaaccacaagccguccaacacgaagguggacaagcgcguggagcccaagagcugcgacaag

SEQ ID NO: 8896 - RNA, 657 nt, Artificial Sequence
  derived and/or modified sequence opt1 from anti-HIV_PGT152_LightChain
gacaucgugaugacccagacgccccugagccucuccgucgacccgggccagcccgccagcaucuccugcaagagcucccagagccugcgccaguccaacgggaagaccagccuguacugguaccagcagaagcccggccagagcccccagcuccugaucuucgagguguccaaccgguucuccggggugagcgaccgcuucgucggcuccgggagcggcaccgacuucacccugcggaucucccgcguggaggccgaggacgugggcuucuacuacugcaugcagagcaaggacuucccgcucaccuucgggggcgggacgaaggucgaccugaagcggaccguggcggcccccuccguguucaucuucccgcccagcgacgagcagcugaaguccggcaccgccagcgucgugugccuccugaacaacuucuacccccgcgaggccaaggugcaguggaaggucgacaacgcccugcagagcgggaacucccaggagagcgugaccgagcaggacuccaaggacagcacguacucccucagcuccacccugacccugagcaaggcggacuacgagaagcacaagguguacgccugcgaggucacccaccagggccucuccagccccgugacgaaguccuucaaccggggcgagugc

SEQ ID NO: 8897 - RNA, 720 nt, Artificial Sequence
  derived and/or modified sequence opt1 from anti-HIV_PGT152_HeavyChain
cgcgugcagcuggucgagagcggcgggggcguggugcagcccgggaaguccguccggcucagcugcgugguguccgacuucccguucagcaaguaccccauguacuggguccgccaggcccccggcaaggggcuggaguggguggccgcgaucuccgccgacgccuggcacguggucuacagcggcuccgugcagggccgguuccuggugagccgcgacaacuccaagaacauccucuaccuggagaugaacacccugaagaucgaggacaccgccgucuaccggugcgcccgcauguuccaggagagcgggcccccgcgguucgacuccuggagcggccgcaacuacuacuacuacuccgggauggacguguggggccaggggacgaccgugaccgucagcuccgcgagcaccaagggccccuccguguucccccucgcccccagcuccaagagcacgagcggcgggaccgccgcccugggcugccuggugaaggacuacuucccggagcccgucaccguguccuggaacagcggggcgcucaccuccggcgugcacacguuccccgccguccugcagagcuccggccuguacagccucuccagcguggugaccguccccuccagcucccuggggacccagaccuacaucugcaacgugaaccacaagccgagcaacacgaaggucgacaagcggguggagcccaaguccugcgacaag

SEQ ID NO: 8898 - RNA, 309 nt, Artificial Sequence
  derived and/or modified sequence opt1 from anti-HIV_VRC-CH30_LightChain
gacauccagaugacccagagccccuccagccuguccgccagccucggcgaccgcgugaccaucacgugccaggccucccgggggaucggcaaggaccugaacugguaccagcagaagccggggaaggcgcccaagcugcucgucagcgacgccuccauccuggagggcggggugcccagccgcuucuccggcagcggcuuccaccagaacuucucccugaccaucagcucccuccagcccgaggacguggccaccuacuucugccagcaguacgagaccuucgggcagggcacgaaggucgacaucaag

SEQ ID NO: 8899 - RNA, 393 nt, Artificial Sequence
  derived and/or modified sequence opt1 from anti-HIV_VRC-CH30_HeavyChain
caggugcagcugguccagagcggcgccgccgugcgcaagcccggggcguccgugaccgucagcugcaaguucgccgaggacgacgacuacuccccgcacugggugaaccccgcccccgagcacuacauccacuuccuccggcaggcccccggccagcagcuggaguggcuggccuggaugaacccgaccaacggggcggugaacuacgccuggcagcuccacggccgccugacggccacccgggacgggagcaugaccaccgccuuccuggagguccgcucccuccggagcgacgacacggcgguguacuacugcgcccgcgcccagaagcggggccgcuccgagugggccuacgcccacuggggccaggggacccccguggcggucagcucc

SEQ ID NO: 8900 - RNA, 309 nt, Artificial Sequence
  derived and/or modified sequence opt1 from anti-HIV_VRC-CH31_LightChain
gacauccagaugacccagagccccuccagccuguccgccagccucggcgaccgcgugaccaucacgugccaggccucccgggggaucggcaaggaccugaacugguaccagcagaaggcggggaaggccccgaagcugcucgucagcgacgccuccacccuggagggcggggugcccagccgcuucuccggcagcggcuuccaccagaacuucucccugaccaucagcucccuccaggccgaggacguggccaccuacuucugccagcaguacgagacguucgggcagggcaccaaggucgacaucaag

SEQ ID NO: 8901 - RNA, 393 nt, Artificial Sequence
  derived and/or modified sequence opt1 from anti-HIV_VRC-CH31_HeavyChain
caggugcagcugguccagagcggcgccgccgugcgcaagcccggggcguccgugaccgucagcugcaaguucgccgaggacgacgacuacuccccguacugggugaaccccgcccccgagcacuucauccacuuccuccggcaggcccccggccagcagcuggaguggcuggccuggaugaacccgaccaacggggcggugaacuacgccugguaccucaacggccgcgucacggccacccgggaccgcagcaugaccaccgccuuccuggaggugaagucccugcggagcgacgacacggcgguguacuacugcgcccgcgcccagaagcgggggcgcuccgagugggccuacgcccacuggggccagggcacccccgucguggugagcucc

SEQ ID NO: 8902 - RNA, 309 nt, Artificial Sequence
  derived and/or modified sequence opt1 from anti-HIV_VRC-CH32_LightChain
gacauccagaugacccagagccccuccagccuguccgccagccucggcgaccgcgugaccaucacgugccaggccucccgggggaucggcaaggaccugaacugguaccagcagaagccggggcgcgcgcccaagcugcucgucagcgacgccuccauccuggagggcggggugcccacccgguucagcggcuccggcuuccaccagaacuucagccugaccaucuccagccuccaggccgaggacguggccaccuacuucugccagcaguacgagacguucgggcagggcaccaaggucgacaucaag

SEQ ID NO: 8903 - RNA, 393 nt, Artificial Sequence
  derived and/or modified sequence opt1 from anti-HIV_VRC-CH32_HeavyChain
caggugcagcugguccagagcggcgccgccgugcgcaagcccggggcguccgugaccgucagcugcaaguucgccgaggacgacgacuucuccccgcacugggugaaccccgcccccgagcacuacauccacuuccuccggcaggcccccggccagcagcuggaguggcuggccuggaugaagccgaccaacggggcggugaacuacgccuggcagcuccagggccgcgucacggugacccgggaccgcagccagaccaccgccuuccuggaggugaagaaccugcgguccgacgacacggccgucuacuacugcgcgcgcgcccagaagcgggggcgcagcgagugggccuacgcccacuggggccagggcacccccguggugaucuccgcc

SEQ ID NO: 8904 - RNA, 309 nt, Artificial Sequence
  derived and/or modified sequence opt1 from anti-HIV_VRC-CH33_LightChain
gacauccagaugacccagagccccuccagccuguccgccagccucggcgaccgcgugaccaucacgugccaggccucccgggggaucggcaaggaccugaacugguaccagcagaagcgcgggcgggcgccgcgccugcucgucagcgacgccuccgugcuggagggcggggugcccagccgguucuccggcagcggcuuccaccagaacuucucccugaccaucagcacccuccagcccgaggacgucgccaccuacuucugccagcaguacgagacguucgggcagggcaccaagguggacaucaag

SEQ ID NO: 8905 - RNA, 393 nt, Artificial Sequence
  derived and/or modified sequence opt1 from anti-HIV_VRC-CH33_HeavyChain
caggugcagcugguccagagcggcgccgccgugcgcaagcccggggcguccaucagcguguccugcaaguucgccgacgccgacgacuacagcccgcacuggaugaaccccgcccccgagcacuacauccacuuccuccggcaggcccccggccagcagcuggaguggcuggcguggaugaacccgaccaacggggccgucaacuacgccugguaccucaacggccgcgugaccgccacgcgggaccgcuccaugaccaccgcguuccuggaggugcggagccugcgcuccgacgacaccgccgucuacuacugcgcccgggcccagaagcgcgcccggagcgagugggcguacgcccacugggggcagggcacgcccgugguggucuccagc

SEQ ID NO: 8906 - RNA, 309 nt, Artificial Sequence
  derived and/or modified sequence opt1 from anti-HIV_VRC-CH34_LightChain
gacauccagaugacccagagccccuccagccuguccgccagccucggcgaccgcgugaccaucacgugccaggccucccgggggaucggcaaggaccugaacugguaccagcagaaggcggggaaggccccgaagcugcucgucagcgacgccuccauccuggagggcggggugcccagccgcuucuccggcagcggcuuccaccagaacuucucccugaccaucagcucccuccagcccgaggacguggccaccuacuucugccagcaguacgagaccuucgggcagggcacgaaggucgacaucaag

SEQ ID NO: 8907 - RNA, 393 nt, Artificial Sequence
  derived and/or modified sequence opt1 from anti-HIV_VRC-CH34_HeavyChain
caggugcagcugguccagagcggcgccgccgugcgcaagcccggggcguccgugaccgucagcugcaaguucgccgaggacgacgacugguccccgcacugggugaaccccgcccccgagcacuacauccacuuccuccggcaggcccccggccagcagcuggaguggcuggccuggaugaacccgaccaacggggcggugaacuacgccuggcagcucaacggccgccugacggccacccgggacaccagcaugaccacggccuuccuggaggucaagucccuccgcagcgacgacaccgcgguguacuacugcgcccgggcccagaagcgcgggcgguccgagugggccuacgcccacuggggccagggcacccccguggucgugagcucc

SEQ ID NO: 8908 - RNA, 306 nt, Artificial Sequence
  derived and/or modified sequence opt1 from anti-HIV_VRC-PG04_LightChain
gagaucgugcugacccagagccccggcacccucucccugagcccgggggagacggccucccugagcugcaccgccgcguccuacggccacaugaccugguaccagaagaagcccgggcagccgcccaagcuccugaucuucgccaccagcaagcgcgccuccggcauccccgaccgguucagcgggucccaguucggcaagcaguacacgcugaccaucacccgcauggagcccgaggacuucgcccgguacuacugccagcagcucgaguucuucggccaggggacccgccuggagauccggcgc

SEQ ID NO: 8909 - RNA, 375 nt, Artificial Sequence
  derived and/or modified sequence opt1 from anti-HIV_VRC-PG04_HeavyChain
caggugcagcugguccagagcggcuccggggugaagaagcccggcgccagcgugcgcgucuccugcuggaccagcgaggacaucuucgagcggaccgagcucauccacugggugcgccaggccccggggcagggccuggaguggaucgggugggugaagacggucaccggcgcggugaacuucggcucccccgacuuccggcagcgcgugagccugacccgggaccgcgaccucuucaccgcccacauggacauccgggggcugacgcagggcgacaccgccaccuacuucugcgcccgccagaaguucuacaccgggggccaggggugguacuucgaccuguggggccggggcacgcucaucgucguguccagc

SEQ ID NO: 8910 - RNA, 303 nt, Artificial Sequence
  derived and/or modified sequence opt1 from anti-HIV_VRC-PG04b_LightChain
gagaucgugcugacccagagccccggcacccucucccugagcccgggggagacggccucccugagcugcaccgccgcguccuacggccacaugaccugguaccagaagaagcccgggcagccgcccaagcuccugaucuucgccaccagcaagcgcgccuccggcauccccgaccgguucagcgggucccaguucggcaagcaguacacgcugaccaucacccgcauggagcccgaggacuucgccggcuacuacugccagcaggucgaguucuucgggcagggcacccggcucgagauccgc

SEQ ID NO: 8911 - RNA, 375 nt, Artificial Sequence
  derived and/or modified sequence opt1 from anti-HIV_VRC-PG04b_HeavyChain
caggugcagcugguccagagcggcuccggggugaagaagcccggcgccagcgugcgcgucuccugcuggaccagcgaggacaucuucgagcggaccgagcucauccacugggugcgccaggccccggggcagggccuggaguggaucgggugggugaagacggucaccggcgcggugaacuucggcucccccaacuuccggcaccgcgugagccugacccgggaccgcgaccucuucaccgcccacauggacauccgggggcugacgcagggcgacaccgccaccuacuucugcgcccgccagaaguucgagcgcgggggccaggggugguacuucgaccuguggggccggggcacccucaucgucguguccagc

SEQ ID NO: 8912 - RNA, 612 nt, Artificial Sequence
  derived and/or modified sequence opt1 from anti-HIV_VRC-PG20_LightChain
cagagcgcccugacccagcccccguccgugagcggcucccccgggcagagcaucacccucuccugcacgggcgccagcaccuccgucgcgugguaccagcaguacgccgacaaggcgccccgccugaucguguucgacgggaacaagcggcccagcgacaucuccagccgcuucuccggcagccaguccgggggcaccgccagccugaccaucuccggccuccagagcgaggacgaggccuacuaccacugcaacgccuucgaguucuucgggggcgggacgaagcugaccgugcugucccagccgaaggccgcccccagcgucacccucuucccgcccuccagcgaggagcugcaggccaacaaggcgacccuggugugccucaucagcgacuucuaccccggcgccgugacggucgccuggaaggccgacuccagccccgugaaggccgggguggagaccaccacccccuccaagcagagcaacaacaaguacgcggccuccagcuaccugucccugacgcccgagcaguggaagucccacaagagcuacagcugccaggucacccacgagggcuccaccguggagaagaccguggccccgacggagugc

SEQ ID NO: 8913 - RNA, 681 nt, Artificial Sequence
  derived and/or modified sequence opt1 from anti-HIV_VRC-PG20_HeavyChain
gaggugcaccugaugcagagcggcaccgagaugaagaagcccggggccuccguccgcgugaccugccagacgagcggcuacaccuucuccgacuacuucauccacuggcuccgccaggugccggggcggggcuucgaguggaugggguggaugaacccccaguggggccaggucaacuacgcccggaccuuccagggccgcgugaccaugacgcgggacguguaccgcgaggucgcguaccuggaccugcggagccucaccuucgccgacaccgccguguacuucugcgcccgccggaugcgcucccaggaccgggagugggacuuccagcacugggggcagggcacccgcaucaucgugagcuccgccagcacgaaggggcccuccgucuucccccuggcgccgagcuccaagagcaccuccggcgggaccgccgcccugggcugccucgugaaggacuacuuccccgagcccgugaccgucagcuggaacuccggcgcccugacgagcggggugcacaccuuccccgcggugcugcaguccagcggccucuacucccugagcagcgucgugaccgugccguccagcucccuggggacccagacguacaucugcaacgucaaccacaagcccagcaacaccaagguggacaagaagguggagcccaaguccugcgacaag

SEQ ID NO: 8914 - RNA, 1059 nt, Artificial Sequence
  derived and/or modified sequence opt1 from anti-HIV_VRC-PG20_G-Chain
guguggaaggacgccgacaccacccuguucugcgccagcgacgcgaaggcccacgagacggagguccacaacgugugggccacccacgccugcgugcccaccgaccccaacccccaggagauccaccucgagaacgucaccgagaacuucaacauguggaagaacaacaugguggagcagaugcaggaggacgugaucucccugugggaccagagccugcagcccugcgucaagcucacgggcggguccgugaucaagcaggccugccccaagaucagcuucgacccgauccccauccacuacugcacccccgcgggcuacgugauccugaagugcaacgacaagaacuucaacgggaccggccccugcaagaacgucuccagcgugcagugcacccacgggaucaagccgguggucuccacgcagcugcuccugaacggcagccuggccgaggaggagaucaucauccgcuccgagaaccucaccaacaacgccaagaccaucaucgugcaccugaacaagagcguggagaucaacugcacccggcccuccaacggcgggagcggcuccgggggcgacauccgcaaggccuacugcgagaucaacgggacgaaguggaacaagguccugaagcaggucaccgagaagcucaaggagcacuucaacaacaagaccaucaucuuccagccgcccagcggcggcgaccuggagaucaccaugcaccacuucaacugccgcggggaguucuucuacugcaacacgacccagcuguucaacaacacgugcaucggcaacgagaccaugaaggggugcaacggcaccaucacccuccccugcaagaucaagcagaucaucaacauguggcagggcaccgggcaggcgauguacgccccgcccaucgacggcaagaucaacugcguguccaacaucaccgggauccugcugacgcgggacggcggggccaacaacaccagcaacgagaccuuccggcccggcggcgggaacaucaaggacaacuggcgcuccgagcucuacaaguacaagguggugcagaucgag

SEQ ID NO: 8915 - RNA, 312 nt, Artificial Sequence
  derived and/or modified sequence opt1 from anti-HIV_VRC02_LightChain
gagaucgugcugacccagagccccggcacccucucccugagcccgggggagacggccaucaucuccugccgcaccagccaguacggcucccuggccugguaccagcagcggcccgggcaggcgccccgccucgugaucuacagcggcuccacccgggccgccgggauccccgaccgcuucagcggcucccgguggggcccggacuacaaccugaccauccgcaaccuggagagcggggacuucggccucuacuacugccagcaguacgaguucuucgggcagggcacgaagguccagguggacaucaagcgg

SEQ ID NO: 8916 - RNA, 363 nt, Artificial Sequence
  derived and/or modified sequence opt1 from anti-HIV_VRC02_HeavyChain
caggugcagcugguccagagcggcgggcagaugaagaagcccggcgaguccaugcgcaucagcugccaggccuccggguacgaguucaucgacugcacccucaacugggugcggcuggccccgggccgccggcccgaguggaugggguggcugaagccccgcggcggcgcggugaacuacgcccggccccuccaggggcgcgucaccaugacgcgggacguguacagcgacaccgccuuccuggagcugcgcucccucaccgccgacgacaccgccguguacuacugcacgcggggcaagaacugcgacuacaacugggacuucgagcacugggggcgcggcaccccggucaccgugagcucc

SEQ ID NO: 8917 - RNA, 309 nt, Artificial Sequence
  derived and/or modified sequence opt1 from anti-HIV_VRC03_LightChain
gagaucgugcugacccagagccccggcauccucucccugagcccgggggagaccgccacgcuguucugcaaggccucccagggcgggaacgcgaugaccugguaccagaagcgccggggccaggucccccgccuccugaucuacgacaccagccggcgcgccuccggggugcccgaccgguucgugggcagcggcuccgggaccgacuucuuccugacgaucaacaagcucgaccgcgaggacuucgccgucuacuacugccagcaguucgaguucuucggccuggggagcgagcuggaggugcaccgg

SEQ ID NO: 8918 - RNA, 390 nt, Artificial Sequence
  derived and/or modified sequence opt1 from anti-HIV_VRC03_HeavyChain
caggugcagcugguccagagcggcgccgugaucaagacccccggguccagcgugaagaucuccugccgcgccagcggcuacaacuuccgggacuacuccauccacuggguccgccucaucccggacaagggguucgaguggaucggcuggaucaagccccuguggggcgcggugagcuacgcccggcagcugcaggggcgcguguccaugacccggcagcucagccaggaccccgacgaccccgacuggggcgucgccuacauggaguucuccgggcugacgccggccgacaccgccgaguacuucugcgugcgccggggcagcugcgacuacugcggggacuuccccuggcaguacuggggccaggggaccguggucgugguguccagc

SEQ ID NO: 8919 - RNA, 630 nt, Artificial Sequence
  derived and/or modified sequence opt1 from anti-HIV_VRC23_LightChain
gagaucgugaugacccagagccccgucaccguguccgugagccggggcgggacggccacccuguccugccgggccagccagggcgucggguccgacguggcgugguaccagcacaagccgggccagacgccccgccuccugaucuacggggccagcacccgggccuccggcgugcccgagcgcuucagcggcuccggguuccacgucgacuucacccugagcaucuccggccuccagcccgaggacguggccaucuacuacugccagcaguacgagaccuucgggcagggcaccaagguggagaucaagcggaccgucgccgcgccgagcguguucaucuucccgcccuccgacgagcagcucaagagcgggacggccuccguggucugccugcugaacaacuucuacccccgcgaggccaaggugcaguggaagguggacaacgcccugcagagcggcaacucccaggagagcgucaccgagcaggacuccaaggacagcaccuacagccuguccagcacccucacgcuguccaaggcggacuacgagaagcacaagguguacgccugcgaggugacccaccagggccugagcucccccgucaccaagagcuucaaccgcggggagugc

SEQ ID NO: 8920 - RNA, 672 nt, Artificial Sequence
  derived and/or modified sequence opt1 from anti-HIV_VRC23_HeavyChain
gaggugcaguucguccagagcggcgccgaggugaagaagcccggggccuccgugcgcgucagcugcgaggcguccggcuacagcuucaccgacuacgugcugcaguggauccggcaggccccggggcagcgccccgaguggaugggcuggaucaagcccgagcgcggggccguguccuacgcgccccaguuccagggccggcucacccugacgcgggaccuguacaccgagaccgccuacaugcacuucaagaaccuccgcagcgacgacaccgccaucuacuacugcgcccggggcguccgccgggacgccuccugguggcugcaguucugggggcagggcacgcuggugaccgugagcuccgccagcaccaaggggccguccgucuucccccucgcgcccagcuccaagagcaccuccggcgggacggccgcccugggcugccuggugaaggacuacuuccccgagccggugaccgucagcuggaacuccggcgcccucaccagcggggugcacaccuuccccgccgugcugcaguccagcggccuguacagccucuccagcgucgugacggugcccuccagcucccuggggacccagaccuacaucugcaacgucaaccacaagcccagcaacaccaagguggacaagaagguggagccgaaguccugc

SEQ ID NO: 8921 - RNA, 1077 nt, Artificial Sequence
  derived and/or modified sequence opt1 from anti-HIV_VRC23_G-Chain
guguggcgcgacgccgacaccacccuguucugcgccagcgacgccaaggccuacgagacggagaagcacaacgucugggccacccacgccugcgugcccaccgacccgaacccccaggagauccaccucgacaacgugaccgagaaguucaacauguggaagaacaacauggucgagcagaugcacacggacaucaucucccugugggaccagagccugaagcccugcgugaagcucaccggcggguccgccaucacccaggcgugccccaaggugagcuucgagccgauccccauccacuacugcacccccgccggcuucgccauccugaagugcaaggacgagggguucaacggcacggggcugugcaagaacgucuccaccgugcagugcacccacggcaucaagcccguggucagcacccagcuccugcugaacggcucccucgccgagaagaacaucacgauccggagcgagaacaucaccaacaacgcgaagaucaucaucgugcagcuggugcagccggucaccaucaagugcauccgccccaacaacgggggcuccgggagcggcggggacauccggcaggcccacugcaacgugacccgcucccgguggaacaagacgcugcaggagguggccgagaagcuccgcaccuacuucggcaacaagaccaucaucuucgccaacagcuccggcggggaccuggagaucaccacgcacagcuucaacugcggcggggaguucuucuacugcaacaccuccggccuguucaacagcaccugguacgucaacuccaccuggaacgacacggacagcacccaggaguccaacgacaccaucacccuccccugccggaucaagcagaucaucaacauguggcagcgcgccggccaggcgauguacgcgcccccgauccccggggugaucaagugcgagagcaacaucacgggccugcugcucacccgggacgggggcaaggacaacaacgugaacgagaccuuccgccccgggggcggcgacaugcgggacaacuggcgcagcgagcuguacaaguacaaggucguggagaucgag

SEQ ID NO: 8922 - RNA, 648 nt, Artificial Sequence
  derived and/or modified sequence opt1 from anti-HIV_5CCK_LightChain
cagagcgcccugacccagcccgccuccgugagcgcguccccgggccagagcaucaccaucuccugcagcgggacgcgcuccgacgucggcggguacgacuucgugagcugguaccagcagcaccccggcaaggugcccaagcucaucaucuacgaggucaccaagcggcccuccgggaucccgcagcgcuucagcggcuccaagagcggcaacaccgccucccugaccaucagcgggcugcaggccgacgacgaggccgacuacuacugcugcuccuacgccaacuacgacaagcucauccugggcgggggcacgaagcugaccgugcucgggcagcccaaggcgaaccccaccgugacccuguucccgcccagcuccgaggagcugcaggccaacaaggccacgcucgucugccugaucagcgacuucuaccccggcgccgugaccguggcguggaaggccgacggcucccccgucaaggccgggguggagaccaccaagcccagcaagcagagcaacaacaaguacgccgccuccagcuaccugucccucacgccggagcaguggaagucccaccggagcuacagcugccaggugacccacgagggcuccaccgucgagaagaccguggcgcccacggagugcagc

SEQ ID NO: 8923 - RNA, 696 nt, Artificial Sequence
  derived and/or modified sequence opt1 from anti-HIV_5CCK_HeavyChain
caggugcagcugguccagagcggcgccgagaugaaggaccccggggccuccgugaaggugagcugccgcgcguccggcuacaaguucaccgacuacuacaugcacuggguccggcaggccccggggcagggccucgaguggguggggugggugaacaccaacggcggcuucacgaaguacggggccaaguuccagggccgcgucaccgugacccgggacaccagcacgaacaccguguuccuggagcugucccgccucaccuucggggacaccgccauguacuucugcgcccggcccaugcgccccgucagccacggcaucgacuacuccgggcuguucguguuccaguucuggggccggggcacgauggugaccgucagcuccgcgagcaccaaggggcccuccguguucccgcuggcccccagcuccaagagcaccuccggcgggacggccgcccucggcugccuggugaaggacuacuuccccgagcccgucaccgugagcuggaacuccggcgcgcugaccagcggggugcacaccuucccggccguccuccaguccagcggccuguacagccuguccagcguggugacgguccccuccagcucccucgggacccagaccuacaucugcaacgugaaccacaagcccagcaacaccaagguggacaagaaggucgagcccaaguccugcgac

SEQ ID NO: 8924 - RNA, 648 nt, Artificial Sequence; identical to SEQ ID NO: 8800
  derived and/or modified sequence opt1 from anti-HIV_5AWN_LightChain

SEQ ID NO: 8925 - RNA, 696 nt, Artificial Sequence
  derived and/or modified sequence opt1 from anti-HIV_5AWN_HeavyChain
caggugcagcugaugcagagcggcgcccagcuccgcgaccccggggacucccugaagaucagcugcaaggccuccggcuacaacuucaucgacuaccacauccacuggguccggcuggcgccggggcgcggccucgaguggaugggguggaucgaccccgugggcggcaucaccaaguacgccgggcaguuccagggccggcugagccugacccgcgacacguccaccaacacccucuuccuggagcugagccggcucaccgccggggacacggccguguacuucugcgcccgcuccaugcggcccgucgaccacggcaucgacuacagcgggcuguucguguuccacuucuggggccgcggcuccgacgugcuggucagcuccgcgagcaccaaggggcccuccguguucccgcucgcccccagcuccaagagcaccuccggcgggaccgccgcccugggcugccuggugaaggacuacuuccccgagcccgucacggugagcuggaacuccggcgcgcucaccagcggggugcacaccuucccggccguccugcagagcuccggccuguacagccucuccagcguggugaccguccccuccagcucccuggggacgcagaccuacaucugcaacgugaaccacaagcccagcaacaccaagguggacaagaaggucgagcccaaguccugcgac

SEQ ID NO: 8926 - RNA, 645 nt, Artificial Sequence
  derived and/or modified sequence opt1 from anti-HIV_3QEG_LightChain
gagaucgugaugaugcagagccccggcacccugucccucagcccgggggagcgcgccacccuguccugccgggccagccaguccgucagcuccagcuaccuggcgugguaccagcagaagcccggccaggcgccccgccuccugaucuacggggccuccagccgggccacgggcauccccgaccgcuucuccgggagcggcuccggcaccgacuucacccugaccaucagccggcucgagccggaggacuucgccguguacuacugccagcaguacggguccagccccgagacguucggccaggggaccaagguggagaucaagcgcaccgucgccgcccccuccguguucaucuucccgcccagcgacgagcagcugaaguccggcaccgccagcguggucugccugcucaacaacuucuacccccgggaggccaaggugcaguggaagguggacaacgcgcugcagagcgggaacucccaggagagcgucacggagcaggacuccaaggacagcaccuacucccugagcuccacccucacccugagcaaggccgacuacgagaagcacaagguguacgccugcgaggugacgcaccagggccuguccagccccgucaccaaguccuucaaccgcggcgagugc

SEQ ID NO: 8927 - RNA, 717 nt, Artificial Sequence
  derived and/or modified sequence opt1 from anti-HIV_3QEG_HeavyChain
caggugcagcugguccagagcggcgccgaggugaagaagcccggguccagcgugaaggucuccugccgcgccagccggggcaccuucuccagcuacgggaucaccugggugcgccaggcgccgggccaggggcucgaguggaugggcggcaucauccccaucuucgacgugacgaacuacgcccagaacuuccaggggcgggucgccaucaccaccgacgccgagauguccaccgccuacauggagcugcgcagccugaaguccgaggacagcgcgguguacuacugcgccuccgacagccgggacuucuccuacuacgagcccggcacgagcuacucccacuacuacaacaucauggacgugugggggcagggcaccaccgucaccgugagcuccgccagcacgaaggggcccuccguguucccgcucgcccccagcagcaaguccaccagcggcggcaccgcggcccuggggugccuggucaaggacuacuuccccgagcccgugaccguguccuggaacagcggcgcccucacguccgggguccacaccuucccggccgugcugcagagcuccggccuguacagccucuccagcguggucaccgugcccuccagcucccugggcacccagacguacaucugcaacgugaaccacaagcccagcaacaccaaggucgacaagcgcguggagcccaaguccugcgacaagacccac

SEQ ID NO: 8928 - RNA, 690 nt, Artificial Sequence
  derived and/or modified sequence opt1 from anti-HIV_1N0X_K-Chain
caggugcagcugguccagagcggcgccgaggugaagaagccgggggccuccgugaaggucagcugccaggcguccggcuaccgcuucagcaacuucgugauccacugggugcggcaggccccggggcagcgcuucgaguggaugggcuggaucaaccccuacaacgggaacaaggaguucuccgccaaguuccaggaccgggucaccuucaccgccgacacgagcgccaacaccgcguacauggagcuccgcucccugcggagcgccgacaccgccguguacuacugcgcccgcgugggccccuacuccugggacgacagcccccaggacaacuacuacauggacgucuggggcaaggggaccacggugaucguguccagcgcguccaccaagggcccgagcgucuucccccuggcccccuccagcaaguccaccagcgggggcaccgccgcccucgggugccuggugaaggacuacuuccccgagccggugacggucuccuggaacagcggcgcccugaccagcggcgugcacaccuuccccgcggugcuccaguccagcgggcuguacucccugagcuccgucgugaccgugcccagcuccagccucggcacgcagaccuacaucugcaacgucaaccacaagcccuccaacaccaagguggacaagaagguggagcccaagagcugc

SEQ ID NO: 8929 - RNA, 645 nt, Artificial Sequence
  derived and/or modified sequence opt1 from anti-HIV_1N0X_M-Chain
gagaucgugcugacccagagccccggcacccucucccugagcccgggggagcgcgccacguucuccugccggagcucccacagcauccgcucccggcgcgucgccugguaccagcacaagcccggccaggcgccccggcuggugauccacggggugagcaaccgcgccuccggcaucagcgaccgguucuccgggagcggcuccggcaccgacuucacccucaccaucacgcgcgucgagcccgaggacuucgcccuguacuacugccagguguacggggccagcuccuacaccuucggccaggggaccaagcuggagcggaagcgcaccguggccgcgccgagcgucuucaucuucccgcccuccgacgagcagcucaagagcggcacggccuccguggugugccugcugaacaacuucuacccccgggaggccaagguccaguggaagguggacaacgcccuccagagcgggaacagccaggaguccgugaccgagcaggacagcaaggacuccaccuacagccuguccagcacccugacgcucuccaaggcggacuacgagaagcacaaggucuacgccugcgaggugacccaccagggccugcgcagccccgugaccaaguccuucaaccggggcgagugc

SEQ ID NO: 8930 - RNA, 654 nt, Artificial Sequence
  derived and/or modified sequence opt1 from anti-HIV_3QEH_HeavyChain
gacaucgugaugacccagagcccccugucccucccggucacccccggcgaggccgccagcaucuccugccgcagcucccagagccugcugcacacgaacggguuccaguaccucgacugguaccugcagaagcccggccagagcccccagcugcucaucuaccugggguccaaccgggcgaccggcgugccgcaccgcuucuccgggagcggcuccggcaccgaguucacccugaagaucagccggguggaggccgaggacgucgggguguacuacugcaugcaggccaaggagucccccacguucggccaggggaccaagguggagaucaagcgcaccgucgccgcccccagcguguucaucuucccgcccuccgacgagcagcucaagagcggcaccgcguccguggucugccugcugaacaacuucuacccccgggaggccaaggugcaguggaagguggacaacgcccuccagagcgggaacucccaggagagcgucacggagcaggacagcaaggacuccaccuacagccuguccagcacccugacccucuccaaggccgacuacgagaagcacaagguguacgcgugcgaggugacgcaccagggccugagcucccccgucaccaagagcuucaaccgcggcgagugc

SEQ ID NO: 8931 - RNA, 696 nt, Artificial Sequence
  derived and/or modified sequence opt1 from anti-HIV_3QEH_G-Chain
caggugcagcugguccagagcggcgccgaggugcgcaagcccggggccuccgugaccgucagcugcaagaccuccggcuacacguucgugaacuucuacaucguguggguccggcaggcgccggggcagggccucgaguggaugggggugaucaaccccuuccgcggcgacaccuacuucgcccagaaguucaagggccgggugacccugacccgcgacacgagcaccuccaccgucuucauggagcugagcucccuccggagcgacgacaccgccaucuacuacugcgcccgcgaccuggagaugcgggacgggaacaaccacggcucccaccuggaguucugggggcagggcacgcucgugaccgugagcuccgccagcaccaaggggcccuccgucuucccccuggcgccgagcuccaagagcaccuccggcggcacggccgcccuggggugccucgugaaggacuacuuccccgagcccgugaccgucagcuggaacuccggcgcccugaccagcggggugcacaccuuccccgcggugcugcagagcuccggccucuacagccuguccagcgucgugacggugccguccagcucccugggcacccagaccuacaucugcaacgucaaccacaagcccagcaacaccaagguggacaagcgcguggagcccaaguccugcgacaagacgcac

SEQ ID NO: 8932 - RNA, 678 nt, Artificial Sequence
  derived and/or modified sequence opt1 from anti-HIV_2B1H_HeavyChain
gagauccagcuggagcagagcggcgccgaggugaagaaguccggggagagccucaagaucuccugccagaccagcggcuacuccuucagcgacuacuggaucggguggguccgccagaugcccggcaaggggcuggaguggaugggcaucuucuacccgggcgacuccgacagccgguacucccccagcuucgaggggcaggucaccauguccgccgaccgcagcacgaacaccgcgcaccuccagugguccagccugaagcccuccgacaccgcccuguacuacugcgcccggcugggcggggacuacgaggacagcggcgccgacgccuucgacuucugggggcagggcacccucgugacgguguccagcgcguccaccaagggccccagcguguucccgcuggcccccagcuccaagagcaccuccgggggcaccgccgcccuggggugccucgugaaggacuacuuccccgagcccgucacggugagcuggaacuccggcgcgcugaccagcggcgugcacaccuucccggccguccugcaguccagcgggcucuacucccugagcuccguggugaccguccccagcuccagccugggcacgcagaccuacaucugcaacgugaaccacaagcccuccaacaccaagguggacaagaaggucgagcccaagagc

SEQ ID NO: 8933 - RNA, 645 nt, Artificial Sequence
  derived and/or modified sequence opt1 from anti-HIV_2B1H_LightChain
cagagcgugcugacccagcccccguccgccagcggcacccccgggcagcggaucuccaucagcugcuccggcacgagcuccaacgucgagaacaacuacguguacugguaccagcaccuccccgggaccgcccccaagcugcugaucuaccggaacgaccaccgcagcuccggcaucccggaccgguucagcgcguccaagagcgggaccuccgccagccucgccaucuccggccugcgccccgaggacgagggcgacuacuacugcgccgccugggacgacagccgcgggggccccgacuggguguucgggggcgggaccaagcugacgguccucgcgcagcccaaggccgccccguccgugacccuguucccgcccagcuccgaggagcugcaggccaacaaggcgacccucgugugccugaucagcgacuucuaccccggcgccgucaccguggccuggaaggccgacagcucccccgugaaggccggcgucgagacgaccacccccagcaagcaguccaacaacaaguacgcggccagcuccuaccugagccucacccccgagcaguggaagucccacaagagcuacuccugccaggugacgcacgaggggagcaccguggagaagaccgucgcccccacc

SEQ ID NO: 8934 - RNA, 648 nt, Artificial Sequence
  derived and/or modified sequence opt1 from anti-HIV_3TNM_B-Chain
cagagcgugcugacccagcccccguccgccagcggcucccccgggcagagcgucaccaucuccugcacgggcaccagcuccgacgucgggggcuacaacuacgugagcugguaccagcaccaccccgggaaggcccccaagcucaucaucuccgaggugaacaaccgcccgagcggcgugcccgaccgguucuccggcagcaaguccgggaacaccgcgagccugaccguguccggccugcaggccgaggacgaggccgaguacuacugcagcuccuacacggacauccacaacuucgucuucgggggcgggaccaagcucaccgugcugggccagcccaaggccgcccccagcgugacccuguucccgcccuccagcgaggagcuccaggcgaacaaggccacgcuggucugccugaucagcgacuucuaccccggcgccgugaccguggccuggaaggcggacuccagccccgucaaggccgggguggagaccaccacgccguccaagcagagcaacaacaaguacgccgccuccagcuaccucucccugacccccgagcaguggaagucccaccgcagcuacagcugccaggugacccacgagggcuccaccgucgagaagacgguggcccccaccgagugcagc

SEQ ID NO: 8935 - RNA, 693 nt, Artificial Sequence
  derived and/or modified sequence opt1 from anti-HIV_3TNM_A-Chain
caggugcagcugcaggagagcggccccgggcucgucaagccgucccagacccugagccuguccugcaccgugagcggcggguccagcuccagcggcgcccacuacugguccuggauccgccaguaccccgggaagggccucgaguggaucggcuacauccacuacagcgggaacacguacuacaaccccucccucaagagccggaucaccaucucccagcacaccagcgagaaccaguucucccugaagcugaacagcgugaccgucgccgacacggcgguguacuacugcgcccgcggcacccggcugcgcacccugcggaacgccuucgacaucugggggcagggcaccauggugacggucuccagcgccuccaccaaggggcccagcguguucccgcucgcccccagcuccaagagcaccuccggcggcaccgcggcccuggggugccuggugaaggacuacuuccccgagcccgucacggugagcuggaacuccggcgcccucaccagcggggugcacaccuucccggccguccugcaguccagcggccuguacucccucagcuccguggugaccguccccagcuccagccugggcacgcagaccuacaucugcaacgugaaccacaagcccuccaacaccaagguggacaagcgcgucgagcccaagagcugcgacaagacccacacg

SEQ ID NO: 8936 - RNA, 690 nt, Artificial Sequence
  derived and/or modified sequence opt1 from anti-HIV_3UJJ_HeavyChain
gaggugcagcugguccagagcggcgccgaggugaagaagcccggggagucccucaagaucagcugcaaggccuccggcuacagcuucuccagcuacuggaucgcgugggugcgccagaugccggggaagggccuggaguggaugggguucaucuaccccgccgacuccgacacccgguacagccccuccuuccagggccagggcaccaucagcgccgacaaguccaucagcacggccuaccugcagugguccagccucaaggccuccgacaccgcgauguacuacugcgccauccugggguucuggggcgccaaccgcgggggcgggggcauggacgucuggggccaggggaccaccgugaucgugagcuccgccagcacgaagggccccuccgucuucccgcuggcgcccagcagcaaguccaccagcgggggcaccgccgcccucggcugccuggugaaggacuacuuccccgagcccgugaccgucuccuggaacagcggggcccugacguccggcgugcacaccuucccggccgugcuccagagcuccgggcuguacagccuguccagcgucgugaccgugcccuccagcucccucggcacccagacguacaucugcaacgucaaccacaagcccagcaacaccaagguggacaagaagguggagcccaaguccugcgacaagacc

SEQ ID NO: 8937 - RNA, 639 nt, Artificial Sequence
  derived and/or modified sequence opt1 from anti-HIV_3UJJ_LightChain
agcuacgagcugacccagcccccguccgugagcgucucccccggccagaccgcccgcaucacgugcagcggggacgcccuccccgagaaguacgcguacugguaccagcagaaguccggccaggcccccgugcugaucaucuacgaggacagcaagcggccguccgggauccccgagcgcuucagcggcucccggagcgggaccauggccacccugaccaucuccggcgcccagguggacgacgaggccgacuacuacugcuacagcacgaacuccggcgggaccuucuucgucuucggcaccgggaccaaggugacggugcucggccagcccaaggcgaaccccaccgucacccuguucccgcccagcuccgaggagcugcaggccaacaaggccacccucgugugccugaucagcgacuucuaccccggggccgugacggucgcguggaaggccgacuccagccccgugaaggccggcguggagaccaccaccccguccaagcagagcaacaacaaguacgccgccagcuccuaccugagccucacgcccgagcaguggaagucccaccgcagcuacuccugccaggucacccacgagggcagcaccguggagaagaccguggcgcccacggagugc

SEQ ID NO: 8938 - RNA, 669 nt, Artificial Sequence
  derived and/or modified sequence opt1 from anti-HIV_3UJI_HeavyChain
caggugcagcugguccagagcgccgccgaggugaagaagcccggcgaggcgcucaagaucuccugcaaggggagcggcuacuccuucagcaacuacuggaucgccugggugcgccagaugccggggaagggccuggaguggauggggaucgucuaccccgacgacuccgacagcuccuacaacagcuccuuccagggccagaucaccuucagcgccgacaaguccaucagcaccgccuaccugcacuggacgucccuccaggccagcgacaccgcgauguacuacugcgcccggcugggcuucgagggggacuacuccggcagcuucuucgacuacugggggcagggcacccugcucaucguguccagcgccuccaccaaggggcccagcguguucccccuggccccgagcuccaagagcacguccggcggcaccgcggcccuggggugccucgucaaggacuacuuccccgagcccgugaccgugagcuggaacuccggcgcccugaccagcgggguccacacguuccccgccgugcugcaguccagcggccucuacucccugagcuccguggucaccgugccgagcuccagccugggcacccagaccuacaucugcaacgugaaccacaagcccuccaacacgaaggucgacaagaagguggagccc

SEQ ID NO: 8939 - RNA, 627 nt, Artificial Sequence
  derived and/or modified sequence opt1 from anti-HIV_3UJI_LightChain
agcuacgagcugacccagcccccguccgugagcgucucccccggccagaccgccagcaucacgugcuccggggacauccucggcgacaaguacgugagcugguaccagcagaaguccgggcagagcccccugcuggugaucuacgaggacaccaagcgccccuccggcaucccggaccgguucagcggguccaagagcggcaacaccgccacccucacgaucuccggcacccaggcgauggacgaggccgacuacuacugccaggccugggacagcacccugggggucguguucggcgggggcaccaaggugacgguccuggggcagcccaaggccgcccccuccgugacccucuucccgcccagcuccgaggagcugcaggcgaacaaggccacccuggugugccucaucagcgacuucuaccccggcgccgucaccguggccuggaaggcggacuccagccccgugaaggccggcgucgagacgaccacccccagcaagcaguccaacaacaaguacgccgccagcuccuaccugagccugaccccggagcaguggaagucccacaagagcuacuccugccaggugacgcacgaggggagcaccguggagaagaccgucgccccc

SEQ ID NO: 8940 - RNA, 666 nt, Artificial Sequence
  derived and/or modified sequence opt1 from anti-HIV_2QSC_HeavyChain
caggugcagcugguccagagcggcgggggccucgugcagcccgggggcucccugcgccugagcugcgccgccuucggguucaacuucuccagcuacgugaugcacuggguccggcaggcgccgggccagggccucgaguaccuguccgccaucagcuccgacggggagaccaccuaccacgccaacagcgugaagggccgcuucacguccagccgggacaacuccaagaacacccuguuccuccagauggggagccugcgcaccgaggacguggccgucuacuacugcgcccgggaccgcuacuacgagaccuccggcagcaacgcguucgacgugugggggcagggcacgaugguggucguguccagcgccuccaccaagggccccagcguguucccccuggcccccugcucccggagcaccagcgaguccaccgccgcgcucgggugccuggucaaggacuacuucccggagcccgugacggugagcuggaacuccggcgcccugaccagcgggguccacaccuuccccgccgugcuccaguccagcggccuguacucccugagcuccguggucaccgugcccagcuccaacuucggcacgcagaccuacacgugcaacguggaccacaagccgagcaacaccaaggucgacaagaccguggag

SEQ ID NO: 8941 - RNA, 645 nt, Artificial Sequence
  derived and/or modified sequence opt1 from anti-HIV_2QSC_LightChain
aacagcgugcugacccagucccccagcucccucagcgccuccgucggcgaccgcgugaccaucacgugccaggccagccaggacaucuccaacuaccugaacugguaccagcacaagccggggaaggcgcccaagcugcucaucuacaccgccagcaaccuggagaccggcgugcccucccgguucagcgggggcggguccggcacccacuucagcuucacgaucaccucccugcagcccgaggacgccgccaccuacuucugccagcaguacgacaaccucggcgaccugagcuucgggggcgggaccaaggucgagaucaagcgcacgguggccgcgccguccguguucaucuucccgcccagcgacgagcagcugaaguccggcaccgccagcgucgugugccuccugaacaacuucuacccccgggaggccaaggugcaguggaaggucgacaacgcccugcaguccgggaacagccaggagagcgugaccgagcaggacuccaaggacagcaccuacucccucagcuccacgcugacccugagcaaggcggacuacgagaagcacaagguguacgccugcgaggucacccaccagggccucuccagccccgugaccaaguccuucaaccgcggcgagugc

SEQ ID NO: 8942 - RNA, 690 nt, Artificial Sequence
  derived and/or modified sequence opt1 from anti-HIV_3MLZ_HeavyChain
caggugcagcugcaggagagcggccccgggcucgucaagccguccgagacccugagccugaccugcacgguguccggcgggagcaucuccggcuuccacuggagcuggauccgccagccgcccgggaagggccucgaguacaucggcuacaucuacuacuccgggagcaccuccuacaaccccagccugaagucccgggugagcauguccgucgacaccagccgcaaccaguucucccuggagcucagcuccgugaccgccgccgacacggcgguguacuacugcgcccgggacuucggcgaguaccacuacgacgggcgcggcuuccagugcgagggguucgaccuguggggccagggcacccuggucaccgugagcuccgccagcaccaaggggcccagcguguucccccucgcccccuccagcaaguccacgagcggcgggaccgccgcgcugggcugccuggucaaggacuacuuccccgagccggugaccguguccuggaacagcggcgcccucaccuccgggguccacacguuccccgccgugcugcagagcuccggccuguacagccucuccagcguggucaccgugcccuccagcucccuggggacccagaccuacaucugcaacgugaaccacaagcccagcaacacgaaggucgacaagaagguggagccgaaguccugc

SEQ ID NO: 8943 - RNA, 642 nt, Artificial Sequence
  derived and/or modified sequence opt1 from anti-HIV_3MLZ_LightChain
cagagcgugcugacccagcccccguccgucagcgccgcccccggccagaaggugaccaucuccugcagcggguccagcuccaacaucggcaacaacauggugagcugguaccagcagcaccccgggacggcgcccaagcuccugaucuacgagaacuccaagcgcccgagcggcauccccgaccgguucuccgggagccgcuccggcaccagcgccacccugggcaucaucgggcuccagaccggcgacgaggccgaguacuacugcgccacgugggacgggucccugcggaccgucuucggcgggggcaccaagcugaccgugcucagccagcccaaggccgcgcccuccgugacgcuguucccgcccagcuccgaggagcugcaggccaacaaggccacccucgucugccugaucagcgacuucuaccccggcgccgugaccguggcguggaaggccgacagcucccccguccgcgccgggguggagaccacgaccccgagcaagcaguccaacaacaaguacgccgccagcuccuaccugagccucacccccgagcaguggaagucccaccggagcuacuccugccaggugacccacgagggcagcacggucgagaagaccguggcgcccaccgagugc

SEQ ID NO: 8944 - RNA, 684 nt, Artificial Sequence
  derived and/or modified sequence opt1 from anti-HIV_3MLX_I-Chain
caggugcagcugcaggagagcggccccgggcucgucaagccguccgagacccugagccugaccugcacgguguccggcgggagcaucuccggcuuccacuggagcuggauccgccagccgcccgggaagggccucgaguacaucggcuacaucuacuacuccgggagcaccuccuacaaccccagccugaagucccgggugagcauguccgucgacaccagccgcaaccaguucucccuggagcucagcuccgugaccgccgccgacacggcgguguacuacugcgcccgggacuucggcgaguaccacuacgacgggcgcggcuuccagugcgagggguucgaccuguggggccagggcacccuggucaccgugagcuccgccagcaccaaggggcccagcguguucccccucgcccccuccagcaaguccacgagcggcgggaccgccgcgcugggcugccuggucaaggacuacuuccccgagccggugaccguguccuggaacagcggcgcccucaccuccgggguccacacguuccccgccgugcugcagagcuccggccuguacagccucuccagcguggucaccgugcccuccagcucccuggggacccagaccuacaucugcaacgugaaccacaagcccagcaacacgaaggucgacaagaagguggagccgaag

SEQ ID NO: 8945 - RNA, 633 nt, Artificial Sequence
  derived and/or modified sequence opt1 from anti-HIV_3MLX_M-Chain
agcgugcugacccagcccccguccgucagcgccgcccccggccagaaggugaccaucuccugcagcggguccagcuccaacaucggcaacaacauggugagcugguaccagcagcaccccgggacggcgcccaagcuccugaucuacgagaacuccaagcgcccgagcggcauccccgaccgguucuccgggagccgcuccggcaccagcgccacccugggcaucaucgggcuccagaccggcgacgaggccgaguacuacugcgccacgugggacgggucccugcggaccgucuucggcgggggcaccaagcugaccgugcucagccagcccaaggccgcgcccuccgugacgcuguucccgcccagcuccgaggagcugcaggccaacaaggccacccucgucugccugaucagcgacuucuaccccggcgccgugaccguggcguggaaggccgacagcucccccguccgcgccgggguggagaccacgaccccgagcaagcaguccaacaacaaguacgccgccagcuccuaccugagccucacccccgagcaguggaagucccaccggagcuacuccugccaggugacccacgagggcagcacggucgagaagaccguggcgcccacc

SEQ ID NO: 8946 - RNA, 684 nt, Artificial Sequence
  derived and/or modified sequence opt1 from anti-HIV_3MLW_I-Chain
caggugcagcugguccagagcggcgccgaggugaagaaggccggggagucccucgagaucagcugcaagggcuccggguacaccuucaccgaccacuggaucgcgugggugcgccagguccccggcaaggggcuggaguggaugggcaugaucuacccgggcgacagcgacacgcgguacucccccagccugcaggggcgcgugaccauguccgccgacaagacccucagcaccgccuaccugcaguggucccggcuggaggccagcgacacggccauguacuacugcgcgcgccuccacuacuccgaccggagcggcuccuacuucaacgacguguuccacaugugggggcagggcaccaccgucaccgugagcuccgccagcacgaaggggcccuccguguucccccuggccccgagcuccaagagcaccagcggcggcaccgccgcgcuggggugccucgucaaggacuacuuccccgagcccgugaccguguccuggaacagcggcgcccugacguccgggguccacaccuuccccgccgugcugcagagcuccggccucuacagccuguccagcguggucaccgugccguccagcucccugggcacccagacguacaucugcaacgugaaccacaagcccagcaacaccaaggucgacaagaagguggagcccaagucc

SEQ ID NO: 8947 - RNA, 645 nt, Artificial Sequence
  derived and/or modified sequence opt1 from anti-HIV_3MLW_M-Chain
cagagcgugcugacccagcccccguccgccagcggcacccccgggcagcgcgucacgaucuccugcagcggcaacuccagcaacaucgagaacaacuacguguacugguaccagcagcuccccggguccacccccaagcugcugaucuuccgggacgaccagcgcccgagcggcgugcccgaccgguucuccgggagcaaguccggcaccagcgccucccucgcgaucagcggccugcgcuccgaggacgaggccgacuacuacugcgccagcugggacgacucccgcgggggccccgacuacgucuucgggaccggcacgaaggugaccgugcuggggcagcccaaggccaacccgaccgucacccucuucccgcccagcuccgaggagcugcaggccaacaaggcgacgcuggugugccucaucagcgacuucuaccccggcgccgugaccgucgccuggaaggccgacggcagccccgugaaggcggggguggagaccaccaagcccuccaagcagagcaacaacaaguacgccgccuccagcuaccugucccugacgcccgagcaguggaagucccaccggagcuacagcugccaggucacccacgagggcuccaccguggagaagaccguggcccccacg

SEQ ID NO: 8948 - RNA, 678 nt, Artificial Sequence
  derived and/or modified sequence opt1 from anti-HIV_3MLV_N-Chain
gaggugcagcuggucgagagcggcggggaggugaagcagcccggccagucccucaagaucagcugcaaguccagcggguacaacuuccuggacuccuggaucggcugggugcgccagaucccggggaagggccuggaguggaucggcaucaucuaccccgacgacagcgacgcccacuacucccccagcuucgaggggcaggucaccauguccguggacaagagcaucuccaccgccuaccuccaguggacgacccugcaggcgagcgacaccggcaaguacuucugcacccggcuguaccucuucgagggggcccaguccagcaacgccuucgaccuguggggccaggggacgaugauccugguguccagcggcaccaccaagggccccuccgucuucccgcucgcccccagcuccaagagcaccagcgggggcacggccgcgcuggggugccuggugaaggacuacuuccccgagcccgugaccgucuccuggaacagcggcgcccucaccuccggcgugcacaccuucccggccgugcugcagagcuccgggcuguacagccucuccagcgucgugacggugcccuccagcucccugggcacccagaccuacaucugcaacgucaaccacaagcccagcaacaccaagguggacaagaagguggagcccaagucc

SEQ ID NO: 8949 - RNA, 657 nt, Artificial Sequence
  derived and/or modified sequence opt1 from anti-HIV_3MLV_M-Chain
agcuaccugcucacccagcccccguccgugagcgucucccccggccagaccgccagcaucuccugcagcggggacaagcuggacgacaaguacguguccugguacuaccagcgccccggccagagccccgugcugcucauguaccaggacuucaagcggccguccgggauccccgagcgccugagcggcuccaagagcgggaagacggccacccugaccaucuccggcacccagagccucgacgagggcgacuacuacugccaggcgugggacgccuccacgggggucagcggcgggggcaccaagcugaccgugcuguucggggagggcacccggcucacggugcuggcccagcccaaggccgcccccuccgucacccuguucccgcccagcuccgaggagcuccaggcgaacaaggccacccuggugugccugaucagcgacuucuaccccggcgccgugaccgucgccuggaaggcggacagcucccccgugaaggccgggguggagacgaccaccccgagcaagcaguccaacaacaaguacgccgccagcuccuaccucagccugacccccgagcaguggaagucccacaagagcuacuccugccaggucacgcacgagggcagcaccguggagaagaccguggcccccacc

SEQ ID NO: 8950 - RNA, 654 nt, Artificial Sequence
  derived and/or modified sequence opt1 from anti-HIV_3MLU_LightChain
uaccugcucacccagcccccgagcguguccgucagccccggccagaccgccuccaucagcugcuccggggacaagcuggacgacaaguacgugagcugguacuaccagcgccccggccagucccccgugcugcucauguaccaggacuucaagcggccgagcgggauccccgagcgccuguccggcagcaaguccgggaagacggccacccugaccaucagcggcacccagucccucgacgagggcgacuacuacugccaggcgugggacgccagcacgggggucuccggcgggggcaccaagcugaccgugcuguucggggagggcacccggcucacggugcuggcccagcccaaggccgcccccagcgucacccuguucccgcccuccagcgaggagcuccaggcgaacaaggccacccuggugugccugaucuccgacuucuaccccggcgccgugaccgucgccuggaaggcggacagcagccccgugaaggccgggguggagacgaccaccccguccaagcagagcaacaacaaguacgccgccuccagcuaccucucccugacccccgagcaguggaagucccacaagagcuacagcugccaggucacgcacgagggcuccaccguggagaagaccguggcccccacc

SEQ ID NO: 8951 - RNA, 657 nt, Artificial Sequence
  derived and/or modified sequence opt1 from anti-HIV_3MLT_G-Chain
agcuacgaccugacccagcccccguccgugagcgucucccccggccagaccgccagcaucuccugcagcggggacaagcucgacgacaaguacguguccugguacuaccagcgccccggccagagccccgugcugcugauguaccaggacuucaagcggccguccgggauccccgagcgccucagcggcuccaagagcgggaagacggccacccugaccaucuccggcacccagagccuggacgagggcgacuacuacugccaggcgugggacgccuccacgggggucagcggcgggggcaccaagcucaccgugcuguucggggacggcacccggcugacggugcucggccagcccaaggccgcccccuccgucacccuguucccgcccagcuccgaggagcugcaggccaacaaggcgacccucgugugccugaucagcgacuucuaccccggggccgugaccgucgccuggaaggccgacagcucccccgugaaggcgggcguggagacgaccaccccgagcaagcaguccaacaacaaguacgccgccagcuccuaccugagccucacccccgagcaguggaagucccacaagagcuacuccugccaggucacgcacgaggggagcaccguggagaagaccguggcccccacc

SEQ ID NO: 8952 - RNA, 666 nt, Artificial Sequence
  derived and/or modified sequence opt1 from anti-HIV_3GO1_HeavyChain
gaggugcagcugcaggagagcggccccgggcucgucaagccguccgagacccugagccugaccugcacgguguccggcgggcccaucaacaacgccuacuggaccuggauccgccagccgcccggcaaggggcucgaguaccugggcuacguguaccacaccggcgucaccaacuacaaccccagccugaagucccggcucacgaucaccaucgacaccagccgcaagcagcugucccugagccucaaguucgugaccgccgcggacuccgccguguacuacugcgcccgggagugggccgaggacggggacuucggcaacgccuuccacgucugggggcagggcacgaugguggcggugagcuccgccagcaccaaggggcccuccgucuucccccuggcccccagcuccaagagcaccuccggcggcaccgccgcgcuggggugccucgugaaggacuacuucccggagcccgugacggucagcuggaacuccggcgcccugaccagcggggugcacaccuuccccgccgugcugcagagcuccggccucuacagccuguccagcgucgugaccgugcccuccagcucccugggcacgcagaccuacaucugcaacgucaaccacaagccgagcaacaccaagguggacaagcgcguggagccc

SEQ ID NO: 8953 - RNA, 627 nt, Artificial Sequence
  derived and/or modified sequence opt1 from anti-HIV_3GO1_LightChain
agcuacgugcugacccagcccccguccgucagcgugucccccggccagaccgcccgcaucacgugcagcgccgaggcgcucuccaaccaguacgccuacugguaccggcagcgccccgggcaggcgccccugcugaucaucuacaaggacaccaagcggccgagcggcauccccgagcgcuucuccgggagcaccuccggcaccacggugacccucaccaucagcgggguccaggccgaggacgaggccgacuacuacugccaguccgccgacagcuccggcgacuacguguucggcgggggcaccaaggugacgguccuggggcagcccaaggccaaccccaccgugacccuguucccgcccagcuccgaggagcuccaggccaacaaggccacccuggugugccugaucagcgacuucuaccccggcgcggucacgguggccuggaaggccgacgggucccccgugaaggccggcgucgagaccaccaagccgagcaagcaguccaacaacaaguacgccgcgagcagcuaccucucccugacccccgagcaguggaagucccaccggagcuacagcugccaggugacgcacgagggcuccaccguggagaagaccgucgccccc

SEQ ID NO: 8954 - RNA, 690 nt, Artificial Sequence
  derived and/or modified sequence opt1 from anti-HIV_4XCY_J-Chain
caggugcagcugguccagagcggcgccgaggugaagcgccccggguccagcgugaccgucuccugcaaggccagcggcggguccuucagcaccuacgcgcucuccugggugcggcaggccccgggccgcgggcuggaguggaugggcggcgugaucccccugcucacgaucaccaacuacgcgccccgguuccaggggcgcaucaccaucaccgccgaccggagcacguccaccgccuaccuggagcugaacagccuccgccccgaggacaccgccgucuacuacugcgcccgggagggcaccacgggguggggcuggcuggggaagccgaucggcgccuucgcccacuggggccaggggacccuggugaccguguccagcgcguccaccaagggccccagcgucuucccccucgcccccuccagcaaguccacgagcgggggcaccgccgcccugggcugccuggugaaggacuacuucccggagcccgugaccgucuccuggaacagcggggcccucaccagcggcgugcacacguuccccgcggugcugcaguccagcgggcuguacucccucagcuccgucgugaccgugcccagcuccagccugggcacccagaccuacaucugcaacgucaaccacaagccguccaacacgaagguggacaagaagguggagcccaagagcugc

SEQ ID NO: 8955 - RNA, 645 nt, Artificial Sequence
  derived and/or modified sequence opt1 from anti-HIV_4XCY_K-Chain
gagaucgugcugacccagagccccggcacccagucccucagcccgggggagcgggccacgcuguccugccgggccagccaguccgucggcaacaacaagcuggcgugguaccagcagcgccccgggcaggcgccccggcuccugaucuacggcgccagcucccgccccagcgggguggccgaccgguucuccggcagcggcuccgggaccgacuucacccugaccaucagccgccucgagccggaggacuucgccguguacuacugccagcaguacggccagucccugagcacguucgggcagggcaccaaggucgaggugaagcggaccguggccgcccccuccgucuucaucuucccgcccagcgacgagcagcugaaguccgggaccgccagcguggugugccuccugaacaacuucuacccccgcgaggccaagguccaguggaagguggacaacgcgcugcaguccggcaacagccaggagagcgugacggagcaggacuccaaggacagcaccuacucccucagcuccacccugacccugagcaaggccgacuacgagaagcacaaggucuacgccugcgaggugacgcaccagggccucuccagccccgugaccaaguccuucaaccgcggggagugc

SEQ ID NO: 8956 - RNA, 630 nt, Artificial Sequence
  derived and/or modified sequence opt1 from anti-HIV_4YBL_C-Chain
gugcugacccagcccccgagcgccuccggcagccccgggcaguccgucaccaucagcugcacgggcaccuccagcgacgucgggggcuacaacuacguguccugguaccagcaccaccccgggaaggcccccaagcucaucaucagcgaggugaacaaccgcccguccggcgugcccgaccgguucagcggcuccaagagcgggaacaccgcgucccugaccgugagcggccugcaggccgaggacgaggccgaguacuacugcuccagcuacacggacauccacaacuucgucuucgggggcgggaccaagcucaccgugcugggccagcccaaggccgcccccuccgugacccuguucccgcccagcuccgaggagcuccaggcgaacaaggccacgcuggucugccugaucagcgacuucuaccccggcgccgugaccguggccuggaaggcggacagcucccccgucaaggccgggguggagaccaccacgccgagcaagcaguccaacaacaaguacgccgccagcuccuaccucagccugacccccgagcaguggaagucccaccgcagcuacuccugccaggugacccacgagggcagcaccgucgagaagacgguggccccc

SEQ ID NO: 8957 - RNA, 672 nt, Artificial Sequence
  derived and/or modified sequence opt1 from anti-HIV_4YBL_B-Chain
caggugcagcugcaggagagcggccccgggcucgucaagccgucccagacccugagccuguccugcaccgugagcggcggguccagcuccagcggcgcccacuacugguccuggauccgccaguaccccgggaagggccucgaguggaucggcuacauccacuacagcgggaacacguacuacaaccccucccucaagagccggaucaccaucucccagcacaccagcgagaaccaguucucccugaagcugaacagcgugaccgucgccgacacggcgguguacuacugcgcccgcggcacccggcugcgcacccugcggaacgccuucgacaucugggggcagggcaccauggugacggucuccagcgccuccaccaaggggcccagcguguucccgcucgcccccagcuccaagagcaccuccggcggcaccgcggcccuggggugccuggugaaggacuacuuccccgagcccgucacggugagcuggaacuccggcgcccucaccagcggggugcacaccuucccggccguccugcaguccagcggccuguacucccucagcuccguggugaccguccccagcuccagccugggcacgcagaccuacaucugcaacgugaaccacaagcccuccaacaccaagguggacaagcgcgucgagcccaag

SEQ ID NO: 8958 - RNA, 630 nt, Artificial Sequence
  derived and/or modified sequence opt1 from anti-HIV_4R4N_X-Chain
gacauccagaugacccagagccccuccuucgugagcgccuccgucggcgaccgcgugaccaucacgugccgggccagccaggggaucuccagcuaccuggcgugguaccagcagaagccgggcaaggcccccaagcucgugaucuacgccgccuccacccugcagagcgggguccccucccgcuucagcggcuccgggagcggcaccgaguucacccugacgaucuccagccuccagcccgaggacuucgccaccuacuacugccagcaccugaucggccugcgguccuucgggcagggcaccaagcucgagaucaagcgcaccguggcggccccgagcguguucaucuucccgcccuccgacgagcagcucaagagcgggacggccuccgucgugugccugcugaacaacuucuacccccgggaggccaaggugcaguggaaggucgacaacgcgcugcagagcggcaacagccaggaguccgugaccgagcaggacagcaaggacuccaccuacagccuguccagcacccucacgcuguccaaggccgacuacgagaagcacaagguguacgccugcgaggucacccaccaggggcugagcucccccgugaccaagagcuucaaccgc

SEQ ID NO: 8959 - RNA, 660 nt, Artificial Sequence
  derived and/or modified sequence opt1 from anti-HIV_4R4B_F-Chain
caggugcagcugcagcaguggggcgccgggcuccugaagcccagcgagacccugucccugaccugcggcgucuacggggagagccucuccggccacuacuggagcugggugcgccagccgcccgggaagcggcuggaguggaucggcgagaucaagcacaacggcucccccaacuaccaccccagccucaagucccgcgugacgaucagccuggacauguccaagaaccaguucagccugaaccucaccuccgucaccgccgcggacaccgccguguacuucugcgcccggcgcagcaacuggccguaccugcccuucgaccccugggggcagggcacgcuggugaccgucuccagcgccuccaccaaggggcccagcguguucccgcucgcccccuccagcaaguccaccagcggcgggacggcggcccugggcugccuggugaaggacuacuuccccgagcccgucaccgugagcuggaacuccggcgcccucaccagcggggugcacaccuucccggccguccugcaguccagcggccuguacucccucagcuccguggugacgguccccagcuccagccuggggacccagaccuacaucugcaacgugaaccacaagcccuccaacaccaagguggacaagaaggucgagcccaag

SEQ ID NO: 8960 - RNA, 750 nt, Artificial Sequence
  derived and/or modified sequence opt1 from anti-HIV_3JUY_D-Chain
caggugcagcugguccagagcggcgccgaggugaagaagcccggggccuccgugaaggucagcugccaggcguccggcuaccgcuucagccacuucaccgugcacugggugcggcaggccccggggcagcgcuucgaguggaugggcuggaucaaccccuacaacgggaacaaggaguucuccgccaaguuccaggaccgggucaccuucacggccgacaccagcgccaacaccgcguacauggagcuccgcucccugcggagcgccgacaccgccguguacuacugcgcccgcgugggcgaguggggcugggacgacucccccuacgacaacuacuacauggacgucugggggaagggcacgaccgugaucgugagcuccgggggcgggggcagcggcgggggcggguccggcggcgggggcagcgagaucguccugacccaggcgcccgggacccucucccugagcccgggcgagcgggccacguucuccugccgcagcucccacagcauccggagccgccggguggccugguaccagcacaagcccgggcaggcgccccgccuggugauccacggcgucuccaaccgggccagcggcaucuccgaccgcuucagcggguccggcagcgggaccgacuucacccucaccaucacgcggguggagcccgaggacuucgcccuguacuacugccagguguacggcgccuccagcuacaccuucgggcagggcaccaagcuggagcgcaag

SEQ ID NO: 8961 - RNA, 369 nt, Artificial Sequence
  derived and/or modified sequence opt1 from anti-HIV_4KG5_HeavyChain
cagcuggugcagagcggccccgaggccaagcgcccgggguccagcgucaagguguccugcaaggccagccgggacaccuucaacaacuacgugcucaacuggguccgccaggcgcccggccaggggcuggaguggaugggcgggaucggccccaucaucgagaccgccgacuacgccgagaaguuccggggccgccuguccaucacggccgacgagagcaccaccaccgccuacauggagcucuccagccugacguccgacgacaccgcgguguacuacugcgcccggagccccuacuccagccugaccgacaccuacuacuacuacauggaccucugggggaagggcacgaccgugaccgucuccagc

SEQ ID NO: 8962 - RNA, 336 nt, Artificial Sequence
  derived and/or modified sequence opt1 from anti-HIV_4KG5_LightChain
cugacccagagccccgacucccucgccgugagccugggcgagcgcgccaccaucaacugcaaguccagccaguccauccuggacagcuccaacaaccggaacuaccucacgugguaccagcagaagccggggcagccgcccaagcugcugaucuacugggcgagcacccgcgaguccggcguccccgaccgguucagcggguccggcagcuccaccgacuucacccucacgaucagcucccugcaggccgaggacguggccguguacuacugccagcaguacuucagcacccccgggaucaccuucggccagggcacccgccuggagaucaagcgg

SEQ ID NO: 8963 - RNA, 309 nt, Artificial Sequence
  derived and/or modified sequence opt1 from anti-HIV-1_LightChain
gagaucgugcugacccagagccccgccacccucucccugagcccgggcgagcgcgccacgcuguccugccgggcgagccaguccgucuacaccaagcucgccugguaccagcagaagcccgggcagccgccccgccugcugaucuacgacgccagcaaccgggccgccggcauccccgcgcgcuucuccgggagcggcuccgggaccgaguucacccucacgaucaagcggauggagcgcgaggacuucgccguguacuacugccagauccuggaguucuucggccagggcaccaccaucgacaugaac

SEQ ID NO: 8964 - RNA, 312 nt, Artificial Sequence
  derived and/or modified sequence opt1 from anti-HIV-1_LightChain
gacauccagaugacccagagccccuccagcguguccgccagcgucggcgaccgcgugaccaucacgugccgggccucccaggggauccugagcucccagcucgcguggcaccagcagcgccggggccagccgccccgccugcugaucuacgggggcagcaaccgggcccccgggauccccgagcgcuucaccggcuccggcagcgggaccgacuucgugcucaccaucaagcggcugcagcgcgacgacuucgccgucuacuacugccagauccuggaguucuucggccgggggacgcgcguggagaugaac

SEQ ID NO: 8965 - RNA, 312 nt, Artificial Sequence
  derived and/or modified sequence opt1 from anti-HIV-1_LightChain
ggccugcuccugacccagagccccgggccgguguccuucuuccccggcgagcgcgccaccgucagcugccgggccucccacagcgugaacuccgcggccaucaacugguaccagcagaagcgcgggcagccgccccggcugaucaucguggacggcagcacgcgcgccaccgccguccccgagcgguucuccgccaccgggagcggcaccgaguucacgcucgugaucucccgccuggagcccgaggacuucgcgguguacuucugccagcaccuccaguucuucggccuggggaccaaggucgacaucaag

SEQ ID NO: 8966 - RNA, 312 nt, Artificial Sequence
  derived and/or modified sequence opt1 from anti-HIV-1_LightChain
gccuucgugaugacccagagccccggcacccuggcccucuccccgggggagcgcgcgacgcugagcugccggaccucccaggagauccugagcaaccagcucgccuggcaccagcagcgccggggccagccgccccgccugcugaucuacgggggcuccaaccgggcccccgggauccccgagcgcuucaccggcagcggcuccgggaccgacuucguccucacgaucaaccggcuggagcgcgacgacuucgccguguacuacugccagauccuggaguucuucggccgggggacccgcguggagaugaac

SEQ ID NO: 8967 - RNA, 312 nt, Artificial Sequence
  derived and/or modified sequence opt1 from anti-HIV-1_LightChain
ggcaucgugcugacccagagccccgacacccucucccugagcccgggggaccgcgccacgcuguccugcaagaccagccaguccaucgccagcgagcaccucgcgugguaccagcagcggcccggccagccgccccgccugcugaucuucggggccuccaaccgggccagcggcauccccacccgcuucuccgggagcggcuccggcgccgacuucacccucagcaucacgcggcuggagcccgaggacuucgccgucuacuacugccaguucuccgaguucuucgggcgcggcgcgcggguggaggugaag

SEQ ID NO: 8968 - RNA, 312 nt, Artificial Sequence
  derived and/or modified sequence opt1 from anti-HIV-1_LightChain
caguucgugaugacccagagccccgccacccuguccagcuccccgggcgggacggccacccucagcugccgcaccucccacagcauccugaacucccagcuggcguggcaccagcagcggcgcggccagccccuccggcugcugaucuacggggccagcaaccgcgcccccggcauccccgagcgguucuccgccagcggguccggcaccgaguucguccucacgaucaagcgcauggagcgggaggacuucgccguguacuacugccagauccuggaguucuucggccaggggaccaccaucgacaugaac

SEQ ID NO: 8969 - RNA, 354 nt, Artificial Sequence
  derived and/or modified sequence opt1 from anti-HIV-1_HeavyChain
cgcgugcaccugguccagagcggcacccaggugaagaagcccggggccuccgugaaggucagcugcgagaccuccggcuucaaguuccucgacagccugauccacugggugcggcaggccccggggcagggccuguacuggaugggguggaucaagcccuaccgcggcuccgugaacuacgacggcuacuuccgggggcgcgucagcaugacgcgggacaucuacaccgacaccgcguaccucgagcuguccggccugcgcagcgacgacaccgccaucuacuacugcgccuucggggccggcgacgggugggaccucguguggggccagggcacgcuggugaucgucuccagc

SEQ ID NO: 8970 - RNA, 354 nt, Artificial Sequence
  derived and/or modified sequence opt1 from anti-HIV-1_HeavyChain
cgcgugcaccugguccagagcggcacccaggugaagaagcccggggccuccgugaaggucagcugcgagaccuccggcuucaaguuccucgacagccugauccacugggugcggcaggccccggggcagggccuguacuggaugggguggaucaagcccuuccgcggcuccgugaacuacgacggcuacuuccgggggcgcgucagcaugacgcgggacaucuacaccgacaccgcguacauggagcucuccggccugcgcagcgacgacaccgccaucuacuacugcgccuucggggccggcgacgggugggaccugguguggggccagggcacgcucgugaucgucuccagc

SEQ ID NO: 8971 - RNA, 354 nt, Artificial Sequence
  derived and/or modified sequence opt1 from anti-HIV-1_HeavyChain
caggugcaccugguccagagcggcacccaggugaagaagcccggggccuccgugcgcgucagcugcgagaccuccggcuucaaguuccucgacagcaucauccacugguuccggcaggccccgggggagggccuguucuggaugggguggaucaagcccuacacgggcuccgugaacuacgugcgccgguaccagggccgcgucagcaugacccgggacguguacuccgacaccgcguacauggaccugagcgggcucaacuccgacgacaccgccguguacuucugcacguacggcgccggggacggcuggaaccuggucugggggcagggcacccuggugaucgugagcgcc

SEQ ID NO: 8972 - RNA, 363 nt, Artificial Sequence
  derived and/or modified sequence opt1 from anti-HIV-1_HeavyChain
caggugcgccugguccagagcggcaaccaggugcggaagcccggggccuccgugcgcaucagcugcgaggccuccggcuacaaguucaucgaccacuucauccacuggguccgccaggugccggggcacggccucgaguggcugggguggaucaacccccggggcggcggggugaacuacagccggggcuuccaggggaagcuguccaugaccaugacccgcgacaacuucgaggagacggcguaccucgaccugagccggcugaaccccggcgacaccgccgucuacuacugcgcccgcggguucgccggcuacgagugguccuuccucuggggccaggggacccuggugaucgugagcucc

SEQ ID NO: 8973 - RNA, 357 nt, Artificial Sequence
  derived and/or modified sequence opt1 from anti-HIV-1_HeavyChain
caggugagccugguccaguccggcaaccagcucaagaagcccggggccagcgugcgcaucuccugcgagaccagcggcuacaacuuccugaaccacuucauccacugggugcggcaggucccggggcacggccuggaguggcucggguggaucaacccccgcggcggcggggugaacuacucccggaacuuccagggcaaggugagccugacccgcaacaucgacauggagacggucuaccuggacgugcgggggcucacccccggcgacaccgccguguacuacugcgcgcgcggguucggcggcuccgacuggaacuucgucugggggcagggcacccggaucacggugagcgcc

SEQ ID NO: 8974 - RNA, 357 nt, Artificial Sequence
  derived and/or modified sequence opt1 from anti-HIV-1_HeavyChain
cgcaucaaccugcaccagagcggcucccaggugaagcggagcggggccuccguccgcaucagcugcgagaccuccggcuucaaguucauggacagccaccuccacugggugcgccagguggccgggcagggcuucgaguggaugggguggaucuucaccuccggcggcggggucaacuacgcgcggcaguuccagggccggcugacgcugacccgcgacguguucaccgacaccguguucauggaccucagcggggucaacgugggcgacacggggguguacuacugcgucaagggcaccggcgggaacgaguggggcuucuccugggggcagggcaccgugguggucgugagcccc

SEQ ID NO: 8975 - RNA, 357 nt, Artificial Sequence
  derived and/or modified sequence opt1 from anti-HIV-1_HeavyChain
cgcaucaaccuggaccagagcggcucccaggugaagaaguccggggccagcguccggaucagcugcgagaccuccggcuucaaguucauggacagccaccuccacugggugcgccagguggccgggcagcccuucgaguggaugggcuggaucuucaccuccgggggcggcgucaacuacgcgcggcaguuccaggggcgccugacgcugacccgggacguguucagcgagaccguguucauggaccucuccggccugaacgccggggacaccggcgucuacuucugcgugaaggggacgggcggcaacgaguggggguucguguggggccaggggaccgucgugguggucagcccg

SEQ ID NO: 8976 - RNA, 357 nt, Artificial Sequence
  derived and/or modified sequence opt1 from anti-HIV-1_HeavyChain
cgcaucgagcugcaccagagcggcucccaggugaagaaguccggggccagcguccggaucagcugcgagaccuccggcuucaaguucauggacagccaccuccacugggugcgccagguggccgggcagcgguucgaguggaugggcuggaucuucaccuccgggggcggcgucaacuacgcgcgccaguuccaggggcggcugcgccugacgcgggacguguucagcgaguccguguucauggaccucagcggccugaacuccggggacaccggcgucuacuacugcgugaaggggaccggcggcaacgaguggggguucguguggggccaggggagccuggucgugguguccccc

SEQ ID NO: 8977 - RNA, 372 nt, Artificial Sequence
  derived and/or modified sequence opt1 from anti-HIV-1_HeavyChain
caggcccuggugcagagcggcucccagaugaagaagcccggggacagcguccgccucuccugccagaccagcgacuccgccaucaccaaguacuucauccacuggauccggcaggcgccgggcaaggggcuggaguggaucgccuggaucagccccuacggcgggcgcgugaacuacggcuggcagguccgggaccgcgccacgcugacccggaacauccacauggagaccguguacauggaccuccgcggccugcggcccgacgacaccgccacguacuacugcgccaugcgcgacuacugccgggacgacaacugcaaccgcugggaccuggggcacuggggccaggggucccucaucguggugagcgcg

SEQ ID NO: 8978 - RNA, 357 nt, Artificial Sequence
  derived and/or modified sequence opt1 from anti-HIV-1_HeavyChain
caggugacccugguccagagcggcaaccagcucaagcgccccggggccuccgugcggaucagcugcgagaccuccggcuacaacuucauggaccacuucauccacugggugcgccaggucccggggcacggccccgaguggcuggggugggugaacccccggggcggcggggugaacuacagccgcaaguuccagggccgguucuccaugacgcgcgacgucuacauggagaccgccuaccuggacgugaccgggcucagccccgcggacaccgccguguacuacugcgcccggggcuucgggggcuccgacuggagcuuccuguggggccaggggacgcugaucaucgucuccagc

SEQ ID NO: 8979 - RNA, 324 nt, Artificial Sequence
  derived and/or modified sequence opt1 from anti-HIV-1_LightChain
gagaucgugcugacccagagccccggcacccucucccugagcgccggggagcgcgccucccugagcugccgggccucccagacgcucaacagcaacuucuucgccugguaccaccagaagccgggccaggcgccccgccugcugaucuacggggccuccaaccgggccaccggcauccccgaccgcuucagcggguccggcagcggcuccgacuucacccucaccaucagccggcuggagcccgaggacuucgggaaguacuacugcgagcaguacgacgucuccccgcgcacguucggccaggggaccaagguggagaucaag

SEQ ID NO: 8980 - RNA, 324 nt, Artificial Sequence
  derived and/or modified sequence opt1 from anti-HIV-1_LightChain
gaggugguccugacccagucccccggcacccucucccugagcccgggggagcgcgccacgcuguccugccgggccagccaguccaucaacagcaacuucuucgccugguaccaccagaagcccggccaggcgccccgccuccugaucuacggggccuccagccgggccaccggcauccccgaccgcaucuccgggaccggcagcggcgccgacuucacccugacgaucaccgggcucgagccggaggacuucggccuguacuacugccagcaguacgacuucagcccccggaccuucgggcagggcacccgcguggagaucaag

SEQ ID NO: 8981 - RNA, 324 nt, Artificial Sequence
  derived and/or modified sequence opt1 from anti-HIV-1_LightChain
gaggugguccugacccagucccccggcacccucucccugagcccgggggagcgcgccacgcuguccugccgggccagccagaccaucaacuccaacuucuucgccugguaccaccagaagcccggccaggcgccccgccuccugaucuacggggccagcucccgggccaccggcauccccgaccgcaucagcggguccggcagcggcaccgacuucacgcugaccaucaccgggcucgagccggaggacuucggccuguacuacugccagcaguucgacuucagcccccggaccuucgggcagggcacgcgcguggagaucaag

SEQ ID NO: 8982 - RNA, 324 nt, Artificial Sequence
  derived and/or modified sequence opt1 from anti-HIV-1_LightChain
gagaucgugcugacccagucccccggcacccucucccuggccccgggggagcgcgccacgcugagcugccgggccucccagagcaucuccaccaccuaccucgccugguaccagcagaagcccggccaggcgccccgccugcugaucuacgagaccagcucccgggccagcgacauccccgaccgcuucuccgggagcggcuccgggacggacuucacccucaccaucagccggcuggagccggaggacuucgccgucuacuacugccaccaguacgaccgcagcccccggaccuucggccagggcacgaagguggagaucaag

SEQ ID NO: 8983 - RNA, 336 nt, Artificial Sequence
  derived and/or modified sequence opt1 from anti-HIV-1_LightChain
gacaucgugaugacccagagccccgccucccugagcgucaccccgggcgagacggccuccaucagcugcaagugcucccgcagccuccgggaggaggugggguacaacuaccuggacugguaccugcagcgccccggcaagagcccccagcuccugaucuacgugggguccuuccgggcgcccggcgucuccgagcgcuuccgggggagcggcgagcacaaggacuucacccugaagaucgcccgcguggagccgggcgacgccgggaucuacuacugcaugcagggcaucgacacgccccggaccuucgggcagggcaccacccucgagaucaac

SEQ ID NO: 8984 - RNA, 321 nt, Artificial Sequence
  derived and/or modified sequence opt1 from anti-HIV-1_LightChain
gacauccagaugacccagagccccuccagccuguccgccagcgugggcgaccgcgucaccaucacgugccgggccucccaggcguuccgcaacgaccucgggugguaccagcacaagccgggcaaggcccccgagcggcugaucuacgccaccagcacccuggaguccggggugcccagccgcuucuccggcagcggguccggcaccaacuucacgcucaccaucagcucccugcaggccgaggacuucgccaccuacuacugccugcaguacaacaccuucccccggacguucggccaggggaccaagguggagaucaag

SEQ ID NO: 8985 - RNA, 333 nt, Artificial Sequence
  derived and/or modified sequence opt1 from anti-HIV-1_LightChain
aacuucaugcugacccagccccacagcguguccgagagcccgggcaagaccgucacgaucuccugcgcccgcacccgcgggggcaucgacagcgccuacgugcacugguaccagcagcgccccggguccgugcccaccaccgucaucuucgaggacaaccggcggcccccgggcgugcccgaccgguucagcggguccaucgacacgagcuccaacaccgcgagccucaccaucuccggccugaagaccgaggacgaggccgacuacuacugccagagcuacgacgacacguacuucuggguguucggcgggggcaccaagcugaccguccuc

SEQ ID NO: 8986 - RNA, 333 nt, Artificial Sequence
  derived and/or modified sequence opt1 from anti-HIV-1_LightChain
aacuucaugcugacccagccccacagcguguccgagagcccgggcaagaccgucacgaucuccugcgcccgcacccgggggaccaucgacagcgccuacgugcacugguaccagcagcgccccggcgcggugcccaccacggucaucuucgaggacgaccggcgccccuccggggugccggaccgguucagcggcuccaucgacagcuccagcaacuccgccagccucaccaucuccgggcugaagaccgaggacgaggccgacuacuacugccagagcuacgacuccaacuacuacuggguguucggcggcgggaccaagcugacgguccuc

SEQ ID NO: 8987 - RNA, 396 nt, Artificial Sequence
  derived and/or modified sequence opt1 from anti-HIV-1_HeavyChain
caggugcagcugcagcagagcggccccgcccucgucaagccguccgagacccugagccugaccugcuccgugagcuccgggcgcgugagcuccuacuacuggagcuggauccggcagucccccggcaaggggcucgaguggaucggcuacauccacuacgaccccgacacgaacaccaacuaccgcacccacuaccaccccagccugcgggggcgcgucgugaucuccguggacagcuccaagagccaggucucccugaaggugcggagcgugaccgccgcggacuccgcccucuacuacugcgcccgccaccgguacgacccguggagcaagggcuacgacauccgcucccccuucgacuucuggggccaggggacgcuggucaccgugagcagc

SEQ ID NO: 8988 - RNA, 396 nt, Artificial Sequence
  derived and/or modified sequence opt1 from anti-HIV-1_HeavyChain
caggugcaccuccagcagagcggccccgggcuggucaagccguccgagacccugagccugaccugcacgguguccggcgggcgcgugagcuccuacuacuggagcuggauccggcagucccccggcaaggggcucgaguggaucggcuacauccacuacgaccccgacaccagcaccaacuaccgcacccacuaccaccccucccugcggggccgcgucgugaucagcguggacacguccaagaaccaggucagccugaccgugcgguccgugaccgccgccgacagcgcgcucuacuacugcgcccgccaccgguacgacgucugguccaacggguacgacauccgcagcccguacgacuucuggggccgggggacccuggugacgguguccagc

SEQ ID NO: 8989 - RNA, 396 nt, Artificial Sequence
  derived and/or modified sequence opt1 from anti-HIV-1_HeavyChain
caggugcaccuggagcagagcggccccgcccucgucaagccguccgagacccugagccugaccugcacgguguccgggggccgcgugagcuccuacuacuggagcuggauccggcagucccccgggaagggccucgaguggaucggguacauccacuacgaccccgacaccagcaccaacuaccgcacccacuaccaccccucccugcggggccgcgucgugaucagcguggacuccagcaagaaccaggucucccugaaggugcggagcgugacggccgcggacuccgcccucuacuacugcgcccgccaccgguacgacgucuggagcaagggcuacgacauccgcuccccguucgacuucugggggcggggcacccuggugaccgugagcucc

SEQ ID NO: 8990 - RNA, 390 nt, Artificial Sequence
  derived and/or modified sequence opt1 from anti-HIV-1_HeavyChain
cagguggucuuccagaagcccggcccggggguggugaagcccagcgagacccugucccugaccugcacggucagcggcgggcgcgugcgguccuacuacuggagcuggauccgccucccgcccggccaggggcuggaguggaucggcuacauccacuacgacgagaccaccgaguacaagcgguccuacaaccccagccucaagucccgcaucaccaucagcauggacacguccaagaaccaggugagccugaagcuguccagcgucaccgccgccgacgcggccguguacuacugcgcccggcaccgcuacgaccggugguccgacagcuacgacauccgcucccccuucgacaucuggggccaggggaccguggucaccgugagcgcc

SEQ ID NO: 8991 - RNA, 396 nt, Artificial Sequence
  derived and/or modified sequence opt1 from anti-HIV-1_HeavyChain
caggugcagcugcagcaguggggcgccgggcuccugaagcccagcgagacccugucccugaccugcgccaucuacggcagcuccuucagcgggcacuacuggauguggauccgccaguccccggcgaagacgcucgaguggaucgccgagaucaaccacaccggcgggacccgguacaaccccagccuggccucccgcguccggguguucagcgacaccuccaagaaccaguucagccucaacaugacgucccugaccgccgccgacaccggcaucuacuacugcgugcgcggccaccugagccgggaccgccucgggcaguacgcguucugguccggcgcccugaucgacuaccuggaccccugggggcagggcacccucgucacggugagcucc

SEQ ID NO: 8992 - RNA, 387 nt, Artificial Sequence
  derived and/or modified sequence opt1 from anti-HIV-1_HeavyChain
caggugcagcugcaccaguggggcgccgggcuccugaagcccagcgagacccugucccugaccugcgccgucuacggcagcuucacgggguuccaguggaccugggugcgccagaccccgggcaaggggcucgaguggaucggcgagaucaaccacuccggccugcucgugaccgggaagacggacuacaaccccagccuggagucccgggucaccaucagcguggacaccuccaagaaccaguucagccugaagcucaccuccgugacggcggccgacaccggcgucuacuacugcgcccgcgccgggggcaugagcgacugggccuaccccuacuacuacgggauggacguguggggccagggcaccauggugaccgucuccagc

SEQ ID NO: 8993 - RNA, 357 nt, Artificial Sequence
  derived and/or modified sequence opt1 from anti-HIV-1_HeavyChain
caggugcagcuggucgagagcggcgggggcguggugcagcccgggcgcucccucacccugagcugcgccaccuccggcuucgacuucagcuccuacggguuccacuggguccggcaggccccgggcaagggccugcagugggugagcaucaucucccacgacgggagcaucaagaacuacggcgacuccaugaaggggcgcuucagcgugucccgggacaacgcgaaggacauccucuaccugcagaugaacagccugcgccccgacgacacggcccucuaccacugcguccggggcgacggggagaacggcggcaccgacuacugggggcugggcacccuggugaccguguccgcc

SEQ ID NO: 8994 - RNA, 357 nt, Artificial Sequence
  derived and/or modified sequence opt1 from anti-HIV-1_HeavyChain
cagguggaccuggucgagagcggcgggggcguggugcagcccgggaagucccucaagcugagcugcaccgccuccggcuucaccuucacgagcuacgggaugcacuggguccgccagaucccgggcaagggccuggaguggguggccaucaucucccacgacgggaccaucaagaacuacggcgacagcgugaaggggcgguucaccaucucccgcgacaacgcgaugaacauccucuaccugcagaugaacaaccugcggggcgacgacaccgcccucuacuacugcguccgcggggacggcgagaacggcgggacggacuacuggggccaggggaccguggugaccgucagcucc

SEQ ID NO: 8995 - RNA, 369 nt, Artificial Sequence
  derived and/or modified sequence opt1 from anti-HIV_V3_HeavyChain
gaggugcagcugguccagagcggcgccgaggugaagaagcccggggagucccucaagaucagcugccagggcuucggguacaccuucuccaccuacuggaucggcugggugcgccagaugccggggaagggccuggaguggcugggcaucaucuaccccgaggacagcgagacgaucuacucccccagcuuccaggggcaggccaccaucuccgcggacaagagccucuccaccgccuaccugcaguggagcggccugcgggccuccgacagcgccaucuacuacugcgcccgccucggguacugcggcuccaccagcugcuccuucuucgacuucugggggcggggcacgcuggucaccgugagcucc

SEQ ID NO: 8996 - RNA, 369 nt, Artificial Sequence
  derived and/or modified sequence opt1 from anti-HIV_V3_HeavyChain
gaggugcagcugguccagagcggcgccgaggugaccaagcccggggagucccucaagaucagcugcaagggcuccggguacagcuucuccacccacuggaucgccugggugcgccagaugccgggccgggggcuggaguggaugggcuucaucuaccccgacgacagcgacacgcgcuacucccccagccugcagggccacgucaucaucuccgcggacaagagccucuccaccgccuaccugcaguggagcucccugaaggccagcgacaccgccauguacuacugcgcccggcucgggggcgacgaguaccaguccagcgggggcauggacgugugggggcagggcaccacggugaucgucuccagc

SEQ ID NO: 8997 - RNA, 393 nt, Artificial Sequence
  derived and/or modified sequence opt1 from anti-HIV_V3_HeavyChain
gaggugcagcugguccagagcggcgccgaggugaagaagcccggggccaccgugaagaucuccugcaaggucagcggcuacacccucacggacuacuacauccacugggugcagcaggcgccggggcgcggccuggaguggcuggggcucguggaccccgagaacggcgagacccuguacgccgagaaguuccagggccgggucacccugaccgccgacacguccaccgacaccgccuacauggagcucaagagccugcgcuacgaggacaccgccguguacuacugcgcgacggaggggccgcccuccuacuacgacagcggcaccuacgccaagucccugcccgccagcuucgccugcugggggcagggcacccucgugaccgucuccagc

SEQ ID NO: 8998 - RNA, 369 nt, Artificial Sequence
  derived and/or modified sequence opt1 from anti-HIV_V3_HeavyChain
caggugcagcugcaggagagcggccccgggcucgucaagccguccgagacccugagccugaccugcacgguguccggcgggagcaucaacaacuacuacugguccuggauccgccagccgcccggcaaggggcucgaguacaucggcuacaucuucuacagcggcuccaccaacuacaaccccagccugaagucccgggugaccuucagcgucgacaccuccaagaaccaguucagccugaagcucacguccgugaccgccaccgacaccgccguguacuacugcgcccgcgggccccugcuguacuucggcgcgccccggacgcacuucgacuacugggggcagggcgcccucgucaccgugagcucc

SEQ ID NO: 8999 - RNA, 372 nt, Artificial Sequence
  derived and/or modified sequence opt1 from anti-HIV_V3_HeavyChain
gaggugcagcugguccagagcggcgccgaggugaagaagcccggggagucccucaagaucagcugcaagggcuccggguacagcuucuccagccacuggaucggcugggugcgccagcugccggggaagggccuggaguggaugggcaucaucuaccccgacgacuccgacaccaaguacaaccccagcuuccaggggcaggucaccaucuccgccgaccggagcaucuccacggcguaccuccaguggagcucccugaaggccagcgacaccgccauguacuacugcgcccgcgugggcuacgacuccuacggguacagcggcuccaacuucgacgagugggggcagggcacccuggugaccgucagcucc

SEQ ID NO: 9000 - RNA, 357 nt, Artificial Sequence
  derived and/or modified sequence opt1 from anti-HIV_V3_HeavyChain
gaggugcagcugguccagagcggcgccgaggugaagaagcccggggagucccucaagaucagcugcaagggcuccggguacaacuucaacagcgacuggaucggcugggugcgccagaugcccgggaagggccuggagugggucggcaugaucuaccccgacgacuucgaggugcggcacuccccgcccuuccaggggcgcgugaccaugagcgucgacaaguccaucagcaccgccuaccugcagugguccagccucaaguccagcgacacgggcauguacuucugcgcgcggcuggacgggaacgccgccgccuucgacuacuggggccaggggacccaggugaccguguccagc

SEQ ID NO: 9001 - RNA, 360 nt, Artificial Sequence
  derived and/or modified sequence opt1 from anti-HIV_V3_HeavyChain
gacgugcagcugguccagagcggcgccgaggugaagaaggccggggagucccucaagaucagcugccgccccuccggcuacaacuucgcggacuacuggaucgggugggugcggcagaugccgggcaaggggcuggaguggaugggcaucaucuuccccgacgacagcgacacccgcuacggccccuccuucgaggggcaggucaccaucagcgccgacaaguccaucaacacggccuaccugcaguggaacagccucaaggccuccgacaccgccauguacuucugcgcgcggcacggcgggagcggcgccgcccccggggacuacuggggccagggcacccuggugaccguguccagc

SEQ ID NO: 9002 - RNA, 363 nt, Artificial Sequence
  derived and/or modified sequence opt1 from anti-HIV_V3_HeavyChain
gaggugcagcugguccagagcggcgccgaggugaagaagcccggggccaccgugaagaucuccugcaaggucagcggcuacaccuucacggacuacuucaugcacugggugcaggaggcgccggggaagggccucgccuggauggggcugguggaccccgagaacggcgacaccgucuacgccgagaagcugcagggccgcgugaccauguccgccgacaccagccgggacacggccuacauggagcucaccucccugcgcagcgaggacaccgcgguguacuacugcgccaucgggaaguccgucgccggcaccagcgccuacgacaucugggggcagggcacgauggugaccguguccagc

SEQ ID NO: 9003 - RNA, 369 nt, Artificial Sequence
  derived and/or modified sequence opt1 from anti-HIV_V3_HeavyChain
caggugcagcugguccagagcggcgccgaggugcgcaagcccggggccuccgugaaggucagcugcaaggcguccggcgacaccuucaacaaccacgacaucaacugggugcggcaggccccggggcagggccccgagugggugggguggaugaaccccaagagcggcaacgccggcuacgcccagaaguuccaggggcgcgucaccaugacgcgggacaccuccaucagcaccgccuacauggagcuccgcucccugaccagcgaggacacgggcguguacuacugcgcgcggcugaccguggacugcgacgacgggggcugcuacggggacuacuggggccagggcacccucgucaccguguccagc

SEQ ID NO: 9004 - RNA, 354 nt, Artificial Sequence
  derived and/or modified sequence opt1 from anti-HIV_V3_HeavyChain
gagguguaccugcagcagagcggcgccgagcucaaggagcccggggccaacgucaagaucuccugcaaggcguucggcuucaucuucaccgacuacuucauccacuggcugcgccaggccccggggaagggcccccaguggguggggguggucgaccccgaggacggcagcaccacguacgccgaggccuuccagggccggguguccaucaccgccgaccgcagcaccgacaccgcguacauggaccuggccgggcucacguccgacgacaccgccguguacuacugcgcccugauguggaacgagagcggccccgacaacugggggcagggcacccuggucaucguguccagc

SEQ ID NO: 9005 - RNA, 393 nt, Artificial Sequence
  derived and/or modified sequence opt1 from anti-HIV_V3_HeavyChain
gaggugcaggucguggaguucggcggggaggugaagaagcccggcgccagcgucaagguguccugcgaggccagcggguacaccuucgccaaguucgccauccacugggugcgccaggccccgcggcagggccuggaguggaugggguggaucaacggcgacgacggcaagaccgaguacucccagaaguuccaggaccgcgucacgaugacccgggacaccagcgccuccaccguguacauggagcucagcucccugcgcagcgaggacacggcccuguacuacugcgcgcgggccauguaccccgacaccgugaccgggaacgacaaccccgcgcccccgcccuucgagggcgacuacugggggcagggcacccucgucacgguguccagc

SEQ ID NO: 9006 - RNA, 393 nt, Artificial Sequence
  derived and/or modified sequence opt1 from anti-HIV_V3_HeavyChain
gaggugcagcuggucgagagcggcgggggccucgugaagcccgggggcucccugcgccugaccugcguggccagcggguucaccuucuccgacgucuggcucaacugggugcggcaggccccgggcaagggccuggaguggguggggcgcaucaagagccggacggacggcgggaccaccgacuacgcggccuccgucaagggccgcuucaccaucagccgggacgacuccaagaacacgcuguaccuccagaugaacagccugaagaccgaggacaccgccguguacuccugcaccacggacggguucaucaugauccgcggcgugagcgaggacuacuacuacuacuacauggacgucuggggcaaggggaccaccgugaccguguccagc

SEQ ID NO: 9007 - RNA, 387 nt, Artificial Sequence
  derived and/or modified sequence opt1 from anti-HIV_CD4bs_HeavyChain
gaggagcagcugguggagagcggcgggggccucgucaagcccgggggcucccagcgccugagcugcgccgccuccgaguucaccuucagccgguacaccaugaacugggugcgccaggcgccggggaagggccuggaguggguguccagcaucuccggcaacgacaacaacaucuacuacgccgacagcgucaaggggcgguucacgaucucccgcgacaacgcccggaacagccucuaccugcagaucaacucccugcgcguggaggacaccgccguguacuacugcgcccggggcccccucgacagcuacgacuucugguccgggagccgccacuacuacggccuggacgucugggggcagggcaccaccgugacgguguccagc

SEQ ID NO: 9008 - RNA, 372 nt, Artificial Sequence
  derived and/or modified sequence opt1 from anti-HIV_CD4bs_HeavyChain
caggugcagcugguccagagcggcuccgagcucaagaagcccggggccagcgugaagguguccugcaaggccagcggcuacaccuucaccucccacaucaucaacuggguccgccaggcgccggggcagggccuggaguggaugggguggaucaacacgaacaccggcaaccccaccuacgcccagggcuucaccgggcgguucguguucagccuggacacguccgugagcauggccuaccuccagaucuccagccugaaggccgaggacaccggcgucuacuacugcgcccgcggguuccggcaguggcugguggcgcgcaucaccuacuucgacuacuggggccaggggacccucgugacggucuccagc

SEQ ID NO: 9009 - RNA, 369 nt, Artificial Sequence
  derived and/or modified sequence opt1 from anti-HIV_CD4bs_HeavyChain
gagcugcgccuccaggccagcggccccgggcuggugaagccguccgagacccugagccucgucugcuccgugagcggcguguccaucagcgacuccuacuggaacuggauccggcagcccgccgggaagggccuggaguggaucgggcgcgucuacacccggggcacgcacaccuacaaccccagccugggcgggcgcgcgaccguguccggcgacaccaacaagaacgaggugagccucaagcugauguccgucacggccgccgacaccgccguguacuacugcgcccgggcgcugagcggggacuggacccgccgguacuucuacauggacguguggggccgcgggacccccgucacgguguccagc

SEQ ID NO: 9010 - RNA, 381 nt, Artificial Sequence
  derived and/or modified sequence opt1 from anti-HIV_CD4bs_HeavyChain
cagcugcagcuccaggagagcggcccccgccuggugaagccguccgagacccugagccugaccugcacggucuccgggggcagcaucuccagcggggacuacuacuggaccuggauccggcagccgcccggcgaggggcuggaguacaucggcuacaucuacuccggcgggagcaccgacuacaaccccucccucaagagccgcgccuccaucagccaggacaccuccacgaacgaguucagccucaagcugaccuccgugaccgccgcggacaccgccguguacuucugcgcccgggaccgccggguccugcucugguucggcgagccccgccgggggcuggacuucuggggccccgggacgcuggugaccgugagcucc

SEQ ID NO: 9011 - RNA, 396 nt, Artificial Sequence
  derived and/or modified sequence opt1 from anti-HIV_CD4bs_HeavyChain
gaggugcagcuggucgagagcggcgggggccucgugaagcccgggggcucccugcgccugagcugcgccgccuccggguucaccuucagcuccgcguggaugagcugggugcggcaggccccgggcaagggccucgagugggucgggcgcaucaaguccaagagcgacggcgagaccacggacuacgccgcccccgugaaggggcgguucaccaucucccgcgacaaccuggagagcacccuguaccuccagcugaacucccugaagaccgaggacacggccguguacuacugcgcgaccgccacccccagcuacuacgacaucaugaccggcaacuacaaguacuacuacuacauggacgucugggggaagggcacgaccgugaccguguccagc

SEQ ID NO: 9012 - RNA, 363 nt, Artificial Sequence
  derived and/or modified sequence opt1 from anti-HIV_CD4bs_HeavyChain
caggugcagcuggucgagagcggcgggggccucgugaagcccgggggcucccugcgccugagcugcgccgccuccggguucaucuuccgggaccacuacaugaccuggauccgccaggcgcccggcaagggccucgagugggugagcuacaucuccagcuccagcaacaacauccaguacgccgacuccgucaaggggcgguucaccgugagccgcgacaacgccaagaacucccuguaccugcagaugaacagccuccgggccgacgacacggccguguacuacugcgcgcgcuccggccccuucuacaacuacgggccgcccaacaacuggggccaggggacccuggucaccgugagcucc

SEQ ID NO: 9013 - RNA, 378 nt, Artificial Sequence
  derived and/or modified sequence opt1 from anti-HIV_CD4bs_HeavyChain
caggugcagcuggucgagagcggcgggggcguggugcagcccgggggcucccucacccugagcugcaccgccuccggguucccguucaacagcuacgccaugcacuggguccgccaggcgcccggcaagggccuggaguggguguccaugacgagccacgacgggggcaacaaggacuucguggacuccgucaaggggcgguucaccaucagccgcgacaacucccggaacacccucuuccugcagaugaacagccugucccaggacgacaccggcguguacuacugcgugcgcgggaagcucgaggacuacaacuucuggggccacuaccgggacuucgacagcuggggccaggggacgcuggucaccguguccgcc

SEQ ID NO: 9014 - RNA, 405 nt, Artificial Sequence
  derived and/or modified sequence opt1 from anti-HIV_CD4bs_HeavyChain
gagccccacguggucgagagcggcgggggcauggccaagcccgggggcucccugcgccucagcugcgccggguccggcuucaccuucaccaacgcguggaugaacugggugcggcaggccccgggcaaggggcuggagugggugggccugaucaagagcaaguccgacgggggcacgaccgacuacgccgccgacgucgaggggcgcuucaccaucagccgggacgaccucgaguccaccauguuccuggagaugcacagccugcagaucgaggacacggccguguacuucugcaccacccaguacccccgcuacuacgaccucaugaccggcaacuacaagcggcgcuacuucuccagcggcauggacgugugggggcagggcacggcggucaccguguccagc

SEQ ID NO: 9015 - RNA, 384 nt, Artificial Sequence
  derived and/or modified sequence opt1 from anti-HIV_CD4bs_HeavyChain
caggugcagcugcaggagagcggccccgggcucgucaagccgucccagacccugagccugaccugcacgguguccggcgacagcguguccagcgggaacuacuacugguccuggauccgccagcccgccggcaagccccucgaguggaucgggcacaucagcaccggcggcgggaccaagaacaaccccucccugcagagccgggucaccaucucccuggacagcuccaagaaccaggugagccucucccugagcuccgugacggccgcggacaccgccgucuacacgugcgcccgcggcccgccccggagccugugguucggggaccccaccuacuccuacauggacguguggggcaaggggaccaccgugaccgucagcagc

SEQ ID NO: 9016 - RNA, 372 nt, Artificial Sequence
  derived and/or modified sequence opt1 from anti-HIV_CD4bs_HeavyChain
caggugcagcugguccagagcggcgccgaggugaagaagcccggguccagcgugaaggucuccugcaaggccagcggcgggaccuucaacucccacgcguucaccugggugcgccaggccccgggccaggggcucgaguggaugggcggcaucauccccacgcuggggcuggccaacgacgcccagaaguuccagggccgguucaccaucaccgccgacgagagcaccacgaccguguacauggagcucuccagccugcgcuccgaggacaccgcggucuacuacugcgcccggcgccccuacuacgaccaggugagcggggugggcgccuucgacaucugggggcagggcacccgggucacgguguccagc

SEQ ID NO: 9017 - RNA, 390 nt, Artificial Sequence
  derived and/or modified sequence opt1 from anti-HIV_V2_HeavyChain
caggugcagcugguccagagcggcgccgaggugaagaagcccggguccagcgugaaggucuccugcgaggccagcggcgugaccuccagcuccuacaccaucagcugggugcgccucgcgccggggcagggccuggaguggauggggcggaucacgcccaucuucgacaucaccaacuacgcccagaaguuccagggccgcgucacccugaccgccgacaaguccacgggcaccaccuacauggagcucagcucccugcggagcgacgacaccgccguguacuacugcgcccgcgacaaguccgacguggucguggugacgagcauccggcccgcguacuacuacgggauggacgucuggggccaggggaccaccgugaccguguccagc

SEQ ID NO: 9018 - RNA, 366 nt, Artificial Sequence
  derived and/or modified sequence opt1 from anti-HIV_V2_HeavyChain
caggugcagcugguccagagcggcgccgaggugaagaagcccggguccagcgugaaggucuccugcaaggccagcggcgggaccuuccgcuccuacgcgaucagcugggugcggcaggccccgggccaggggcucgaguggaugggcggcaucauccccaucuucgggaccgccgacuacgcccagaaguuccagggcaaggugacgaucaccgccgacgaguccaccagcaccgcguacauggagcuguccagccugacguccgaggacaccgccauguacuacugcgcccgcagccgggaccacuucuucgacacccgcgucuuccagggguggggccaggggacccucgugacgguguccagc

SEQ ID NO: 9019 - RNA, 363 nt, Artificial Sequence
  derived and/or modified sequence opt1 from anti-HIV_V2_HeavyChain
caggugcagcugguccagagcggcgccgaggugaagaagcccggguccagcgugaaggucuccugcaaggccagcggcgggaacuucaacaccuacaccaucuccugggugcgccaggcgccgggccaggggcucgaguggaugggccggaucauccccaucuucggcaucgugaaccccgcccagaaguuccccgggcgcgucacgaucaacguggacaagagcaccaacaccgccuacauggagcuguccagccugcgguccgaggacaccgccguguacuacugcgccacgagcggcgucgggcuccacuucggcuacuucgacuacugggggcagggcacccaggugaccguguccagc

SEQ ID NO: 9020 - RNA, 378 nt, Artificial Sequence
  derived and/or modified sequence opt1 from anti-HIV_V2_HeavyChain
caggugcagcugcagcaguggggccccgggcuccugaagccgagcgagacccugucccugaccugcgccgucuacggcgggagcuucggccgcuacuacugguccuggauccggcagagcuccggggagggccucgaguggcugggccagaucgaccacacggggagcaccaccuacaaccccucccucaagggccgcgugaccaucagcaucgacuccagcacgaaccaguucucccugaaggugaccagcgucaucgccgcggacaccgccguguacuacugcgcccgggcccccuccggguaccccggcgugagccuguaccaguacuacgggcucgacgucuggggccagggcaccacggugaccguguccccg

SEQ ID NO: 9021 - RNA, 366 nt, Artificial Sequence
  derived and/or modified sequence opt1 from anti-HIV_V2_HeavyChain
caggugcagcugguccagagcggcgccgaggugaagaagcccggguccagcgugaaggucuccugcaaggccagcggcgggaccuucuccaacuacgcgaucagcugggugcgccaggccccgggccaggggcucgaguggaugggcggcaucauccccaucuucgggaccacggacuacgcccagaaguuccagggccgggugaccaucaccgccgacgccuccaccagcacggcguacauggagcuguccagccugcgcuccgacgacaccgccgucuacuacugcgcccggagccgcgggcacuacuucgacacccggguguucgagggcugggggcagggcacccucgugacggucuccagc

SEQ ID NO: 9022 - RNA, 372 nt, Artificial Sequence
  derived and/or modified sequence opt1 from anti-HIV_V2_HeavyChain
caggugcaccugguccagagcggcaccgaggugaagaagcccggggccuccgugaccgucagcugcaaggccuccggcuacagcuucacgggguacuaccuccacugggugcgccaggcgcccggccaggggcuggaguggaugggcuggaucaaccccaacuccggcgggaccuacuacgcccagaacuuccaggcccgggugaccaugacccgcgacacgagcaucuccaccgucuacauggaccugagccggcuccgcuccgacgacaccgccguguacuacugcgugcggcgcgccguccugaccgcgcugccgccccgguacuacuucgacuucuggggccaggggacgcucgugaccgugagcucc

SEQ ID NO: 9023 - RNA, 318 nt, Artificial Sequence
  derived and/or modified sequence opt1 from anti-HIV_V3_LightChain
agccuggagcucacccagcccccguccgugagcgucucccccggccagaccgugagcaucacgugcuccgggaaccugcugggcgacaaggacgccagcugguaccagcucaagcccgggcagucccccauccuggugaucuaccuggacaccgagcgcccgagcggcauccccgagcgguucuccgggagcaaguccggcaacaccgccacccucacgaucagcggcacccaggcgauggacgaggccgaguacuucugccaggccugggacaccaccacgguccuguucgggggcgggacccgccugaccgugcuc

SEQ ID NO: 9024 - RNA, 324 nt, Artificial Sequence
  derived and/or modified sequence opt1 from anti-HIV_V3_LightChain
agcgacgagcugacccagcccccguccgugagcgucucccccggccagaccgcccgcaucacgugcagcggggacgcccuccccgagaaguacgcguacugguaccagcagaaguccggccaggcccccgugcuggugaucgacgaggacaacaagcggccguucgggacccccgagcgcuucagcggcucccggagcgggaccauggccacccugacgaucaccggcgcccagauggaggacgaggccgacuacuacugcuccagcaccgacucccgcggcaccuacugggucuucgggggcgggacgaagcucaccgugcug

SEQ ID NO: 9025 - RNA, 336 nt, Artificial Sequence
  derived and/or modified sequence opt1 from anti-HIV_V3_LightChain
cagagcgugcugacccagcccccguccgucagcgccgcccccggccagaaggugaccaucuccugcagcgcggggaacuccaagaucggcgacaacuacaucagcugguaccagcacgugcccggggccgcccccaagcuccugaucuacgagaacgacaagcgcccguccggcauccccgaccgguucagcggguccaagagcggcacguccgccagccugggcaucaccgggcuccagaccggcgacgaggccgacuacuacugcgcggccugggacaacucccugagcuccgcccuguacgucuucgggaccggcacgaaggugaccgugcuc

SEQ ID NO: 9026 - RNA, 339 nt, Artificial Sequence
  derived and/or modified sequence opt1 from anti-HIV_V3_LightChain
gacaucgugaugacccagagccccgacucccuggccgucagccucggcgagcgcgccaccaucaacugcaaguccagccagaacguguucuacuccagcaacaaccggaacuaccuggcgugguaccagcagcgccccgggcagccgcccaagcuccuguucuacugggccuccacgcgggagagcggcgugcccgaccgcuucuccgggagcggcuccgggaccgacuucacccugaccaucagcucccugcagacggaggacgucgccaucuacuacugccagcaguacuacaacaccccgcccaccuucggccccggcaccaagguggagaucaag

SEQ ID NO: 9027 - RNA, 318 nt, Artificial Sequence
  derived and/or modified sequence opt1 from anti-HIV_V3_LightChain
agcuacgagcugacccagcccccguccgugagcgucucccccggccagaccgccacgaucacgugcagcggggaccuccugggcgacaaguacgccuccugguaccgccagaagcccgggcagagccccgugcuggugaucuacgaggacaccaagcggccguccggccuccccgagcgcuucagcggguccaacagcggcaacaccgcgacccugaccaucuccgagacccaggccauggacgaggccgacuacuacugccaggccugggacacccggacggucguguucggcgggggcaccaagcugaccgugcuc

SEQ ID NO: 9028 - RNA, 327 nt, Artificial Sequence
  derived and/or modified sequence opt1 from anti-HIV_V3_LightChain
cagagcgugcugacccagcccccguccgucagcgccgcccccggccagaaggugaccaucuccugcagcgggcgcuccagcgacaucgagaacaaguucguguccugguaccagcagcuccccggcacggcgcccaagcugcugaucuacgaggacaacaagcggccgagcgggauccccgaccgcuucuccggcagcaaguccgggaccagcgccacccucggcaucaccggccugcagacgggggacgaggccgacuacuacugcggcaccugggacaacaaccugcgggccggguucggcgggggcacccaccucaccguccug

SEQ ID NO: 9029 - RNA, 324 nt, Artificial Sequence
  derived and/or modified sequence opt1 from anti-HIV_V3_LightChain
agcuacgagcugacccagcccccguccgugagcgucucccccggccagaccgcccgcaucacgugcagcggggacgcccuccccaacaaguacgcguucugguaccagcagaaguccggccaggcccccgugcuggugaucuucgacgacaaccggcgcccggccgggauccccgagcgguucagcggcucccgcagcgggacccuggccacccucaccaucuccggcgcccaggucgaggacgaggcggacuacuacugcuacagcacggacaacgacggcaaguacuucguguucggguccggcaccauggugaccguccug

SEQ ID NO: 9030 - RNA, 318 nt, Artificial Sequence
  derived and/or modified sequence opt1 from anti-HIV_V3_LightChain
agcuacgagcugacccagcccccguccgugagcgucucccccggccagaccgccagcaucacgugcuccgggcacaagcucggcgacaaguacgccagcugguaccagcacaagcccgggcagucccccgugcuggugaucuacgaggacacccagcgcccgagcggcauccccgagcggaucuccgggagcaaguccggcaacaccgcgacccugacgaucagcggcacccaggccauggacgaggccgacuacuacugccaggccugggacucccgcgccgcggucuucgggggcgggacccggcucaccgugcug

SEQ ID NO: 9031 - RNA, 327 nt, Artificial Sequence
  derived and/or modified sequence opt1 from anti-HIV_V3_LightChain
cagagcgcccugacccagcccgccuccgugagcggcuccccggggcagagcaucaccaucuccugcacgggcaucagcuccgacaucgggaccgacaacuacgucagcugguaccagcagcaccccggcaaggcgcccaagcucaucaucuacgagguguccaaccgccccagcgggaucucccaccgguucagcggcuccaagagcggcaacaccgccucccugaucaucagcgggcuccagguggaggacgaggcccacuacuacugcaacuccuaccgcagcgacacccuggucuucggcgggggcacgaaggugaccgugcug

SEQ ID NO: 9032 - RNA, 333 nt, Artificial Sequence
  derived and/or modified sequence opt1 from anti-HIV_V3_LightChain
cagagcgugcugacccagcccccguccgccagcggcacccccgggcagcgcgucacgaucuccugcagcggcuccagcuccaacaucgggagcaacaccgugaacugguaccagcaccuccccggcaccgcccccaagcugcugaucuacuccaacgaccagcggccgagcggggugcccgaccgcuucuccggcagcuccagcggcaccuccgcgagccucgccaucuccgggcugcagagcgaggacgaggccgacuacuacugcgccgccugggacgacucccugaacggccccuucgucuucgggacgggcaccaaggugaccgugcuc

SEQ ID NO: 9033 - RNA, 318 nt, Artificial Sequence
  derived and/or modified sequence opt1 from anti-HIV_V3_LightChain
gacauccagaugacccagagccccuccagccuguccgccagcgugggcgaccgcaucaccaucacgugccggaccucccagagcaucgacaaccaccucaacugguaccagcacaagccggggaaggcccccaagcugcugaucuccgcggccagccgccuccaguccggcguccccagccgguucaccggguccggcagcgggaccgaguucacgcugaccaucuccagccugcagcccgaggacuucgccguguacuacugccagcaguccuacaucaccaucaccuucggcccgggcacgaagguggacaucaag

SEQ ID NO: 9034 - RNA, 321 nt, Artificial Sequence
  derived and/or modified sequence opt1 from anti-HIV_V3_LightChain
gagaucgugaugacccagagccccgccacccuguccgucagcccgggcgagggggugacgcucuccugccgcgccagccaguccgugagcuccaacauccugugguaccagcagcggcccggccaggcgccccgccugcuccuguacggggccagcacccgggccaccggcauccccgcccgcuucuccgggagcggcuccggcaccgaguucacgcugaccaucaacagcaugcaguccgaggacuucgccaucuacuacugccagcaguaccacgacuggcucuggacccuggggcagggcacccaggucgagaucaag

SEQ ID NO: 9035 - RNA, 327 nt, Artificial Sequence
  derived and/or modified sequence opt1 from anti-HIV_V3_LightChain
agcuacgagcugacccagcccccguccgugagcgucucccccggccagaccgccagcaucacgugcuccggggacaagaugggcgagcgcuacaccagcugguaccagcagaagcccgggcagucccccgugcucgugaugagcgagaacaucaagcggccggccggcauccccgagcgcuucuccgggagcuccagcggcaacaccgcgauccugaccaucuccggcacgcaggccgucgacgaggccgacuacuacugccaggugugggacaccaccaccacgagcuacgugaucuucgggggcgggaccaagcugaccguccuc

SEQ ID NO: 9036 - RNA, 321 nt, Artificial Sequence
  derived and/or modified sequence opt1 from anti-HIV_V3_LightChain
gacauccagaugacccagagccccuccagccuguccgccagcgugggcgaccgcgucaccaucacgugccaggccucccaggacaucgggaacuaccucaacugguaccaccagaagccgggcaaggcgcccaagcugcugaucuacgacgccagcaacguggagaccgggguggccucccgguucagcggcuccgggagcggcaccgacuucacccucacgaucuccagccugcagcccgaggacaucggcaccuacuucugccagcaguacgagucccugcccugggccuucgggggcgggaccaaggucgagauccgc

SEQ ID NO: 9037 - RNA, 333 nt, Artificial Sequence
  derived and/or modified sequence opt1 from anti-HIV_V3_LightChain
aacuucaagcugacccagccccacagcguguccgagagcccgggcaagaccgucacgaucuccugcacccgcaccagcgggaccaucgccacgaacuacgugcagugguuccagcagcggcccggcuccagccccaccaccaugaucuacgagaacgacaagcgccccuccggggugccggaccgguucagcggcuccaucgacaccagcuccaacagcgccucccucacgaucagcgggcugaagaccgaggacgaggcggacuacuacugccaguccuacaacagcaccgacaucgucguguucggcggcgggaccaagcugacggugcuc

SEQ ID NO: 9038 - RNA, 327 nt, Artificial Sequence
  derived and/or modified sequence opt1 from anti-HIV_V3_LightChain
cagagcgugcugacccagcccccguccgucagcgccgcccccggccagaaggugaccaucuccugcagcggguccagcuccaacaucggcaacaacauggugagcugguaccagcagcaccccgggacggcgcccaagcuccugaucuacgagaacuccaagcgcccgagcggcauccccgaccgguucuccgggagccgcuccggcaccagcgccacccugggcaucaucgggcuccagaccggcgacgaggccgaguacuacugcgccacgugggacgggucccugcggaccgucuucggcgggggcaccaagcugaccgugcuc

SEQ ID NO: 9039 - RNA, 324 nt, Artificial Sequence
  derived and/or modified sequence opt1 from anti-HIV_V3_LightChain
agcuacgagcugacccagcccccguccgugagcgucucccccggccagaccgcccgcaucacgugcagcggggacgcccuccccaaccaguacggcuacugguaccagcagaagcccgggcaggcgccggugcuggugaucuucaaggacuccgagcggcccagcggcauccccgagcgcuucuccgggagcuccagcggcaccaccgucacccugacgaucuccggcgugcaggccgaggacgaggccgacuacuacugccagagcgccgacuccagcgggaacuacgagguguucggcgggggcaccaagcucaccguccug

SEQ ID NO: 9040 - RNA, 330 nt, Artificial Sequence
  derived and/or modified sequence opt1 from anti-HIV_V3_LightChain
cagagcgugcugacccagcccccguccgucagcgaggcgccccgccagcgggugaccaucuccugcagcggcuccagcuccaacaucgggaacaacgccgugaacugguaccagcagguccccggcaaggcccccaagcuccugaucuacuacgacgaccugcucccgagcgggguguccgaccgcuucagcggcuccaagagcggguccagcgccucccuggccaucagcggccugcaguccgaggacgaggccgacuacuacugcgccgcgugggacgacagccucaagguguacgucuucggcacggggaccuccgugaccgugcug

SEQ ID NO: 9041 - RNA, 333 nt, Artificial Sequence
  derived and/or modified sequence opt1 from anti-HIV_V3_LightChain
gacaucgugaugaaccagagcccgcccucccuggccgucacccccggcgagcccgccagcaucuccugccgcgcgagccagucccuccuguacagcgacgggcacaacuaccuggacugguaccuccagaagcccggccaggccccgcagcugcugaucuaccucggguccacccgggccagcggcgugcccgaccgcuucuccgggagcggcuccggcacggacuucacccugaagaucagccggguggaggccgaggacgucgggguguacuacugcaugcagccccugcaguccuacaccuucggccaggggaccaagcucgagaucaag

SEQ ID NO: 9042 - RNA, 321 nt, Artificial Sequence
  derived and/or modified sequence opt1 from anti-HIV_V3_LightChain
gccuacgagcugacccagcccccgagcguguccgucagccccggccagaccgcccgcaucacgugcuccggggacgcgcuccccaaccaguacgccuacugguaccaccagcggcccggccaggccccggugcuggugauccacaaggacaccgagcgccccagcgggauccccgcccgguucuccggcagcuccagcgggaccaccgucacgcugaccaucuccgaggugcaggccgaggacgagggcgacuacuacugccagagcgcggacaccuccgccuacguggucuucggcgggggcaccaagcucacggugcug

SEQ ID NO: 9043 - RNA, 330 nt, Artificial Sequence
  derived and/or modified sequence opt1 from anti-HIV_V3_LightChain
cagagcgugcugacccaggcccccuccagcuccggcaccccggggcagagcgucacgaucuccugcagcggcuccagcuccaacauggagaucaacuacguguacugguaccgccaguuccccgggaccgcgccccagcuccugaucuacaacgacaaccagcggcccagcggcgugccggaccgcuucuccgccagcaaguccgggaccagcgccucccuggccaucggcggccuccggagcgaggacgaggccgacuacuucugcgccgucuggcacggggaccgcggcgggcccguguucggcgggggcaccaagcugacggugcug

SEQ ID NO: 9044 - RNA, 327 nt, Artificial Sequence
  derived and/or modified sequence opt1 from anti-HIV_V3_LightChain
agcuacgagcugaagcagccccgcuccgugagcgucuccccgggccagaccgcccggaucacgugcagcggggacgccaugcccaaccaguacgcguacugguaccagcagcgccccggccgggcccccgugcuccugaucuucaaggacaacgagcgcgccuccgggaucccggagcggaucagcggcuccagcuccgggaccaccgccacccugaccaucaaccgcgugcaggccgaggacgaggcggacuaccucugccagagcgccgacuccagcggcgccuuccccugggucuucggcgggggcacgacccugaccgugcug

SEQ ID NO: 9045 - RNA, 324 nt, Artificial Sequence
  derived and/or modified sequence opt1 from anti-HIV_V3_LightChain
agcuacgagcugacccagcccccguccgugagcgucucccccggccagaccgcccgcaucacgugcagcggggacgcccuccccaaggaguacgcguacugguaccagcagaaguccggccaggcccccgugcuggugaucuacgaggacacccggcgcccgagcgggauccccgagcgguucuccggcagcuccagcgggaccauggccacccugacggucuccggcgcccacguggacgacgaggccgacuacuacugcuacagccgcgacaccuccgcgaaccaguggguguucggcgggggcaccaagcucaccguccug

SEQ ID NO: 9046 - RNA, 318 nt, Artificial Sequence
  derived and/or modified sequence opt1 from anti-HIV_V3_LightChain
gagaucgugcugacccagagccccgccacccucucccugagcccgggcgagcgcgccacgcuguccugccgggcgagccaguccaucagcaccuaccucgggugguaccagcagaagcccggccaggcgccccgccugcugaucuacgacgccuccaaccgggccaccgggauccccgcccgcuucagcggcuccgggagcggcaccgacuucacgcucaccaucuccagccuggagccggaggacuucgccgucuacuacugccagcagcgguacaccuggaucaccuucggccaggggacgcgccuggagaucaag

SEQ ID NO: 9047 - RNA, 327 nt, Artificial Sequence
  derived and/or modified sequence opt1 from anti-HIV_V3_LightChain
agcuacgagcugacccagcccccguccgugagcgucucccccggccagaccgcccgcaucacgugcagcggggacgcccuccccaaccaguacguguacugguaccagcagcggcccggccaggcgccgguggucgugcuguacaaggacaccgagcgccccuccgggauccccgagcgguucagcggcuccagcuccgggaccaccgugacgcugaccaucagcggcguccaggccgaggacgaggccgacuacuacugccaguccgccgacaacagcggcgccuacccccucuucuucgggggcgggaccaagcugaccgugcug

SEQ ID NO: 9048 - RNA, 333 nt, Artificial Sequence
  derived and/or modified sequence opt1 from anti-HIV_V3_LightChain
cagagcgugcugacccagcccccguccgucagcgccgcccccggccagaaggugaccaucuccugcagcggguccagcuccaacaucggcaacaacuacgugcucugguaccagcaguuccccgggacggcgcccaagcugcugaucuacggcaacaacaagcgcccgagcgggauccccgaccgguucuccggcagcaaguccggcaccagcgccacccucgggaucaccggccugcagacgggggacgaggccgacuacuucugcgccaccugggacuccggccugagcgccgacugggucuucgggggcggcaccaagcucaccgugcug

SEQ ID NO: 9049 - RNA, 321 nt, Artificial Sequence
  derived and/or modified sequence opt1 from anti-HIV_V3_LightChain
gacauccagaugacccagagccccuccagccuguccgccagcgugggcgaccgcgucaccaucacgugccgggccucccaggagaucgacaacuaccucgcgugguaccagcagcgcccggggaaggcccccaagagccugaucuacgccgccuccagccugcagggcggggugccgcccaaguucuccggcagcggguccggcaccgaguucacccucaccaucagcucccugcaggccgaggacuucgcgacguacuacugccagcaguacaacgccuacccccugaccuucggccaggggacccggcucgacaucaac

SEQ ID NO: 9050 - RNA, 324 nt, Artificial Sequence
  derived and/or modified sequence opt1 from anti-HIV_V3_LightChain
agcuacgagcugacccagcccccgucccucagcgugucccccggccagaccgccagcaucacgugcuccggggacggccugcccaagcaguacggguacugguaccagcagaagcccggccaggccccgcugcucgucauccugaaggacaccgagcgccccagcgggauccccgagcgguucuccggcagcuccagcggcaccaccgugacgcugaccaucuccggggugcaggcggaggacgaggccgacuacuacugccagagcgucgacuccaccggcagcuacuacguguucgggcccggcaccaaggugacgguccuc

SEQ ID NO: 9051 - RNA, 324 nt, Artificial Sequence
  derived and/or modified sequence opt1 from anti-HIV_V3_LightChain
agcuacgagcugacccagcccccguccgugagcgucucccccggccagaccgcccgcaucacgugcagcggggacgugcuccccaagaaguacgccuacugguaccagcagaaguccggccuggcgcccgugcuggucaucuacgaggacaaccggcgcccgagcgggauccccgagcgguucuccggcagcuccagcgggaccauggccacccucaccaucuccggcgcccagguggaggacgagggcgacuacuacugcagcuccacggacagcuccggggaccacuacguguucggcaccgggaccaaggucaccgugcug

SEQ ID NO: 9052 - RNA, 321 nt, Artificial Sequence
  derived and/or modified sequence opt1 from anti-HIV_V3_LightChain
gccuacgagcugacccagcccccgagcguguccgucagccccggccagaccgcccgcaucacgugcuccgcggaggcccucagcaaccaguacgccuacugguaccggcagcgccccgggcaggcgccccugcugaucaucuacaaggacaccaagcggccguccggcauccccgagcgcuucagcggguccaccagcggcaccacggugacccucaccaucuccggggugcaggccgaggacgaggccgacuacuacugccagagcgccgacuccagcggcgacuacgucuucggcgggggcaccaaggugacggugcug

SEQ ID NO: 9053 - RNA, 333 nt, Artificial Sequence
  derived and/or modified sequence opt1 from anti-HIV_CD4bs_LightChain
cagcccgugcugacccagagcuccagcgccuccgccagccucggcuccagcgucaagcugaccugcacgcugggguccggccacagcggguccaucaucgccuggcaccagcagcagccgggcaaggcgccccgcuaccucaugaaggugcagagcuccgggagcuacaacaagggcuccggcgugcccgaccgguucagcggguccagcuccggcgccgaccgcuaccugaccaucagcaaccugcaguucgaggacgagggggacuacuacugcgagaccugggacaccaacaaguacgucuucggcacggggaccaaggugaccgugcuc

SEQ ID NO: 9054 - RNA, 324 nt, Artificial Sequence
  derived and/or modified sequence opt1 from anti-HIV_CD4bs_LightChain
gagcuggugcucacccagagccccggcacccugucccugagcccgggggagcgcgccacgcucuccugccgggccagccaguccgucgcgagcuacuaccuggccugguaccagcagaagcccggccaggcgccccgccugcucaucuacggggccuccagccgggccaccggcauccccgaccgcuucuccgggagcguguccggcaccgacuucacccugacgaucagccggcuggagccggaggacuucgcccucuacuacugccagcaguacggcuccagcccccuguccuucgggggcgggaccaagguggagauccgc

SEQ ID NO: 9055 - RNA, 333 nt, Artificial Sequence
  derived and/or modified sequence opt1 from anti-HIV_CD4bs_LightChain
cagagcgcccugacccagcccccguccaugagcggcucccccgggcagagcaucaccaucuccugcacgggcagcggguccgacgugggcagccacaacuucgucuccugguaccagcagcaccccgcccgcgugcccaagcuccugaucuacgcgguggggaaccggccgagcggcgucuccgagcgcuucagcggcuccaagagcgggaacaccgccuaccugaccaucuccggccuccaggccgacgacgaggccgacuacuacugcagcucccacaccacggggaccacccuggagguguucggcgggggcacccggcugacggugcuc

SEQ ID NO: 9056 - RNA, 333 nt, Artificial Sequence
  derived and/or modified sequence opt1 from anti-HIV_CD4bs_LightChain
gacaucgugaugacccagagcccccugucccucccggucacccccggcgagcccgccagcaucuccugccgcagcuccgagagccugcugcacuccaacggguucaucuaccucgacugguaccugcagaagcccggccagagcccgcagcugcucaucuaccugggguccaagcgggccagcggcguguccgaccgcuucagcggguccggcagcggcacggcguucacccugaagaucucccggguggaggccgaggacgucgggguguacuacugcaugcaggcccucgagagccgcaccuucggccaggggaccaagcuggagaucaag

SEQ ID NO: 9057 - RNA, 327 nt, Artificial Sequence
  derived and/or modified sequence opt1 from anti-HIV_CD4bs_LightChain
gagaucgugcugacccagagccccggcacccucucccugagcccgggggagcgcgccacgcuguccugccgggccagccaguccgucagcuccagcuaccucgcgugguaccagcagaagcccggccagagcccccgccugcugaucuacggggccuccucccgggccaccggcauccccgaccgcuucagcggguccggcagcggcaccgacuucacccucacgaucucccggcuggagccggaggacuucgccguguacuacugccagcacuacgggagcuccagcaucuucaccuucggccccgggaccaagguggacauccgc

SEQ ID NO: 9058 - RNA, 330 nt, Artificial Sequence
  derived and/or modified sequence opt1 from anti-HIV_CD4bs_LightChain
aacuucaugcugacccagccccacagcguguccggcagcccggggaagaccgucacgaucuccugcacccgcagcuccggcagcaucgccgggaacuacgugcagugguaccagcagcggcccggcaccucccccaccacggugaucuacgagaacgaccagcgcagcuccgggguccccgaccgguucagcggcuccaucgacagcuccagcaacuccgccagccucaccaucuccggccugaagaccgaggacgaggcggacuacuacugccacagcuacgacgccaccaaccagguguucgggggcgggacgaagcugaccgugcuc

SEQ ID NO: 9059 - RNA, 333 nt, Artificial Sequence
  derived and/or modified sequence opt1 from anti-HIV_CD4bs_LightChain
gacguggucgugacccagagcccccugucccucccggugacccugggccagcccgccagcaucuccugccgcagcucccagagccuggucuacuccgacgggacgacccaccucaacugguaccaccagcggcccggccagcccccgcgccggcugaucuaccgcgugagcaaccgggacuccggggugcccgaccgcuucagcggcuccgggagcggcaccgacuucacccugcggaucucccgcgucgaggccgaggacgugggccucuacuacugcaugcuggcgacgcaccccuucaccuucgggcccggcaccaagguggagaucaag

SEQ ID NO: 9060 - RNA, 336 nt, Artificial Sequence
  derived and/or modified sequence opt1 from anti-HIV_CD4bs_LightChain
cagagcgugcugacccagcccccguccgucagcggcgcccccgggcagaccgugacgaucuccugcaccggcagcuccagcaacaucgggcccuccuacgacgugcagugguaccagcaguuccccggccgcgccccgaagcuccugaucagcgggaacaacaaccgggcguccggcguccccgaccgcuucagcggcuccaagagcgggaccuccgccagccuggccaucaccggccuccaguccgaggacgaggccgacuacuacugccagacguacgacagcucccugagcgggcacgugguguucggcgggggcacccggcugaccguccuc

SEQ ID NO: 9061 - RNA, 321 nt, Artificial Sequence
  derived and/or modified sequence opt1 from anti-HIV_CD4bs_LightChain
gacauccagaugacccagagccccuccacccugagcgccuccgugggcgaccgcgucacgaucacgugccgggccagcgcguccaucuacaccuggcucgccugguaccagcagcgcccggggaaggcccccgaggugcugaucuacaaggccagcacccugaaguccggcgugcccagccgguucuccgggagcggcuccgggaccgaguucacccucaccaucagcucccugcagcccggcgacuucgccaccuacuacugccagcaguacacgaccuacccgcugaccuucggcgggggcaccacggucgagaucaag

SEQ ID NO: 9062 - RNA, 330 nt, Artificial Sequence
  derived and/or modified sequence opt1 from anti-HIV_CD4bs_LightChain
cagagcgcccugacccagcccgccuccgugagcggcuccccggggcagagcaucaccaucuccugcacgggcaccagcaacgacaucgggaccuacaaccucgucuccugguaccagcaccaccccaacaaggcgcccaaggugguggucuacgagaacaacaagcgccccagcggcaucuccaaccgguucagcggguccaagagcggcaacaccgccucccugacgaucagcggccugcaggccgaggacgaggccgacuacuacugcugcuccuacgccgggagcuccaccuggguguucggcgggggcaccaagcucaccgugcug

SEQ ID NO: 9063 - RNA, 321 nt, Artificial Sequence
  derived and/or modified sequence opt1 from anti-HIV_V2_LightChain
gacauccagaugacccagagccccuccacccugagcgccuccgugggcgaccgcgucacgaucacgugccgggccagccagaccaucuccagcuggcucgcgugguaccagcagaaguccgggaccgccccgaagcugcugaucuacaaggccagcuccaucgugagcggcgugcccucccgcuucagcggguccggcagcgggaccgaguucacccucaccaucaccucccugcagcccgacgacuucgccacguacuacugccagcaguacaacagcucccccgagaccuucggccagggcaccaaggucgagaucaag

SEQ ID NO: 9064 - RNA, 318 nt, Artificial Sequence
  derived and/or modified sequence opt1 from anti-HIV_V2_LightChain
gagaucgugcugacccagagccccggcacccucucccugagcccgggggagcgcgccacgcuguccugccgggccagccaguccgucagcuccuaccucgcgugguaccagcagaagcccggccaggcgccccgccugcugaucuacgacgccagcucccgggccaccgggauccccgaccgcuucagcggcuccgggagcggcaccgacuucacccucacgaucucccggcuggagccggaggacuucgccguguacuacugccagcacuacgccggcagccgcaccuucgggcagggcaccaagguggagaucaag

SEQ ID NO: 9065 - RNA, 333 nt, Artificial Sequence
  derived and/or modified sequence opt1 from anti-HIV_V2_LightChain
cagagcgugcugacccagcccccguccgucagcggcgcccccgggcagcgcgugaccaucuccugcacgggcagcuccagcaacaucggggcccacuacgacgugcacugguaccagcagcuccccggcaccgcgcccaagcugcugaucuacgggaacuccaaccggccgagcggcguccccgaccgcuucuccggcagcaaguccgggaccagcgccucccucgccaucaccggccugcaggccgaggacgaggccgacuacuacugccagagcuacgacuccagccuguccggguacguguucggcacggggaccaaggugaccguccuc

SEQ ID NO: 9066 - RNA, 324 nt, Artificial Sequence
  derived and/or modified sequence opt1 from anti-HIV_V2_LightChain
gacaccgugaugacccagagccccgccacgcuguccgucagcccgggcgagcgcgugacccucuccugccgggccagccagaucaucaacaccaaccuggcgugguaccagaagcgccccgggcaggcgccccggcugcucaucuacgccgccuccgcccgcgccaccggcauccccgcccgguucagcggguccggcagcgggacggaguucacccugaccaucuccggccugcagagcgaggacuccgccguguacuacugccagcaguacaagcacuggccgcccuacaccuucggccgcgggacgaagcucgagauccgg

SEQ ID NO: 9067 - RNA, 321 nt, Artificial Sequence
  derived and/or modified sequence opt1 from anti-HIV_V2_LightChain
gagaucgugcugacccagagccccggcacccucucccugagcccgggggagcgcgccacgcuguccugccgggccagccaguccgucagcuccagcuaccucgccugguaccagcagaagcccggccaggcgccccgccugcugaucuacggggccuccagccgggccaccggcauccccgaccgcuucuccgggagcggcuccggcaccgacuucacccucacgaucagccggcuggagccggaggacuucgccguguacuacugccagcaguacggguccagccgcaccuucggccaggggaccaagguggagaucaag

SEQ ID NO: 9068 - RNA, 321 nt, Artificial Sequence
  derived and/or modified sequence opt1 from anti-HIV_V2_LightChain
gacauccagaugacccagagccccuccagccuguccgccagcgugggcgaccgcgucaccaucacgugccgggccucccagagcaucuccgggaaccucaacugguaccagcagaagccgggcaaggcgcccaaccugcugaucuacggggccagcucccuccagagcggcgugcccucccgcuucagcggguccggcagcggcaccgacuucacccugaccaucuccagccugcagcccgaggacuucgccacguaccacugccagcagucccacagcaccuccuggaccuucgggcagggcaccaagguggucaucaag

SEQ ID NO: 9069 - RNA, 327 nt, Artificial Sequence
  derived and/or modified sequence opt1 from anti-HIV_10E8
gccagcgagcugacccaggaccccaccguguccgucgcccucggccagacggugaccaucacgugccgcggggacagccugcggaaccacuacaccuccugguaccagcagaagaccggccaggcgccggugcugcucaucuaccccaagcacaaccgcagccccgggaucuccgaccgguucagcgccuccagcuccggcaacaccgccagccugaccaucaccggggcccagacggaggacgagggcgacuacuacugcuccagccgcgacaaguccggcagccggcuggucaccuucgggggcgggaccgaggugaccggccuc

SEQ ID NO: 9070 - RNA, 327 nt, Artificial Sequence
  derived and/or modified sequence opt1 from anti-HIV_10E8
gccagcgagcugacccaggaccccaccguguccgucgcccucggccagacggugaccaucacgugccgcggggacagccugcggaaccacuacaccuccugguaccagcagaagaccggccaggcgccggugcugcucaucuaccccaagcacaaccgcagccccgggaucuccgaccgguucagcgccuccagcuccggcaacaccgccagccugaccaucaccggggcccagacggaggacgagggcgacuacuacugcuccagccgcgacaaguccggcagccggcuggucaccuucgggggcgggaccaaggugaccgugguc

SEQ ID NO: 9071 - RNA, 327 nt, Artificial Sequence
  derived and/or modified sequence opt1 from anti-HIV_10E8
gccagcgagcugacccaggaccccaccguguccgucgcccucggccagacggugaccaucacgugccgcggggacagccugcggaacuacuacaccuccugguaccagcagaagccgggccaggcgcccgugcugcucaucuaccccaagcacaaccggcccccggggaucagcgaccgcuucuccgccagcuccagcggcaacaccgccucccugaccaucaccggggcccagaccgaggacgagggcgacuacuacugcagcucccgcgacaagagcggcucccggcuggucacguucgggggcgggaccaaggugaccggccuc

SEQ ID NO: 9072 - RNA, 327 nt, Artificial Sequence
  derived and/or modified sequence opt1 from anti-HIV_10E8
gccagcgagcugacccaggaccccaccguguccgucgcccucggccagacggugaccaucacgugccgcggggacagccugcggaacuacuacaccuccugguaccagcagaagccgggccaggcgcccgugcugcucaucuaccccaagcacaaccggcccccggggaucagcgaccgcuucuccgccagcuccagcggcaacaccgccucccugaccaucaccggggcccagaccgaggacgagggcgacuacuacugcagcucccgcgacaagagcggcucccggcuggucacguucgggcgcggcaccaagcucaccguggug

SEQ ID NO: 9073 - RNA, 327 nt, Artificial Sequence
  derived and/or modified sequence opt1 from anti-HIV_10E8
gccagcgagcugacccaggaccccaccguguccgucgcccucggccagacggugaccaucacgugccgcggggacagccugcggaaccacuacaccuccugguaccagcagaagaccggccaggcgccggugcugcucaucuaccccaagcacaaccgcagccccgggaucuccgaccgguucagcgccuccagcuccggcaacaccgccagccugaccaucaccggggcccagacggaggacgagggcgacuacuacugcuccagccgcgacaaguccggcagccggcuggucaccuucgggggcgggaccaaggugaccgugcuc

SEQ ID NO: 9074 - RNA, 327 nt, Artificial Sequence
  derived and/or modified sequence opt1 from anti-HIV_10E8
gccagcgagcugacccaggaccccaccguguccgucgcccucggccagacggugaccaucacgugccgcggggacagccugcggaacuacuacaccuccugguaccagcagaagccgcgccaggcgcccgugcugcucaucuaccccaagcacaaccggcccccgggcaucagcgaccgcuucuccgccagcuccagcgggaacaccgccucccugaccaucaccggcgcccagaccgaggacgagggggacuacuacugcagcucccgggacaagagcggcucccgccuggucacguucggcgggggcaccaagcucaccgugcug

SEQ ID NO: 9075 - RNA, 327 nt, Artificial Sequence
  derived and/or modified sequence opt1 from anti-HIV_10E8
gccagcgagcugacccaggaccccaccguguccgucgcccucggccagacggugaccaucacgugccgcggggacagccugcggaacuacuacaccuccugguaccagcagaagccgggccaggcgcccgugcugcucaucuaccccaagcacaaccggcccccggggaucagcgaccgcuucuccgccagcuccagcggcaacaccgccucccugaccaucaccggggcccagaccgaggacgagggcgacuacuacugcagcucccgcgacaagagcggcucccggcuggucacguucgggggcgggaccaagcucaccgugcug

SEQ ID NO: 9076 - RNA, 327 nt, Artificial Sequence
  derived and/or modified sequence opt1 from anti-HIV_10E8
gccagcgagcugacccaggaccccaccguguccgucgcccucggccagacggugaccaucacgugccgcggggacagccugcggaaccacuacaccuccugguaccagcagaagaccggccaggcgcccauccugcucaucuaccccaagcacaaccgcccgcccgggaucagcgaccgguucuccgccagcuccagcggcaacaccgccucccugaccaucaccggggcccagacggaggacgagggcgacuacuacugcagcucccgcgacaagagcggcucccggcuggugaccuucgggggcgggaccaagcucaccguccug

SEQ ID NO: 9077 - RNA, 327 nt, Artificial Sequence
  derived and/or modified sequence opt1 from anti-HIV_10E8
agcuccgaccugacccaggaccccgccgugagcgucgcccucggccagaccgugcgcaucacgugccagggggacucccugcggcgcuacuacgcgggcugguaccagcagaagccggggcaggcccccgugcuggucguguacggccgggacaaccgccccagcgggauccccgaccgguucuccggcagcaccuccggcaacaccgccagccucaccaucgccggggcccaggcggaggacgacgccgacuacuacugcuccagccgcgacaaguccggcagccggcuguccguguucgggggcgggacgaagcugaccguccuc

SEQ ID NO: 9078 - RNA, 327 nt, Artificial Sequence
  derived and/or modified sequence opt1 from anti-HIV_10E8
gccagcgagcugacccaggaccccgccguguccgucgcguucgagaagaccgugacgaucacgugccagggcgacagccuccgcucccacuacgugagcugguaccagaagcggccggggcaggcccccguccugguguucuacggcaagaacaaccgccccuccgggauccccgaccgguucagcggcuccaccagcgggaacaccgccucccugaccaucgccggcgcccaggcggaggacgacgccgacuacuacugcagcucccgcgacaagagcggcucccggcucagcguguucgggggcgggaccaagcugaccgucccg

SEQ ID NO: 9079 - RNA, 327 nt, Artificial Sequence
  derived and/or modified sequence opt1 from anti-HIV_10E8
gccagcgagcugacccaggaccccgccguguccgucgcgcucaagcagaccgugacgaucacgugccgcggcgacagccugcggucccacuacgugagcugguaccagcagaagccggggcaggcccccguccugguguucuacggcaagaacaaccgccccuccgggauccccgaccgguucagcggcuccagcuccgggaacaccgccagccucaccaucgccggcgcccaggcggaggacgacgccgacuacuacugcuccagccgcgacaaguccggcagccggcuguccguguucgggggcgggaccaagcugaccguccuc

SEQ ID NO: 9080 - RNA, 327 nt, Artificial Sequence
  derived and/or modified sequence opt1 from anti-HIV_10E8
agcuccgagcugacccaggaccccggcgugagcgucgcccucaagcagaccgugacgaucacgugccgcggggacucccugcggagccacuacguguccugguaccagaagaagccgggccaggcccccguccugguguucuacgggaagaacaucggccccagcgggauccccgaccgcuucuccggcagcaccuccggcaacaccgcgagccucaccaucgccggggcccaggccgaggacgacgccgacuacuacugcuccagccgggacaaguccggcagccgccuguccguguucgggggcgggaccaagcugaccguccuc

SEQ ID NO: 9081 - RNA, 327 nt, Artificial Sequence
  derived and/or modified sequence opt1 from anti-HIV_10E8
gccagcgagcugacccaggaccccgccguguccgucgcgcucaagcagaccgugacgaucacgugccgcggcgacagccugcggucccacuacgugagcugguaccagaagaagccggggcaggcccccguccugguguucuacggcaagaacaaccgccccuccgggauccccgaccgguucagcggcuccagcuccgggaacaccgccagccucaccaucgccggcgcccaggcggaggacgacgccgacuacuacugcuccagccgcgacaaguccggcagccggcuguccguguucgggggcgggaccaagcugaccguccuc

SEQ ID NO: 9082 - RNA, 327 nt, Artificial Sequence
  derived and/or modified sequence opt1 from anti-HIV_10E8
gccagcgagcugacccaggaccccggcguguccgucgcccucaagcagaccgugacgaucacgugccgcggggacagccugcggucccacuacgugagcugguaccagaagcgcccgggccaggcgcccguccugguguucuacgggaagaacaaccggcccuccggcauccccgaccgcuucagcggguccaccagcggcaacaccgccucccucaccaucgccggcgcccaggccgaggacgacgcggacuacuacugcagcucccgggacaagagcgggucccgccugagcguguucggcgggggcaccaagcugaccguccuc

SEQ ID NO: 9083 - RNA, 327 nt, Artificial Sequence
  derived and/or modified sequence opt1 from anti-HIV_10E8
gccagcgagcugacccaggaccccggcguguccgucgcccucgagcagaccgugacgaucacgugccgcggggacagccugcggucccacuacgugagcugguaccagaagaagccgggccaggcgcccguccugguguucuacgggaagaacaaccgccccuccggcauccccgaccgguucagcggguccaccagcggcaacaccgccucccucaccaucgccggcgcccaggccgaggacgacgcggacuacuacugcagcucccgcgacaagagcgggucccggcugagcguguucggcgggggcaccaagcugaccguccuc

SEQ ID NO: 9084 - RNA, 327 nt, Artificial Sequence
  derived and/or modified sequence opt1 from anti-HIV_10E8
gccagcgagcugacccaggaccccggcguguccgucgcccucaagcagaccgugacgaucacgugccgcggggacagccugcggucccacuacgugagcugguaccagaagaagccgggccaggcgcccguccugguguucuacgggaagaacaaccgccccuccggcauccccgaccgguucagcggguccaccagcggcaacaccgccucccucaccaucgccggcgcccaggccgaggacgacgcggacuacuacugcagcucccgcgacaagagcgggucccggcugagcguguucggcgggggcaccaagcugaccguccuc

SEQ ID NO: 9085 - RNA, 327 nt, Artificial Sequence
  derived and/or modified sequence opt1 from anti-HIV_10E8
agcuccgagcugacccaggaccccggcgugagcgucgcccucaagcagaccgugacgaucacgugccgcggggacucccugcggagccacuacguguccugguaccagaagaagccgggccaggcccccguccugguguucuacgggaagaacaaccgccccagcggcauccccgaccgguucuccgggagcaccuccggcaacaccgcgagccucaccaucgccggcgcccaggccgaggacgacgccgacuacuacugcuccagccgcgacaaguccgggagccggcuguccguguucggcgggggcaccaagcugaccguccuc

SEQ ID NO: 9086 - RNA, 327 nt, Artificial Sequence
  derived and/or modified sequence opt1 from anti-HIV_10E8
agcuccgagcugacccaggagaccggcgugagcgucgcccucgggcgcacggugaccaucacgugccggggcgacucccugcgcagccacuacgccuccugguaccaggagaagcccgggcaggcgccgaagcuccuguucuacggcaagaacaaccggcccagcgggauccccgaccgcuucuccggcagcgccuccggcaaccgggccagccugaccaucuccggggcccaggccgaggacgacgcggaguacuacugcagcucccgcgacaagagcggcucccggcugagcguguucgggggcgggaccaagcucgccguccug

SEQ ID NO: 9087 - RNA, 327 nt, Artificial Sequence
  derived and/or modified sequence opt1 from anti-HIV_10E8
agcuccgagcugacccaggagaccggcgugagcgucgcccucgggcgcacggugaccaucacgugccggggcgacucccugcgcagccacuacgccuccugguaccagaagaagcccgggcaggcgccgaagcuccuguucuacggcaagaacaaccggcccagcgggauccccgaccgcuucuccggcuucgccagcggcaaccgggccucccugaccaucagcggggcccaggccgaggacgacgcggaguacuacugcuccagccgcgacaaguccggcagccggcuguccguguucgggggcgggaccaagcucaccguccug

SEQ ID NO: 9088 - RNA, 327 nt, Artificial Sequence
  derived and/or modified sequence opt1 from anti-HIV_10E8
agcuccgagcugacccaggagaccggcgugagcgucgcccucgggcgcacggugaccaucacgugccggggcgacucccugcgcagccacuacgccuccugguaccagaagaagcccgggcaggcgccgaagcuccuguucuacggcaagaacaaccggcccagcgggauccccgaccgcuucuccggcagcgccuccggcaaccgggccagccugaccaucuccggggcccaggccgaggacgacgcggaguacaucugcagcucccgcgacaagagcggcucccggcugagcguguucgggggcgggaccaagcucaccguccug

SEQ ID NO: 9089 - RNA, 327 nt, Artificial Sequence
  derived and/or modified sequence opt1 from anti-HIV_10E8
agcuccgagcugacccaggagaccggcgugagcgucgcccucgggcgcacggugaccaucacgugccggggcgacucccugcgcagccacuacgccuccugguaccagaagaagcccgggcaggcgccgaagcuccuguucuacggcaagaacaaccggcccagcgggauccccgaccgcuucuccggcagcgccuccggcaaccgggccagccugaccaucuccggggcccaggccgaggacgacgcggaguacuacugcagcucccgcgacaagagcggcucccggcugagcguguucgggggcgggaccaagcucaccguccug

SEQ ID NO: 9090 - RNA, 327 nt, Artificial Sequence
  derived and/or modified sequence opt1 from anti-HIV_10E8
agcuccgagcugacccaggagaccggcgugagcgucgcccucgggcgcacggugaccaucacgugccggggcgacucccugcgcagccacuacgccuccugguaccagaagaagcccgggcaggcgccgauccuccuguucuacggcaagaacaaccggcccagcgggauccacgaccgcuucuccggcagcgccuccggcaaccgggccagccugaccaucuccggggcccaggccgaggacgacgcggaguacuacugcagcucccgcgacaagagcggcucccggcugagcguguucgggggcgggaccaagcucaccguccug

SEQ ID NO: 9091 - RNA, 393 nt, Artificial Sequence
  derived and/or modified sequence opt1 from anti-HIV_10E8
gaggugcagcuggucgagagcggcggggaccucgugaagcccggcgggucccugcgccugagcugcuccgccagcggcuucuccuucaagaacaccuggaugaccugggugcggcaggcccccgggaagggccucgagugggucggccgcaucacggggcccggcgagggguggaccagcgacuacgcggccaccgugcagggccgguucaccaucucccgcaacaacaugaucgacaugcuguaccuggagaugaaccggcuccgcacggacgacaccgggcuguacuacugcgugcacaccgagaaguacuacaacuucuggggcggcuacccgcccggggaggaguacuuccagcacuggggccgggggacccuggucaucgugagcucc

SEQ ID NO: 9092 - RNA, 393 nt, Artificial Sequence
  derived and/or modified sequence opt1 from anti-HIV_10E8
gagauccgccugguggagagcggcgggggccucgucaagcccgggggcucccugcggcugagcugcuccgccagcggguucaacuucgacuccgccuggaugaccugggugcgccagccgcccggcaagggccucgaguggguggggcggaucaccggccccggggagggcuggagcgucggguacgcggaguccgugaagggccgcuucaucaucagccggaucaacuccaucaacuuccuguaccuggagaugaacaaccuccgccccgaggacacgggcagcuacuucugcgcccacaccgggaagcacuacgacuucuggcggggcuacccgcccggggaggaguacuuccaggacuggggccagggcacccaggugaucgucuccagc

SEQ ID NO: 9093 - RNA, 393 nt, Artificial Sequence
  derived and/or modified sequence opt1 from anti-HIV_10E8
gagauccgccugguggagagcggcgggggccucgucaagcccgggggcucccugcggcugagcugcuccgccagcggguucaacuucgacuccgccuggaugaccugggugcgccagccgcccggcaagggccucgaguggguggggcggaucaccggccccggggagggcuggagcgucgacuacgcggaguccgugaaggggcgcuucaucaucagccggaucaacuccaucaacuuccuguaccuggagaugaacaaccuccgccccgaggacacgggcagcuacuucugcgcccacaccggcaagcacuacgacuucuggcggggguacccgcccggcgaggaguacuuccaggacugggggcagggcacccaggugaucgucuccagc

SEQ ID NO: 9094 - RNA, 393 nt, Artificial Sequence
  derived and/or modified sequence opt1 from anti-HIV_10E8
gaggugcgccuggucgagagcggcgggcggcucgugcgccccggcgggucccugcggcugagcugcuccgccagcggcuucaacuucgacaacgccuggaugaccugggugcgccagccgcccgggaagggccucgagugggucggccggaucaccgggcccggcgaggggugguccguggacuacgcggccagcgugaagggccgcuucacgaucucccggaugaacagcaucaacuucuucuaccuggagaugaacaaccugaagaucgaggacaccgggcucuacuucugcgcccgcaccggcaagcacuacgccuucuggggcggguacccgcccggcgaggaguaccuggaggacugggggcagggcacccuggucaucguguccagc

SEQ ID NO: 9095 - RNA, 393 nt, Artificial Sequence
  derived and/or modified sequence opt1 from anti-HIV_10E8
gaggugcgccuggucgagagcggcgggggccucgugaagcccgggggcucccugcggcugagcugcuccgccagcggguucaacuucgacgacgccuggaugaccugggugcgccagccgcccggcaagggccucgagugggucgggcggaucuccggccccggggagggcuggagcguggacuacgcggaguccgugaaggggcgcuucaccaucagccggcugaacuccaucaacuuccuguaccucgagaugaacaacguccgcacggaggacaccggcuacuacuucugcgcccggaccggcaagcacuacgacuucuggagcggguacccgcccggcgaggaguacuuccaggacugggggcagggcacccuggugaucguguccagc

SEQ ID NO: 9096 - RNA, 393 nt, Artificial Sequence
  derived and/or modified sequence opt1 from anti-HIV_10E8
gaggugcgccuggccgagagcggcgggggccucgucaagcccgggggcucccugcggcugagcugcuccgccagcggguucgacuucgacaacgcguggaugaccugggugcgccagccgcccggcaagggccucgaguggguggggcggaucaccggccccggggagggcugguccgucgacuacgccgcccccguggaggggcgcuucacgaucagccggcugaacuccaucaacuuccuguaccucgagaugaacaaccugcgcauggaggacagcggccuguacuucugcgcccggaccggcaaguacuacgacuucugguccggguacccgcccggcgaggaguacuuccaggacugggggcagggcacccucgugaucguccccagc

SEQ ID NO: 9097 - RNA, 393 nt, Artificial Sequence
  derived and/or modified sequence opt1 from anti-HIV_10E8
gaggugcgccuggucgagagcggcgggggccucgugaagcccgggggcucccugcggcugagcugcuccgccagcggguucgacuucgacaacgccuggaugaccugggugcgccagccgcccggcaagggccucgagugggucgggcggaucaccggccccggggagggcugguccguggacuacgcggcccccguggaggggcgcuucacgaucagccggcugaacuccaucaacuuccuguaccucgagaugaacaaccugcgcauggaggacagcggccuguacuucugcgcccggaccggcaaguacuacgacuucugguccggguacccgcccggcgaggaguacuuccaggacugggggcagggcacccucgucaucgugcccagc

SEQ ID NO: 9098 - RNA, 393 nt, Artificial Sequence
  derived and/or modified sequence opt1 from anti-HIV_10E8
gaggugcgccuggucgagagcggcgggggccucgugaagcccgggggcucccugcggcugagcugcuccgccagcggguucgacuucgacaacgccuggaugaccugggugcgccagccgcccggcaagggccucgagugggucgggcggaucaccggccccggggagggcugguccguggacuacgcggcccccguggaggggcgcuucacgaucagccggcugaacuccaucaacuuccuguaccucgagaugaacaaccugcgcauggaggacagcggccuguacuucugcgcccggaccggcaaguacuacgacuucugguccggguacccgcccggcgaggaguacuuccaggacugggggcagggcacccucgucaucgugagcucc

SEQ ID NO: 9099 - RNA, 393 nt, Artificial Sequence
  derived and/or modified sequence opt1 from anti-HIV_10E8
gaggugcgccuggccgagagcggcgggggccucgucaagcccgggggcucccugcggcugagcugcuccgccagcggguucgacuucgacaacgcguggaugaccugggugcgccagccgcccggcaagggccucgaguggguggggcggaucaccggccccggggagggcugguccgucgacuacgccgcccccguggaggggcgcuucacgaucagccggcugaacuccaucaacuuccuguaccucgagaugaacaaccugcgcauggaggacagcggccuguacuucugcgcccggaccggcaaguacuacgacuucugguccggguacccgcccggcgaggaguacuuccaggacugggggcgcggcacccucgugaucgucagcucc

SEQ ID NO: 9100 - RNA, 393 nt, Artificial Sequence
  derived and/or modified sequence opt1 from anti-HIV_10E8
gaggugcgccuggucgagagcggcgggggccucgugaagcccgggggcucccugcggcugagcugcuccgccagcggguucgacuucgacaacgccuggaugaccugggugcgccagccgcccggcaagggccucgagugggucgggcggaucaccggccccggggagggcugguccguggacuacgcggcccccguggaggggcgcuucacgaucagccggcugaacuccaucaacuuccuguaccucgagaugaacaaccugcgcauggaggacagcggccuguacuucugcgcccggaccggcaaguacuacgacuucugguccggguacccgcccggcgaggaguacuuccaggacugggggcgcggcacccucgucaucgugagcucc

SEQ ID NO: 9101 - RNA, 333 nt, Artificial Sequence
  derived and/or modified sequence opt1 from anti-HIV-1_LightChain
cagagcgugcugacccagcccccguccgucagcgccgcccccggccagaaggugaccaucuccugcagcgggcgcuccagcaacaucggcaacaacaacguguucugguaccagcagcuccccgggacggcgcccaagcugcugaucuacgacaacgacaagcggccguccggcauccccgaccgcuucagcggguccaagagcggcaccuccgccacccucggcaucaccgggcugcagacgggcgacgaggccgacuacuacugcgggaccugggacagcucccugagcgccggcggggucuucggcaccggcaccaaggugacggugcuc

SEQ ID NO: 9102 - RNA, 336 nt, Artificial Sequence
  derived and/or modified sequence opt1 from anti-HIV-1_LightChain
cagagcgugcugacccagcccgccuccgucagcggcuccccggggcagagcaucaccaucuccugcacgggcaccaagagcgacaucgggggcuacaaguacguguccugguaccagcagcaccccgggaaggcccccaagauccucaucuacgacgugaacaagcgccccagcggcaucccggaccgguucuccggcagcaaguccgggaccagcgcgacccugggcaucacggggcugcagaccggcgacgaggccgacuacuacugcgggaccugggacaacucccucagcaccggcggcgucuucgggacgggcaccaaggugaccgugcug

SEQ ID NO: 9103 - RNA, 321 nt, Artificial Sequence
  derived and/or modified sequence opt1 from anti-HIV-1_LightChain
cagagcgugcugacccagcccccguccgucagcgccgcccccggccagcgcgugaccaucuccugcuucgggagccgguucuccagcguguccugguaccagcagcuccccggcacggcgcccaagcugcugaucuacgagaacaccaagcgcccgagcgggauccccgaccgguucuccggcagcaaguccgggaccagcgccacccucggcaucacgggccugcagaccggggacgaggccgacuacuacugcggcaccugggaccgcucccugagcgccgggggcgucuucgggaccggcacgaaggugaccgugcuc

SEQ ID NO: 9104 - RNA, 333 nt, Artificial Sequence
  derived and/or modified sequence opt1 from anti-HIV-1_LightChain
cagagcgugcugacccagcccccguccgccagcggcacccccgggcagacgaucaccaucuccugcagcggcuccagcuccaacaucgggagcaacgacgucuacugguaccagcaccuccccggcaccacccccaagguggugaucuacaagaacaaccgccggccguccgggauccccgaccgcuucagcggcuccaagagcggcacguccgccacccuggggaucaccggccugcagaccggggacgaggcggacuacuacugcggcacgugggaccggagccucuccgccgggggcgucuucggcaccgggaccaaggugaccgugcug

SEQ ID NO: 9105 - RNA, 327 nt, Artificial Sequence
  derived and/or modified sequence opt1 from anti-HIV-1_LightChain
cagagcgugcugacccagcccccguccaugagcgccgcccccggccagaaggucaccaucuccugcagcggguccacgagcaucaucggcaacaacuacaucuccugguaccagcagcuccccgggaccgcgcccaagcugcugaucuacgaggacaacaagcgcccgagcggcauccccgaccgguucuccgggagcaaguccggcaccagcgccacccucggcaucacggggcugcagaccggcgacgaggccgacuacuacugcgggaccuggcacuccagccuguccgccggcgggguguucggcaccggcacgaaggugacc

SEQ ID NO: 9106 - RNA, 333 nt, Artificial Sequence
  derived and/or modified sequence opt1 from anti-HIV-1_LightChain
cagagcgugcugacccagcccccguccgucagcgccgcccccggccucaaggugaccaucuccugcagcgggaacacguccaacgugggcgacaacuucgucagcugguaccgcuaccugcccgggaccgcgcccaagcugcucuccuacgaggacgacaagcggccgagcggcauccccgaccgcuucuccgggagcaaguccggcaccagcgccacccugggcaucacggggcugcagaccggcgacgaggccgacuacuacugcgggaccugggacuccagccucuccgccggcgggguguucggcaccggcacgaaggugaccguccug

SEQ ID NO: 9107 - RNA, 333 nt, Artificial Sequence
  derived and/or modified sequence opt1 from anti-HIV-1_LightChain
cagagcgugcugacccagcccccguccgcgagcggcacccccgggcagcgcgucacgaucuccugcagcggcuccagcuccaacaucgggagcaacaccgugaacugguaccagcaguuccccggcaccgcccccaagcuccugaucuacgagaacaaccggcgcccguccggggugcccgcgcgguucagcggcuccaagagcggcaccuccgccacgcuggccaucaccgggcuccagaccggcgacgaggccgacuacuacugcgccaccugggacagcucccugagcgccgggggcgucuucgggacgggcaccaaggugaccgugcug

SEQ ID NO: 9108 - RNA, 318 nt, Artificial Sequence
  derived and/or modified sequence opt1 from anti-HIV-1_LightChain
cagagcgugcugacccagcccccguccgucagcgccgcccccggccagaaggugaccaucuccugcagcggguccagcuccaacaucggcaacaacuacgugagcugguaccagcagcuccccgggacggcgcccaagcugcugaucuacgagaacaacaagcgcccguccggcauccccgaccgguucagcggguccaagagcggcaccuccgccacccucggcaucaccgggcugcagacgggcgacgaggccgacuacuacugcgggaccugggacaacagccuguccaccggcggggucuucggcaccggcacg

SEQ ID NO: 9109 - RNA, 288 nt, Artificial Sequence
  derived and/or modified sequence opt1 from anti-HIV-1_LightChain
ggccugagccccucccucugcagcggguccagcuccaacaucggcaacaacuacgugagcugguaccagcagcugccggggaccgcgcccaagcugcucaucuacgagaacaccaagcgccccuccggcauccccgaccgguucagcggguccaagagcggcacguccgccacccugggcaucaccgggcugcagaccggcgacgagggggacuacuacugcggcacgugggaccgcagccucuccgccgggggcgucuucggcaccgggaccaaggugaccgugcug

SEQ ID NO: 9110 - RNA, 333 nt, Artificial Sequence
  derived and/or modified sequence opt1 from anti-HIV-1_LightChain
caguucgugcugacccagcccccgagcgucuccgccgcccccggccagcgcgugaccgugagcugcuccgggacgaccagcgacaucggcgagaacuacgucuccugguaccagaaguucagcgaggcggcccccaagcuccugcuguacgacaacgacaagcggcccuccgggaucccggaccgcuucagcggcuccaagagcgggaccuccgccacccucggcaucacgggccugcagaccggggacgaggccgacuacuacugcggcaccugggacagcucccugagcgccgggggcguguucgggaccggcacgaaggugaccguccuc

SEQ ID NO: 9111 - RNA, 327 nt, Artificial Sequence
  derived and/or modified sequence opt1 from anti-HIV-1_LightChain
cagagcgugcugacccagcccccguccgucagcgccgcccccggccagaaggugaccaucuccugcagcgggggcuccagcaacaucgggaacuacuacguguccugguaccuccagcugcccggcacggcgcccaagcugcucaucuacgagaacaacaagcgcccgagcgggauccccgaccgguucuccggcagcaaguccggcaccagcgccacccuggggaucaccggccugcagacgggggacgaggccgacuacuacugcggcaccuggcacuccagccucuccgccgggggcgucuucggcaccgggaccaaggugacg

SEQ ID NO: 9112 - RNA, 333 nt, Artificial Sequence
  derived and/or modified sequence opt1 from anti-HIV-1_LightChain
cagagcgugcugacccagcccccguccgucagcgccgcccccggccagaaggugaccaucuccugcagcgggaacauguccaacaucggcgacaacgccgugagcugguaccgccagguccccgaggcgcccccgcagcuccugaucuucgggaacgacaagcggcccuccggcgugacggaccgcuucagcggguccaagagcggcaccuccgccacccugggcaucaccgggcuccagacgggcgacgaggccgacuacuacugcgggaccugggaccggagccuguccgccggcgggguguucggcaccggcaccaaggucacggugcug

SEQ ID NO: 9113 - RNA, 336 nt, Artificial Sequence
  derived and/or modified sequence opt1 from anti-HIV-1_LightChain
cagagcgugcugacccagcccccguccgucagcggcgcccccgggcagcgcgugaccaucuccugcacgggcagcuccagcaacaucggggccggcuacgacgugcacugguaccuccagcugcccgggaccgcgccccggcugcucaucuacgacaacgacaagcgcccguccggcauccccgaccgguucagcggcuccaagagcgggaccuccgccacccugggcaucacggggcugcagaccggcgacgaggccgacuacuacugcgggaccuggcacagcucccucagcgccggcggcgucuucgggaccggcacgaaggugaccgugcug

SEQ ID NO: 9114 - RNA, 333 nt, Artificial Sequence
  derived and/or modified sequence opt1 from anti-HIV-1_LightChain
cagagcgugcugacccagcccccguccgucagcgccgcccccggccagaaggugaccaucuccugcagcggguccacgagcaacaucggcaacaacuucguguccugguaccagcagcuccccgggaccgcgcccaagcugcuguucuacgacaacuacaagcgcccgagcggcauccccgaccgguucuccgggagcaaguccggcaccagcgccacccucgccaucacgggccugcagaccggggacgaggccgacuacuacugcgccaccugggacuccagccuguccgcgggcggggucuucggcaccgggacgaaggugaccgugcuc

SEQ ID NO: 9115 - RNA, 336 nt, Artificial Sequence
  derived and/or modified sequence opt1 from anti-HIV-1_LightChain
cagagcgugcugacccagcccccguccgucagcggcgcccccgggcagcgcgugaccaucuccugcacgggcgggagcuccaacaucggcgccggguacgacgugcacugguaccagcaccuccccggcaccgcgccccagcugcugaucuacgagaacaccaagcggccgagcggcauccccgaccgcuucuccgggagcaaguccggcaccagcgccacgcucgggaucaccggccugcagaccggggacgaggccgacuacuacugcggcaccugggaccggucccugagcgccggcggggucuucggcacggggaccaaggugaccgugcuc

SEQ ID NO: 9116 - RNA, 333 nt, Artificial Sequence
  derived and/or modified sequence opt1 from anti-HIV-1_LightChain
cagagcgugcugacccagcccccgucccucagcgccgcccccggccagcgcgucaccguguccugcagcggguccagcuccaacaucggcgacaacuacgugagcugguaccagcagcugcccggggccgcgccccggcugcucaucuacgagaacaacaagcgcccguccggcauccccgaccgguucagcggguccaagagcggcacguccgccacccugggcaucaccgggcugcagaccggcgacgaggccgacuacuacugcgggacgugggacaacagccucuccaccggcggggucuucggcaccggcaccaaggugacggugcug

SEQ ID NO: 9117 - RNA, 333 nt, Artificial Sequence
  derived and/or modified sequence opt1 from anti-HIV-1_LightChain
cagagcgugcugacccagcccccguccgucagcgccgcccccggccagaaggugaccaucuccugcagcgggcgcuccagcaacaucggcaacuacuucguguccugguaccagcaguuccccgggacggcgcccaagcuccugaucuacgacaacaacaagcggccgagcggcauccccgaccgcuucuccgggagcaaguccggcaccagcgccacccugggcaucaccgggcuccagacgggcgacgaggccgacuacuacugcgggaccugggaccggucccugagcgccggcggggucuucggcaccggcaccaaggugacggugcug

SEQ ID NO: 9118 - RNA, 333 nt, Artificial Sequence
  derived and/or modified sequence opt1 from anti-HIV-1_LightChain
cagagcgugcugacccagcccccguccgccagcggcacccccgggcagcgcgucacgaucuccugcagcggcuccagcuccaacaucgggagcaacgccgugcacugguuccggcagcuccccggcaccgcgcccaagcugcugaucuacgagaacaacaagcgcccguccgggauccccgaccgguucagcggcuccaagagcggcaccuccgccacccucgggaucacgggccugcagaccggggacgaggccgacuacuacugcgccaccugggacagcucccugagcgccggcgggguguucggcaccggcacgaaggucaccgugcuc

SEQ ID NO: 9119 - RNA, 333 nt, Artificial Sequence
  derived and/or modified sequence opt1 from anti-HIV-1_LightChain
cagagcgugcugacccagcccccguccgucagcgccgccuccggccagaaggugaccaucagcugcuccgggagcuccagcaacaucggcaacaacuacguguccugguaccaccagcuccccgggacggcgcccaagcugcugaucuacgacaccaacaagcgccccagcggcaucccggaccgguucuccgggagcaccuccggcaccagcgccacgcucggcaucaccgggcugcagaccggcgacgaggccgacuacuacugcgggaccugggacaacucccugagcacgggcggggucuucggcaccggcaccaaggugaccgugcuc

SEQ ID NO: 9120 - RNA, 333 nt, Artificial Sequence
  derived and/or modified sequence opt1 from anti-HIV-1_LightChain
cagcccgugcugacccagccgcccagcgucuccgccgcccccggccagaccgugacgaucagcugcuccgggagcuucuccaacaucgagaccaacuacgugagcugguaccagcagcuccccggcaccgcgccgaagcugcugaucuacgacaacaacaugcgccccuccgggauccccgaccgguucagcggcuccaagagcgggaccuccgccacgcucggcaucaccggccugcagaccggggacgaggccgacuacuacugcggcaccugggacacgagccuguccgccgggggcgucuucgggaccggcaccaaggugaccgugcuc

SEQ ID NO: 9121 - RNA, 336 nt, Artificial Sequence
  derived and/or modified sequence opt1 from anti-HIV-1_LightChain
cagcccgugcugacccagccgcccagcgucuccggcgcccccgggcagcgcgugaccaucagcugcacgggcuccagcuccaacaucggggccggcuacgacgugcacugguaccagcagcuccccgggaccgcgccgaagcugcugaucuacgagaacaacaagcggcccagcggcauccccgaccgcuucuccggcagcaaguccgggaccagcgccacccucggcaucacggggcugcagaccggcgacgaggccgacuacuacugcgggaccugggacaacucccugagcaccggcggcgucuucgggacgggcaccaaggugaccgugcuc

SEQ ID NO: 9122 - RNA, 333 nt, Artificial Sequence
  derived and/or modified sequence opt1 from anti-HIV-1_LightChain
cagagcgugcugacccagcccccgucccucagcgccgcccccggccagcgcaucaccaucuccugcagcggguccagcuccaacaucggcaacaacuacgucagcugguaccagcaguuccccgggacggcgcccaagcugcugaucuacgagaacaacaagcggccguccggcauccccgaccgcuucagcgccuccaagagcgggaccuccgccacccucggcaucaccggccugcagacgggggacgaggccaacuacuacugcggcaccuggcacagcucccugagcgccgggggcguguucgggaccggcaccaaggugacgguccuc

SEQ ID NO: 9123 - RNA, 333 nt, Artificial Sequence
  derived and/or modified sequence opt1 from anti-HIV-1_LightChain
cagagcgugcugacccagcccccguccgucagcgccgcccccggccagcgcgugaccaucuccugcuucgggagccgguucaacgugggcacguccagcgucuccugguaccagcagcuccccgggaccgcgcccaagcugcugaucgacgccaacggcgagcgcccgagcgggauccccgaccgguucuccggcagcaaguccggcaccagcgccacccucgggaucacgggccugcagaccggggacgaggccgacuacuacugcggcaccugggacuccagccuguccgccgggggcguguucggcaccgggacgaaggugaccguccuc

SEQ ID NO: 9124 - RNA, 333 nt, Artificial Sequence
  derived and/or modified sequence opt1 from anti-HIV-1_LightChain
cagagcgugcugacccagcccccguccgucagcgccacccccggccagaaggugacgaucuccugcagcgggucccgcagcaacaucggcucccacuacgugagcugguaccagcaguuccccgggaccgcccccaagcuccugaucuacgacaacaacaagcggccguccggcauccccgaccgcuucagcggguccaagagcggcaccuccgcgacccugggcaucacggggcuccagaccggcgacgaggccgacuacuacugcgggaccuggcacagcucccugagcgccggcggggucuucggcaccggcacgaaggugaccgugcug

SEQ ID NO: 9125 - RNA, 333 nt, Artificial Sequence
  derived and/or modified sequence opt1 from anti-HIV-1_LightChain
cagagcgugcugacccagcccccguccgccagcggcacccccgggcagcgcgucacgaucuccugcagcggcuccagcuccaacaucgggagcaaccacguguacugguaccagcagcuccccggcaagacccccaagcugcugaucuaccggaacaaccagcgcccguccgggauccccgaccgguucagcggcuccaagagcggcaccuccgccacccucgggaucacgggccugcagaccggggacgaggcggacuacuacugcggcaccugggacagcucccugagcaccgggggcguguucggcacggggaccaaggucaccgugcuc

SEQ ID NO: 9126 - RNA, 333 nt, Artificial Sequence
  derived and/or modified sequence opt1 from anti-HIV-1_LightChain
cagagcgugcugacccagcccccguccgucagcgcggcccccggccagaaggugaccaucuccugcagcggguccagcgcgaacaucggcaacaacuacguguccugguaccagcaguuccccgggacgggcccccgccucaucaucuacgagagcaacaagcggccguccgggaucagcgaccgcuucuccggcagccaguccgacgccgccgccacccuggacaucaccggccugcagaccggggacgaggccgacuacuacugcggcacgugggacagcucccucagcgccgggggcgucuucgggaccggcacccgggugaccgugcug

SEQ ID NO: 9127 - RNA, 336 nt, Artificial Sequence
  derived and/or modified sequence opt1 from anti-HIV-1_LightChain
cagagcgugcugacccagcccccguccgucagcggcgcccccgggcagaccgugacgaucuccugcaccggcgacaccagcaacaucggggccgacuaccgcgugcacugguaccagcagcuccccggcaccgcgcccaagcugcugaucuacgagaacaacaagcggccguccgggauccccgaccgcuucagcggcuccaagagcggcacguccgccacccucgggaucaccggccugcagaccggggacgaggccgacuacuacugcggcacgugggacaacagccuguccaccgggggcgucuucggcaccgggaccaaggugacggugcuc

SEQ ID NO: 9128 - RNA, 333 nt, Artificial Sequence
  derived and/or modified sequence opt1 from anti-HIV-1_LightChain
cagagcgugcugacccagcccccgucccucagcgccgcccccggccagcgcgucaccguguccugcagcggguccagcuccaacaucggcaacaacuacgugagcugguaccagcagcugcccggggcggcccccaagcugcucaucuacaacaacaacauccggccguccggcauccccgagcgcuucagcggguccaagagcggcacguccgccacccugggcaucaccgggcugcagaccggcgacgagggggacuacuacugcggcacgugggaccggagccucuccgccgggggcgucuucggcaccgggaccaaggugaccgugcug

SEQ ID NO: 9129 - RNA, 333 nt, Artificial Sequence
  derived and/or modified sequence opt1 from anti-HIV-1_LightChain
cagagcgugcugacccagcccccguccgccagcggcacccccgggcagcgcgucacgaucuccugcagcggcuccagcuccaacaucgggggcaacuacgugagcugguaccagcagcuccccgggaccgcccccaagcugcugaucuccgagaacaacaagcggccgagcggcauccccgaccgcuucuccggcagcaaguccgggaccagcgcgacccucggcaucacggggcugcagaccggcgacgaggccgacuacuacugcgggaccugggacuccagccuguccgccggcggcguguucgggaccggcacgaaggucaccgugcuc

SEQ ID NO: 9130 - RNA, 333 nt, Artificial Sequence
  derived and/or modified sequence opt1 from anti-HIV-1_LightChain
cagagccugcucacccagcccccguccgugagcgccgcccccggccagaaggucaccaucuccugcagcggguccagcuccaacaucggcaacaacuucgugagcugguaccagcagcugcccgggacggcgcccaagcugcucaucuacgagaacaacaugcgcccguccggcauccccgaccgguucagcggguccaagagcggcaccuccgccacccugggcaucaccgggcugcagacgggcgacgaggccgacuacuacugcgggaccugggacagcucccucagcgccggcgggguguucggcaccggcaccaaggucacggugcug

SEQ ID NO: 9131 - RNA, 333 nt, Artificial Sequence
  derived and/or modified sequence opt1 from anti-HIV-1_LightChain
cagagcgugcugacccagcccccguccgucagcgccgcccccggccagaaggugaccaucuccugcagcgggacguccagcaacaucgcgaacuacuacguguccugguaccgccagcuccccggcaccgcccccaagcugcugaucuacgagaacaacaagcggccgagcgggauccccgaccgcuucuccggcagcaaguccgggaccagcgccacccucggcaucacgggccugcagaccggggacgaggccgacuacuacugcggcaccugggacuccagccuguccgccgggggcgucuucgggaccggcacgaaggugaccgugcuc

SEQ ID NO: 9132 - RNA, 333 nt, Artificial Sequence
  derived and/or modified sequence opt1 from anti-HIV-1_LightChain
cagcccgugcugacccagccgcccagcgucuccggcgcccccgggcagcgcgugaccaucagcugcuccggcagcuccagcaacaucgggaacaacgacguguccugguaccagcagguccccggcacggccccgaagcuccugaucuacgagaacaacaagcggcccagcgggauccccgaccgcuucuccggcagcaaguccggcaccagcgcgacccuggggaucaccggccuccagacgggggacgaggccgacuacuacugcggcaccugggacaccucccugagcgccgggggcguguucggcaccgggacgaaggugaccguccug

SEQ ID NO: 9133 - RNA, 333 nt, Artificial Sequence
  derived and/or modified sequence opt1 from anti-HIV-1_LightChain
cagcuggugcucacccagcccccgagcgucuccgccgcccccggccagcgcgugaccaucagcugcuucgggucccgguucaacgugggcacgagcuccgucagcugguaccagcagcugcccgggaccgcgcccaagcugcucaucgacgccaacggcgagcgcccguccgggauccccgaccgguucuucggcagcgaguccggcaccagcgccacccuggggaucacgggccugcagaccggggacgaggccgacuacuacugcggcaccuggcacuccagccucuccgccgggggcguguucggcaccgggacgaaggugaccguccug

SEQ ID NO: 9134 - RNA, 333 nt, Artificial Sequence
  derived and/or modified sequence opt1 from anti-HIV-1_LightChain
agcuacgagcugacccagcccccguccgugagcgccgcccccggccagaaggucaccaucuccugcagcggguccagcuccaacaucggcaacaacuacgugagcugguaccagcagcuccccgggacggcgcccaagcugcugaucuacgagaacaacaagcgcccguccggcauccccgaccgguucagcggguccaagagcggcaccuccgccacccucggcaucaccgggcugcagacgggcgacgaggccgacuacuacugcgggaccugggacaccagccuguccgccggcgggguguucggcaccggcacgaaggucaccgugcuc

SEQ ID NO: 9135 - RNA, 333 nt, Artificial Sequence
  derived and/or modified sequence opt1 from anti-HIV-1_LightChain
cagagcgugcugacccagcccccguccgccagcggcacccccgggcagcgcgucacgaucuccugcagcggcuccaccagcaacaucgggaccuacuacguguccugguaccagcagcuccccggcaccgcccccaagcugcugaucuacgagaacacgaagcggccgagcgggauccccgaccgcuucuccggcagcaaguccggcaccagcgcgacccucgggaucaccggccugcagacgggggacgagggcgacuacuacugcgggaccugggaccggucccugagcgccggcggcguguucgggaccggcaccaaggucacggugcuc

SEQ ID NO: 9136 - RNA, 336 nt, Artificial Sequence
  derived and/or modified sequence opt1 from anti-HIV-1_LightChain
cagagcgcccugacccagcccgccuccgugagcgcguccccgggccagagcaucgccaucuccugcaccgggacgagcuccgacgucggcagcuacaacuacguguccugguaccagcagcuccccgggaccgcccccaagcugcugaucuacgagaacaccaagcgccccagcggcaucccggaccgguucuccgggagcaaguccggcaccagcgccacgcucggcaucaccgggcugcagaccggcgacgaggccgacuacuacugcgggaccugggaccgcucccugagcgcgggcgggguguucggcacgggcaccaaggucaccgugcuc

SEQ ID NO: 9137 - RNA, 330 nt, Artificial Sequence
  derived and/or modified sequence opt1 from anti-HIV-1_LightChain
cagagcgugcugacccagcccccguccgucagcgccgcccccggccagcgcgugaccaucuccugcagcgggggcuccagcaacaucgggaacaaccacguguccugguaccagcaccuccccggccgggcgccccagcugcugaucuacgacacgacccagcgcccgagcgggauccccgaccgguucuccggcagcaaguccggcaccagcgccacccucgggaucacgggccugcagaccggggacgaggccgacuacuacugcggcaccugggacuccagccuguccaccgggggcgucuucggcacggggaccaaggugaccgug

SEQ ID NO: 9138 - RNA, 333 nt, Artificial Sequence
  derived and/or modified sequence opt1 from anti-HIV-1_LightChain
cagagcgugcugacccagcccccguccgccagcggcacccccgggcagcgcgucacgaucuccugcagcggcuccagcuccaacaucgggagcaaguacgugugcugguaccagcagcuccccggcaccgcccccaagcugcugaucuaccggaacaaccagcgcccguccgggauccccgaccgguucagcggcuccaagagcggcaccuccgcgacccucgggaucacgggccugcagaccggggacgaggccgacuacuacugcggcaccuggcacagcucccugagcgccgggggcguguucggcaccgggacgaaggucaccgugcuc

SEQ ID NO: 9139 - RNA, 333 nt, Artificial Sequence
  derived and/or modified sequence opt1 from anti-HIV-1_LightChain
cagagcgugcugacccagcccccguccgucagcgccgcccccggccagaaggugaccaucuccugcagcggggacuccagcacguucgagaacgacuacgugugcugguaccagcagcuccccggcaccgcgcccaagcugcugaucuacgacaacaacaagcgcccguccgggauccccgaccgguucagcggcuccaagagcgggaccuccgccacccucggcaucacgggccugcagaccggggacgaggccgacuacuacugcggcaccuggcacagcucccugagcgccgggggcgucuucgggaccggcacgaaggugaccgugcuc

SEQ ID NO: 9140 - RNA, 333 nt, Artificial Sequence
  derived and/or modified sequence opt1 from anti-HIV-1_LightChain
cagagcgugcugacccagcccccguccgucagcgcggcccccggccagaaggugaccaucuccugcagcggguccagcuccaacaucggcaacaacuacgugagcugguaccagcagcuccccgggacggcgcccaagcugcugaucuacggcaacuccaaccgcccgagcgggguccccgaccgguucuccggcagcaaguccggcaccagcgccucccucgccaucaccgggcugcaggccgaggacgaggccgacuacuacugcggcaccugggacagcucccugagcgccgggggcguguucgggacgggcaccaaggugaccguccuc

SEQ ID NO: 9141 - RNA, 333 nt, Artificial Sequence
  derived and/or modified sequence opt1 from anti-HIV-1_LightChain
cagagcgugcugacccagcccccguccgucagcgccgcccccggccagaccgugacgaucuccugcagcggguccagcuccaacaucggcagcaacaccgugaacugguaccagcagcuccccgggaccgcgcccaagcugcugaucuacgagaacaacaagcgcccguccggcauccccgaccgguucagcggguccaagagcggcaccuccgccacgcucggcaucaccgggcugcagaccggcgacgaggccgacuacuacugcgggaccugggacaacagccuguccacgggcggggucuucggcaccggcaccaaggugaccgugcuc

SEQ ID NO: 9142 - RNA, 336 nt, Artificial Sequence
  derived and/or modified sequence opt1 from anti-HIV-1_LightChain
cagagcgugcugacccagcccccguccgucagcggcgcccccgggcagcgcgugaccaucuucugcacgggcuccagcuccaacgucgggggcggguacgacgugcacugguaccagcagcuccccggcaccgcccccaagcugcugaucuacgagaacaacaagcggccgagcggcauccccgaccgcuucuccgggagcaaguccggcaccagcgcgacccucgggaucacgggccugcagaccggggacgaggccgacuacuacugcggcaccugggacuccagccuguccgccggcgggguguucggcaccgggacgaaggugaccguccuc

SEQ ID NO: 9143 - RNA, 333 nt, Artificial Sequence
  derived and/or modified sequence opt1 from anti-HIV-1_LightChain
cagagcgugcugacccagcccccguccgucagcgccgcccccggccagaaggugacccucuccugcagcggguccagcuccaacaucggcaacaacagcguguccugguaccagcaguuccccgggacggcgcccaagcugcugaucuacgacagcgacaagcgcccguccggcauccccgaccgguucagcggguccaagagcggcaccuccgccacccucggcaucaccgggcugcagacgggcgacgagggggacuacuacugcggcaccugggaccgcagccuguccgccgggggcgucuucggcaccgggaccaaggugacggugcuc

SEQ ID NO: 9144 - RNA, 333 nt, Artificial Sequence
  derived and/or modified sequence opt1 from anti-HIV-1_LightChain
cagagcgugcugacccagcccccguccgccagcggcacccccgggcagaaggucacgaucuccugcagcggcuccagcucccagaucgggagcaacuccguguacugguaccagcagcuccccggcaccacccccaagcugcugaucuacgggaacaaccagcgcccgagcggcauccccgaccgguucuccggcagcaaguccgggaccagcgccacgcucggcaucaccgggcugcagaccggcgacgaggcggacuacuacugcgggaccugggacuccagccuguccgccggcggcguguucgggacgggcaccaaggucaccgugcuc

SEQ ID NO: 9145 - RNA, 336 nt, Artificial Sequence
  derived and/or modified sequence opt1 from anti-HIV-1_LightChain
cagagcgcccugacccagcccgccuccgugagcggcuccccggggcagagcaucaccaucuccugcacgggcaccgggagcgacgucggcggguacaaccacguguccugguaccagcagcaccccggcaaggcgcccaagcuccugaucuacgacaacaacaagcgccccagcggcaucccggaccgguucuccgggagcaaguccggcaccagcgccacccuggggaucacgggccuccagaccggggacgaggccgacuacuacugcggcaccuggcacuccagccuguccgccggcgggguguucggcaccgggacgaaggucaccgugcug

SEQ ID NO: 9146 - RNA, 333 nt, Artificial Sequence
  derived and/or modified sequence opt1 from anti-HIV-1_LightChain
cagagcgugcugacccagcccccguccgucagcgccgcccccggccagcgcgugaccaucuccugcagcggguccggcagcaacaucggggaccgguucguguccugguaccagcaccuccccggcacgguccccaagcugcugaucuacgacaacgagcaccgcccgagcgggauccccgaccgguucuccggcagcaaguccggcaccagcgcgacccucgggaucaccggccugcagacgggggacgaggccgacuacuacugcggcaccugggacuccagccuguccgccgggggcguguucggcaccgggaccaaggugacgguccuc

SEQ ID NO: 9147 - RNA, 333 nt, Artificial Sequence
  derived and/or modified sequence opt1 from anti-HIV-1_LightChain
cagagcgugcugacccagcccccguccgucagcgccgcccccggccagaagaucaccaucuccugcagcggguccagcuccaacaucggcaagagcgugguguccugguaccgccaguuccccgggacggcgcccaagcuccugaucuacgacaccuacaagcggccgagcggcauccccgaccgcuucuccgggagcaaguccggcaccagcgccacccugggcaucacggggcuccagaccggcgacgaggccgacuacuacugcgggaccuggcacuccagccuguccgccggcggggucuucggcaccggcacgaaggugaccgugcug

SEQ ID NO: 9148 - RNA, 333 nt, Artificial Sequence
  derived and/or modified sequence opt1 from anti-HIV-1_LightChain
cagcccgugcugacccagccgcccagcgccuccggcacccccgggcagcgcgucacgaucagcugcuccggcagcuccagcaacaucgggggcaacaccgugaacugguaccagcaguuccccggggccgcgccgcggcuccugaucuacgaggacaacaagcgccccuccggcauccccgaccgguucagcggcuccaagagcgggaccuccgccacccugggcaucacggggcuccagaccggcgacgaggccgacuacuacugcgggaccugggacagcucccugagcgccggcggcguguucgggaccggcacgaaggucaccgugcug

SEQ ID NO: 9149 - RNA, 333 nt, Artificial Sequence
  derived and/or modified sequence opt1 from anti-HIV-1_LightChain
aacuucaugcugacccagccccacagcguguccgagagcccgggcaagaccgucacgaucuccugcacccgcagcuccgggagcguggccuccaacuacgugcagugguaccagcagcuccccggcaccgcccccaagcugcugaucuacgagaacaacaagcggcccagcgggaucccggaccgcuucuccggcagcaaguccgggaccagcgcgacgcucggcaucaccggccugcagaccggggacgaggccgacuacuacugcggcaccuggcacuccagccuguccgccgggggcgucuucgggacgggcaccaaggugaccgugcuc

SEQ ID NO: 9150 - RNA, 333 nt, Artificial Sequence
  derived and/or modified sequence opt1 from anti-HIV-1_LightChain
cagagcaugcugacccagcccccguccgugagcgccgcccccggccagcgcgucaccguguccugcagcggguccagcuccaacaucggcagccacuucguguccugguaccagcagcuccccgggacggcgcccaagcugcugaucuacgacaacagcaaccggccguccgccauccccgaccgcuucagcggcuccaagagcgggaccuccgccacccucggcaucagcggccugcacaccggggacgaggccgacuacuacugcgccacgugggacaacucccugagcaccggcggggucuucggcaccgggaccaaggugacggugcuc

SEQ ID NO: 9151 - RNA, 333 nt, Artificial Sequence
  derived and/or modified sequence opt1 from anti-HIV-1_LightChain
cagagcgugcugacccagcccccguccgucagcgccgcccccggccagaaggugaucaucuccugcagcgggggcuccagcaacaucgggaacaacuucguguccugguaccaccagcuccccggcaccgcgcccaagcugcugaucuacgagaacacgaagcgcccgagcaagauccccgcccgguucuccgggagcaaguccggcaccagcgccacccucggcaucaccgggcugcagacgggcgacgaggccgacuacuacugcgggaccugggacuccagccuguccgccggcggggucuucggcaccggcaccaaggugacggugcuc

SEQ ID NO: 9152 - RNA, 315 nt, Artificial Sequence
  derived and/or modified sequence opt1 from anti-HIV-1_LightChain
cagagccugcucacccagcccccguccgugagcgccgcccccggccagaaggucaccaucuccugcagcggguccagcuccaacaucggcaacaacuacgugagcugguaccagcagcugcccgggacggcgcccaagcugcucaucuacgagaacaacaagcgcccguccggcauccccgaccgguucagcggguccaagagcggcaccuccgccacccugggcaucaccgggcugcagacgggcgacgaggccgacuacuacugcgggaccugggacagcucccucagcgccggcgggguguucggcaccggc

SEQ ID NO: 9153 - RNA, 336 nt, Artificial Sequence
  derived and/or modified sequence opt1 from anti-HIV-1_LightChain
cagagcgcccugacccagcccgccuccgugagcggcuccccggggcagagcaucaccaucuccugcacgggcaccagcuccgacaucgggagcuacuccuucgucagcugguaccagcagcaccccggcaaggcgcccaagcucaucaucuacgacgugaacaagcgccccuccgggaucccggaccgguucagcggcuccaagagcggcaccuccgccacccuggggaucacgggccugcagaccggggacgaggccgacuacuacugcggcaccugggaccgcagccucuccgccgggggcguguucggcaccgggacgaaggucaccgugcug

SEQ ID NO: 9154 - RNA, 336 nt, Artificial Sequence
  derived and/or modified sequence opt1 from anti-HIV-1_LightChain
cagagcgugcugacccagcccccguccgucagcggcgcccccgggcagcgcgugaccaucuccugcacgggcaacagcuccaacaucggggccggcuucgacgugcacugguaccggcaccuccccgggaccgcgcccaagcugcugaucuacgagaacaccaagcgcccgagcggcauccccgaccgguucuccggcagcaaguccgggaccagcgccacgcucggcaucaccgggcugcagaccggcgacgaggccgacuacuacugcgggaccugggaccgcucccugagcgccggcggcgucuucgggacgggcaccaaggugaccgugcuc

SEQ ID NO: 9155 - RNA, 333 nt, Artificial Sequence
  derived and/or modified sequence opt1 from anti-HIV-1_LightChain
cagagcgugcugacccagcccccguccgucagcgccgcccccggccagaaggugaccaucuccugcagcgggggcuccagcaacaucgggaacuacuacguguccugguaccuccagcugcccggcgcggcccccaagcugcucaucuacgacacggacaagcgcccgagcgggauccccgaccgguucuccggcagcaaguccggcaccagcgccacccuggggaucaccggccugcagacgggggacgaggccgacuacuacugcggcaccugggaccgcucccucagcgccgggggcgucuucggcaccgggaccaaggugacggugcug

SEQ ID NO: 9156 - RNA, 333 nt, Artificial Sequence
  derived and/or modified sequence opt1 from anti-HIV-1_LightChain
cagagcgugcugacccggcccccguccgucagcgccgcccccggccagaaggugaccaucuccugcagcgggcgcuccagcaacaucggcaacaacuacguguccugguaccagcagcuccccggggcggcccccaagcugcugaucuacgagaacaacaagcgcccgagcggcauccccgaccgguucuccgggagcaaguccggcacgagcgccacccucggcaucaccgggcugcagaccggcgacgaggccgacuacuacugcgggacgugggacuccagccuguccgccggcggggucuucggcaccggcaccaaggugaccgugcuc

SEQ ID NO: 9157 - RNA, 333 nt, Artificial Sequence
  derived and/or modified sequence opt1 from anti-HIV-1_LightChain
cagagcgugcugacccagcccccguccgucagcgccgcccccggccagaaggugaccaucuccugcagcgggacgaucuccaacaucggcgcgaaccucgugagcugguaccgccagcugcccgggaccguccccaccgugcugauccacgagaacaacaagcggccguccggcauccccgaccgcuucagcggguccaagagcggcaccuccgccacgcucggcaucaccgggcugcagaccggcgacgaggccgacuacuacugcgggaccuggcacagcucccugagcgccggcgggguguucggcacgggcaccaaggucaccgugcuc

SEQ ID NO: 9158 - RNA, 327 nt, Artificial Sequence
  derived and/or modified sequence opt1 from anti-HIV-1_LightChain
cagagcgugcugacccagcccccguccgucagcgccgcccccggccagaaggugaccaucuccugcagcggguccagcuccaacaucggcaacaacuucgugagcugguaccagcagcuccccgggacggcgcccaagcugcugaucuacgagaacaccaagcgcccguccggcauccccgaccgguucagcggguccaagagcggcaccuccgccacccucggcaucacggggcugcagaccggcgacgaggccgacuacuacugcgggaccugggaccgcagccuguccgccggcggggucuucggcaccggcacgaaggugacc

SEQ ID NO: 9159 - RNA, 333 nt, Artificial Sequence
  derived and/or modified sequence opt1 from anti-HIV-1_LightChain
cagagcgugcugacccagucccccagcgucuccgccgccccgggccagcgcgugaccaucagcugcuccgggggcagcuccaacaucgggagcaacgcgguguccugguaccagcagcuccccggcacggcccccaagcugcugaucuacggggacaccaugcggcccagcggcaucccggaccgcuucuccggcagcaaguccgggaccagcgccacccucggcaucacggggcugcagaccggcgacgaggccgacuacuacugcgggaccugggaccggucccugagcgccggcggcgucuucgggaccggcacgaaggugaccgugcuc

SEQ ID NO: 9160 - RNA, 333 nt, Artificial Sequence
  derived and/or modified sequence opt1 from anti-HIV-1_LightChain
cagagcgugcugacccagcccccguccgucagcgccgcccccggccagcaggucaccaucuccugcagcgggacgaccuccaacaucggcaccaacuacgugagcugguaccagcagaugccgcccgcggcccccaagcuccugaucuacgacaacaagaagcgccccuccgacauccccgaccgguucagcggguccaagagcggcaccuccgccacgcuggggaucaccggccuccagaccggcgacgaggccgacuacuacugcgggaccugggaccgcagccuguccgccggcgggguguucggcacggggaccaaggugaccgugcug

SEQ ID NO: 9161 - RNA, 333 nt, Artificial Sequence
  derived and/or modified sequence opt1 from anti-HIV-1_LightChain
cagagcguggucacccagucccccagcgccuccggcaccccggggcagcgcgugaucaucagcugcuccggcagcuccagcaacaucgggaacaucuacguguccugguaccagcagcugcccggcacggcccccaagcuccugaucuacgagaacaacaagcggcccagcgggaucccggaccgcuucuccggcagcaaguccggcaccagcgcgacccuggggaucaccggccuccagacgggggacgaggccgacuacuacugcggcaccuggcacuccagccuguccgccgggggcgucuucggcaccgggaccaaggugacggugcug

SEQ ID NO: 9162 - RNA, 333 nt, Artificial Sequence
  derived and/or modified sequence opt1 from anti-HIV-1_LightChain
cagagcgugcugacccagcccccguccaugagcgccgcccccggccagaaggucaccaucuccugcagcggguccacgagcaucaucggcaacaacuacaucuccugguaccagcagcuccccgggaccgcgcccaagcugcugaucuacgaggacaacaagcgcccgagcggcauccccgaccgguucuccgggagcaaguccggcaccagcgccacccucggcaucacggggcugcagaccggcgacgaggccgacuacuacugcgggaccugggaccgcucccugagcgccggcgggguguucggcaccggcacgaaggugaccguccuc

SEQ ID NO: 9163 - RNA, 336 nt, Artificial Sequence
  derived and/or modified sequence opt1 from anti-HIV-1_LightChain
cagagcgcccugacccagcccccguccgccagcggcucccgcgggcagagcgugaucaucuccugcaccggcacgagcuccgacgucgggguguacaaccucgugagcugguaccagcagcugcccggcaccgcgcccaagcugcucaucuacgagaacaacaagcggcccuccgggaucccggaccgcuucagcggcuccaagagcggcaccuccgccacccuggggaucacgggccugcagaccggggacgaggccgacuacuacugcggcaccuggcacagcucccucagcgccgggggcgucuucggcaccgggacgaaggugaccgugcug

SEQ ID NO: 9164 - RNA, 333 nt, Artificial Sequence
  derived and/or modified sequence opt1 from anti-HIV-1_LightChain
cagagcgugcugacccagcccccguccaugagcgccgcccccggccaguccgucagcaucuccugcagcggguccagcgacaacaucgagcgcaaccaggugaucuggcuccgccaggugcccggcgcggcccccaccguccugaucaucuucaacaaccggcggccguccggggugcccgaccgcuucagcggcucccggagcgggacguccgccacccugggcaucaccggccuccagaccggggacgaggccgacuacuacugcggcacgugggaccgcagccuguccgccgggggcguguucgggaccggcaccaaggucaccgugcug

SEQ ID NO: 9165 - RNA, 333 nt, Artificial Sequence
  derived and/or modified sequence opt1 from anti-HIV-1_LightChain
cagagcgugcugacccagcccccguccgucagcgccgcccccggccagaccgugacgaucuccugcagcggguccuucagcaacaucgagaccaacuacguguccugguaccagcagcuccccggcaccgcgcccaagcugcugaucuacgagaacaccaagcgcccgagcgggauccccgaccgguucuccggcagcaaguccgggacgagcgccacccucggcaucaccggccugcagaccggggacgaggccgacuacuacugcggcacgugggaccgcucccugagcgccgggggcgucuucgggaccggcaccaaggugaccgugcuc

SEQ ID NO: 9166 - RNA, 333 nt, Artificial Sequence
  derived and/or modified sequence opt1 from anti-HIV-1_LightChain
cagagccugcucacccagcccccguccgugagcgccgcccccggccagaaggucaccaucuccugcagcggguccagcuccaacaucggcagcaaguacgugugcugguaccagcagcugcccgggacggcgcccaagcugcucaucuacgagaacaccaagcgcccguccggcauccccgaccgguucagcggguccaagagcggcaccuccgccacccugggcaucacggggcugcagaccggcgacgaggccgacuacuacugcgggaccugggaccgcagccucuccgccggcgggguguucggcaccggcacgaaggucaccgugcug

SEQ ID NO: 9167 - RNA, 336 nt, Artificial Sequence
  derived and/or modified sequence opt1 from anti-HIV-1_LightChain
cagagcgcccugacccagccccgcuccgugagcggcuccccggggcagagcgucaccaucuccugcacgggcaccaccagcgacgucgggggcuacaacuacguguccugguaccagcagcuccccgggaccgcccccaagcugcugaucuacgagaacaacaagcggcccagcggcaucccggaccgcuucuccggcagcaaguccgggacgagcgcgacccucggcaucaccgggcugcagaccggcgacgaggccgacuacuacugcgggacgugggacaacucccugagcaccggcggcguguucgggaccggcaccaaggugacggugcuc

SEQ ID NO: 9168 - RNA, 333 nt, Artificial Sequence
  derived and/or modified sequence opt1 from anti-HIV-1_LightChain
cagagcgugcugacccagcccccguccgucagcgccgcccccggccagcgcgugaccaucuccugcacgggguucaccagcaacaucggccucaacuacguguccugguaccagcagguccccgggaccacccccaagcuggugaucuucgagaacgaccggcgcuuccugggcaucccggaccgguucagcggguccaagagcggcgcguccgccacgcucggcaucaccgggcugcagaccggcgacgaggccgacuacuacugcgggaccugggacagcucccugagcgccggcgggguguucggcacgggcaccaaggucaccgugcuc

SEQ ID NO: 9169 - RNA, 333 nt, Artificial Sequence
  derived and/or modified sequence opt1 from anti-HIV-1_LightChain
cagagcgugcuggcccagcccccguccgucagcgccgcgcccggccagaaggugaccaucuccugcagcgggcgcaccuccaacaucggcaacaacuacgugagcugguaccagcagcuccccgggacggcccccaagcugcugaucuacgagaacaacaagcggccguccggcauccccgaccgcuucagcggguccaagagcggcaccuccgccacccucggcaucaccgggcugcagacgggcgacgaggccgacuacuacugcgggaccugggacaccagccuguccgccggcggggucuucggcaccggcacgaaggugaccgugcuc

SEQ ID NO: 9170 - RNA, 333 nt, Artificial Sequence
  derived and/or modified sequence opt1 from anti-HIV-1_LightChain
cagagcgugcugacccagcccaccuccgucagcgccgccccgggccgcugggugacgguguccugcagcgggacccgguccaacaucggcgaccacagcgucuccugguuccagcaccuccccggggcggcccccaagcugcugaucuacgagaacaacaagcgccccagcggcaucccggaccgguucuccgggagcaaguccggcaccagcgccacccucggcaucacggggcugcagaccggcgacgaggccgacuacuacugcgggaccugggacuccagccuguccaccggcgggguguucggcacgggcaccaaggugaccguccuc

SEQ ID NO: 9171 - RNA, 333 nt, Artificial Sequence
  derived and/or modified sequence opt1 from anti-HIV-1_LightChain
cagagcgugcugacccagcccccguccgucagcgccgcccccggccagaaggugaccaucuccugcagcggguccagcuccaacaucggcgacaacuacgugagcugguaccagcaguuccccgggacggcgcccaagcuccugaucuccgagaacaacaagcgcccgagcggcauccccgaccgguucuccgggagcaaguccggcaccagcgccacccugggcaucaccgggcuccagacgggcgacgaggccgacuacuacugcgggaccugggacuccagccuguccgccggcggggucuucggcaccggcaccaaggugacggugcug

SEQ ID NO: 9172 - RNA, 333 nt, Artificial Sequence
  derived and/or modified sequence opt1 from anti-HIV-1_LightChain
caggcccugcucacccagcccccgagcguguccgccgcgcccggccagaaggucaccaucagcugcuccgggagcuccagcaacaucggcaacaacuacguguccugguaccagcagcugcccgggacggcccccaagcugcucaucagcgagaacaacaagcgcccguccggcauccccgaccgguucagcggguccaagagcggcaccuccgccacccugggcaucaccgggcugcagacgggcgacgaggccgacuacuacugcgggaccugggacaccagccucuccgccggcgggguguucggcaccggcacgaaggucaccgugcug

SEQ ID NO: 9173 - RNA, 333 nt, Artificial Sequence
  derived and/or modified sequence opt1 from anti-HIV-1_LightChain
cagcuggugcucacccagcccccgagcgccuccggcacccccgggcagcgcgucacgaucagcugcuccggcagcaccuccaacaucgggaccuacuacguguacugguaccagcugcugcccggcaccacgcccaaggugcucaucuacgccaacgaccagcggccgagcgggauccccgaccgcuucuccggcagcaaguccggcaccagcgcgacccuggggaucaccggccugcagacgggggacgaggccgacuacuacugcggcaccugggacuccagccucuccaccgggggcgucuucggcaccgggacgaaggugaccgugcug

SEQ ID NO: 9174 - RNA, 333 nt, Artificial Sequence
  derived and/or modified sequence opt1 from anti-HIV-1_LightChain
cagagcgugcugacccagcccccguccgucagcgccgcccccggccagaaggugaccaucuccugcagcgggacguccagcaacaucggcaacaacuucguguccugguaccagcgccuccccgggaccgcgcccaagcugcugaucuucgagaacgacaagcggccgagcggcauccccgaccgcuucuccgggagcaaguccggcaccagcgccacccucggcaucacggggcugcagaccggcgacgaggccgacuacuacugcgggaccugggaccggucccugagcgccggcggggucuucggcaccggcacgaaggugaccgugcuc

SEQ ID NO: 9175 - RNA, 333 nt, Artificial Sequence
  derived and/or modified sequence opt1 from anti-HIV-1_LightChain
cagagcgugcugacccagucccccagcgucuccgccaccccgggccagcgcgugacgaucagcugcuccgggaacaccagcaacaucggcaagaacuucguguccugguaccagcaguuccccgggaccgcccccaagcuccugaucuacgacaacgacaagcggcccagcggcaucccggaccgcuucuccgggagcaaguccggcaccagcgcgacgcugggcaucaccgggcuccagaccggcgacgaggccgacuacuacugcgggaccugggacuccagccuguccgccggcggggucuucggcacgggcaccaaggugaccgugcug

SEQ ID NO: 9176 - RNA, 333 nt, Artificial Sequence
  derived and/or modified sequence opt1 from anti-HIV-1_LightChain
cagagcgugcugacccagcccccguccgucagcgcggcccccggccgcgaggugaucaucuccugcagcggguccagcuccaacaucggcaacaaccacgugagcugguaccagcagcuccccgggaccgcgcccaagguccugaucuacgaguccaacaagcggcacagcggcaucccggaccgcuucuccgggagcaaguccggcacgagcgccacccuggccaucaccggccuccagaccggggacgaggccgacuacuacugcggcgccugggacuccagccuguccgccgggggcguguucgggacgggcaccaaggugaccguccug

SEQ ID NO: 9177 - RNA, 333 nt, Artificial Sequence
  derived and/or modified sequence opt1 from anti-HIV-1_LightChain
cagagcgugcugacccagcccccguccgccagcggcacccccgggcagcgcgucacgaucuccugcagcggcuccagcuccaacaucggggacagcaccgugaacugguaccagcagcuccccggcaccgcccccaagcugcugaucuacgagaacaccaagcggccguccgggauccccgaccgcuucagcggcuccaagagcggcacguccgcgacccucgggaucaccggccugcagaccggggacgaggccgacuacuacugcggcacgugggaccggagccuguccgccgggggcguguucggcaccgggaccaaggucaccgugcuc

SEQ ID NO: 9178 - RNA, 333 nt, Artificial Sequence
  derived and/or modified sequence opt1 from anti-HIV-1_LightChain
cagagcgugcugacccagcccccguccgucagcgccgcccccggccagaaggugaccaucuccugcagcggguccacgagcaacaucggcaacaacuacguguccugguaccagcagcuccccgggaccgcgcccaagcugcugaucuacgagaacaaccgccagccgagcggcauccccgaccgguucuccgggagcaaguccggcaccagcgccacccucggcaucacggggcugcagaccggcgacgagggggacuacuacugcggcaccugggaccgcucccugagcgccgggggcgucuucggcaccgggacgaaggugaccgugcuc

SEQ ID NO: 9179 - RNA, 333 nt, Artificial Sequence
  derived and/or modified sequence opt1 from anti-HIV-1_LightChain
cagagcgugcugacccagcccccguccgucagcgccgcccccggccagaaggugaccaucuccugcagcggguccagcuccaacaucggcagcaacuacguguccugguaccagcagcuccccgggacggcgcccaagcugcugaucuacgagaacaacaagcgcccgagcggcauccccgaccgguucuccgggagcaaguccggcaccagcgccacccucggcaucaccgggcugcagacgggcgacgaggccgucuacuacugcgggaccugggacuccagccugaccgccggcgggguguucggcuccggcaccaaggugacgguccuc

SEQ ID NO: 9180 - RNA, 336 nt, Artificial Sequence
  derived and/or modified sequence opt1 from anti-HIV-1_LightChain
cagagcgugcugacccagcccccguccgucagcggcgcccccgggcagcgcgugaccaucuccugcaucggcagcuccagcaacaucggggccgacuaccgggugcacugguaccagcagcuccccggcacggcgcccaagcugcugaucuacgagaacaacaagcgcccguccgggauccccgaccgguucagcggcuccaagagcggcaccuccgccacccucgggaucaccggccugcagacgggggacgaggccgacuacuacugcggcaccugggacagcucccugagcaccgggggcgucuucggcaccgggacgaaggugaccgugcuc

SEQ ID NO: 9181 - RNA, 336 nt, Artificial Sequence
  derived and/or modified sequence opt1 from anti-HIV-1_LightChain
cagagcgugcugacccagcccccguccgucagcggcgcccccgggcagcgcaucaccguguccugcacgggcaccagcuccaacaucggggcccccuacgacgugaacugguaccagcagcuccccggcaccgcgccgaagcugcugaucuacgagaacaccaagcggcccagcgggauccccgaccgcuucuccggcagcaaguccggcacgagcgccacccucgggaucaccggccugcagaccggggacgaggccgacuacuacugcggcacgugggaccggucccugagcgccgggggcgucuucggcaccgggaccaaggugaccgugcuc

SEQ ID NO: 9182 - RNA, 333 nt, Artificial Sequence
  derived and/or modified sequence opt1 from anti-HIV-1_LightChain
cagagcgugcugacccagcccccggccauguccgccgcgcccggccagagcgucaccaucuccugcagcggguccgccuucaacaucgagcgccaccaggugacguggcuccggcaccuccccggcaccgcccccaccagcgugaucaucaugaacaaccagcgcccguccgggguccccgaccgguucagcggcucccgcagcgggaccuccgccacgcugggcaucaccggccugcagaccggggacgagggcgacuacuacugcgggaccugggaccggagccuguccgccggcgggguguucggcacgggcaccaaggugaccguccug

SEQ ID NO: 9183 - RNA, 333 nt, Artificial Sequence
  derived and/or modified sequence opt1 from anti-HIV-1_LightChain
cagagcgugcuggcccagcccccguccgccagcggcacccccgggcagcgcgucaccaucuccugcagcggcuccgcgagcaacaucggguucaacuccgugacgugguaccagcagcuccccggcaccgcccccaccgugcugaucuacgggaacgaccugcggccgagcggcauccccgaccgcuucuccggcagcaaguccgggaccagcgccacgcucggcaucaccgggcugcagaccggcgacgagggggacuacuacugcggcaccugggaccggucccugagcgccggcggggucuucggcacggggaccaaggugaccgugcuc

SEQ ID NO: 9184 - RNA, 336 nt, Artificial Sequence
  derived and/or modified sequence opt1 from anti-HIV-1_LightChain
cagagcgcccugacccagcccgccuccgugagcggcuccccgggggagagcaucaccaucuccugcacgggcacccgcagcgacaucgggaacuacgcguacgucuccugguaccagcagcuccccggcaccgcccccaagcugcugaucagcgagaacaacaagcggcccuccgggaucccggaccgcuucagcggcuccaagagcggcaccuccgccacgcucgggaucaccggccugcagaccggggacgaggccgacuacuacugcggcaccugggacagcucccugagcgccgggggcguguucggcacggggaccaaggugaccguccuc

SEQ ID NO: 9185 - RNA, 333 nt, Artificial Sequence
  derived and/or modified sequence opt1 from anti-HIV-1_LightChain
cagagcgugcugacccagcccccguccgucagcgccccgcccggccagaaggugaccaucuccugcagcgggacgaccuccaacaucggcagcaacuacguggccugguaccagcagcuccccgggaccgcgcccaagcugcugaucuacgacaacgacaagcgccccuccggcauccccgaccgguucagcggguccaagagcggcaccuccgccacgcucggcaucaccgggcugcagaccggcgacgaggccgacuacuacugcgggaccugggaccgcagccuguccgccggcggggucuucggcacgggcaccaaggugaccgugcuc

SEQ ID NO: 9186 - RNA, 333 nt, Artificial Sequence
  derived and/or modified sequence opt1 from anti-HIV-1_LightChain
cagagcgugcugacccagucccccagcgucuccggcaccccggggcagcgcgugacgaucuucugcagcggcuccgacagcgacaucgggaucaacuccgugagcugguaccagcagcuccccggcaccgcccccaagcugcugaucuacgacaacaacaagcggcccuccgggaucccggaccgcuucagcggcuccaagagcggcaccuccgccacccucgggaucacgggccugcagaccggggacgaggcggacuacuacugcggcaccugggaccggagccuguccgccgggggcgucuucggcaccgggacgaaggugaccgugcuc

SEQ ID NO: 9187 - RNA, 333 nt, Artificial Sequence
  derived and/or modified sequence opt1 from anti-HIV-1_LightChain
cagagcgugcugacccagcccccguccgucagcgccgcccccggccagaaggugaccaucuccugcagcgggaacuccagcaacaucggcaacaacuacguguccugguaccagcaccuccccgggacggcgcccaagcugcugaucuacgagaacaccaagcgcccgagcggcauccccgaccgguucuccgggagcaaguccggcaccagcgccacccucggcaucacggggcugcagaccggcgacgaggccgacuacuacugcgggaccugggaccgcucccugagcgccggcggggucuucggcaccggcacgaaggugaccgugcuc

SEQ ID NO: 9188 - RNA, 333 nt, Artificial Sequence
  derived and/or modified sequence opt1 from anti-HIV-1_LightChain
cagagccugcucacccagcccccguccgugagcgccgcccccggccagaaggucaccaucuccugcagcgggggcaacuccgacaucgggaagaacuucgugagcugguaccagcagcugcccggcacggcgcccaagcugcucaucuacgagaacaacaagcgcccguccgggauccccgaccgguucagcggcuccaagagcggcaccuccgccacccuggggaucaccggccugcagacgggggacgaggccgacuacuacugcggcaccugggacaacagccucuccaccgggggcguguucggcaccgggacgaaggucaccgugcug

SEQ ID NO: 9189 - RNA, 333 nt, Artificial Sequence
  derived and/or modified sequence opt1 from anti-HIV-1_LightChain
cagagcgugcugacccagcccccguccgucagcgccgcccccggccagaaggugaucaucuccugcagcggguccagcuccaacaucggcaagaacuacguggcgugguaccagcagcuccccgggaccgcccccaagcugcuggucuacgagaacacgaaccgcccgagcggcauccccgaccgguucuccgggagcaaguccggcaccagcgccacccucggcaucaccgggcugcagacgggcgacgaggccgacuacuacugcgggaccugggacuccagccuguccgccggcgggguguucggcaccggcaccaaggugacgguccuc

SEQ ID NO: 9190 - RNA, 333 nt, Artificial Sequence
  derived and/or modified sequence opt1 from anti-HIV-1_LightChain
cagagcgugcugacccagcccccguccgucagcgccgcccccggccagaaggugaccaucuccugcagcggguccaugagcgacaucggccucaaccccguguccugguaccgccagcugcccgaggcgccgccccaccuccugaucuucgacaacgacgagcggcccagcgggacggccggccgcuucuccgccagcaaguccgggaccagcgccacccuggacaucaccggccugcagacgggcgacgaggccgacuacuacugcgggaccugggacuccagccucuccgcgggcggggucuucggcaccgggaccaaggugacggugcug

SEQ ID NO: 9191 - RNA, 336 nt, Artificial Sequence
  derived and/or modified sequence opt1 from anti-HIV-1_LightChain
cagagcgcccugacccagcccgccuccgugagcggcuccccggggcagagcaucaccaucuccugcacgggcaccagcuccgacgucgggagcuacaaccucguguccugguaccagcaguaccccggccgcgcgcccaagcugcugaucuacgagaacaacaagcggcccagcgggaucccggaccgcuucuccggcagcaaguccggcaccagcgccacccucgggaucacgggccugcagaccggggacgaggccgacuacuacugcggcaccugggacaacucccugagcaccgggggcguguucggcacggggaccaaggucaccgugcuc

SEQ ID NO: 9192 - RNA, 333 nt, Artificial Sequence
  derived and/or modified sequence opt1 from anti-HIV-1_LightChain
cagagccugcucacccagcccccguccgugagcgccucccccggccagaaggucaccaucagcugcuccgggacgagcuccaacaucggcaacaacuacgugagcugguaccagcaguuccccgggaccgcccccaagcugcugaucuacgagaacaacaagcgcuccagcggcaucccggaccgguucuccgggagcaaguccgacaccagcgcgacccucggcaucacgggccugcagaccggggacgaggccgacuacuacugcggcaccugggaccgcucccugagcgccgggggcguguucgggaccggcacgaaggucaccgugcuc

SEQ ID NO: 9193 - RNA, 336 nt, Artificial Sequence
  derived and/or modified sequence opt1 from anti-HIV-1_LightChain
cagagcgugcugacccagcccccguccgucagcggcgcccccgggcagcgcgugaccaucuccugcacgggccggcgcagcaacaucggggccggcuacgacgugcacugguaccagcagcuccccgggaccgcgcccaagcugcugaucuacgagaacaacaagcggccguccggcauccccgaccgcuucagcggcuccaagagcgggaccuccgccacccucggcaucacggggcugcagaccggcgacgaggccgacuacuacugcgggaccugggacaccagccuguccgccggcggcgucuucgggacgggcaccaaggugaccgugcuc

SEQ ID NO: 9194 - RNA, 333 nt, Artificial Sequence
  derived and/or modified sequence opt1 from anti-HIV-1_LightChain
cagagcgugcugacccagcccccguccgucagcgccgcccccggccagcgcgugaccaucuccugcagcggguccagcuccaacaucggcaacaacuucgugagcugguaccaguucuuccccgggacggcgcccaagcucgucaucuacgagaacgacaagcggccguccggcacccccgaccgcuucagcggguccaagagcggcaccuccgccacccuggccaucaucggccugcagacgggggacgagggcgacuacuacugcgggaccugggacaacagccucuccaccggcgggguguucggcaccggcacgaaggugaccguccug

SEQ ID NO: 9195 - RNA, 333 nt, Artificial Sequence
  derived and/or modified sequence opt1 from anti-HIV-1_LightChain
cagagcgugcugacccagcccccguccgucagcgccgcccccggccagcgcgugaccaucuccugcagcgggggcuccagcaacaucgggaacaaccacguguccugguaccagcagcuccccggcacggcgcccaagcugcugaucagcgagaacaacaagcggccguccgggauccccgaccgcuucagcggcuccaagagcggcaccuccgccacccucgggaucaccggccugcagacgggggacgaggccgacuacuacugcggcaccugggacagcucccugagcgccgggggcgucuucggcaccgggaccaaggugacggugcuc

SEQ ID NO: 9196 - RNA, 333 nt, Artificial Sequence
  derived and/or modified sequence opt1 from anti-HIV-1_LightChain
cagagcgugcugacccagcccccguccgucagcgccgcccccggccagaaggugaccaucuccugcagcggguccagcuccaacaucggccgcgacuucgugagcugguaccagcagguccccgggacggcgcccaagcuccugaucuacgacaacgacaagcggccguccggcauccccgaccgcuucagcggguccaagagcggcaccuccgccacccugggcaucaccgggcuccagacgggcgacgaggccgacuacuacugcgggaccugggacagcucccugagcgccggcgggguguucggcaccggcaccaaggugacgguccug

SEQ ID NO: 9197 - RNA, 336 nt, Artificial Sequence
  derived and/or modified sequence opt1 from anti-HIV-1_LightChain
cagaccguggucacccagcccccgagcguguccggcgcccccgggcagacggccaccaucagcugcaccggcuccagcuccaacaucggggcggacuacgacgugcacugguaccagcagcugcccggcaccgcccccaagcuccugaucuacgacaacaacaagcgcccgagcgggauccccgaccgguucuccggcagcaaguccggcacgagcgccacccuggggaucaccggccuccagaccggggacgaggccgacuacuacugcggcacgugggaccgcucccugagcgccgggggcgucuucggcaccgggaccaaggugaccgugcug

SEQ ID NO: 9198 - RNA, 333 nt, Artificial Sequence
  derived and/or modified sequence opt1 from anti-HIV-1_LightChain
aacuucaugcugacccagcccccgagcgccuccggcacccccgggcagcgcgugacgaucagcugcuccggcagcuccagcaacaucggguccaacuacgucuacugguaccagcagcuccccggcaccacccccaagcugcugaucuaccggaacaaccagcgcccgagcgggauccccgaccgguucuccggcagcaaguccggcaccagcgccacgcucgggaucaccggccugcagaccggggacgaggcggacuacuacugcggcaccugggacuccagccuguccgccgggggcguguucggcacggggaccaaggugaccguccuc

SEQ ID NO: 9199 - RNA, 333 nt, Artificial Sequence
  derived and/or modified sequence opt1 from anti-HIV-1_LightChain
cagagcgugcugacccagcccccguccgucagcgccgcccccggccagaaggugaccaucuccugcagcggguccagccccaacaucggcaacaacuuccucuccugguaccagcagcugcccgggacggcgccgaagcugcucaucuacgagaacaccaagcgccccagcggcauccccgaccgguucuccgggagcaaguccggcaccagcgccacccugggcaucacggggcugcagaccggcgacgaggccgacuacuacugcgggaccugggaccgcucccucagcgccggcgggguguucggcaccggcacgaaggucaccgugcug

SEQ ID NO: 9200 - RNA, 333 nt, Artificial Sequence
  derived and/or modified sequence opt1 from anti-HIV-1_LightChain
cagagcgugcugacccagucccccagcgucuccgccgccccgggccagaaggugaccaucagcugcuccgggagcuccagcgacaucggcaacaacuucguguccugguaccagcagcuccccgggacggcgcccaagcugcugaucuacgagaacaacaagcgccccagcggcaucccggaccgguucuccgggagcaaguccggcaccagcgccacccucggcaucaccgggcugcagacgggcgacgaggccgacuacuacugcgggaccugggacuccagccuguccgccggcggggucuucggcaccggcaccaaggugacggugcuc

SEQ ID NO: 9201 - RNA, 333 nt, Artificial Sequence
  derived and/or modified sequence opt1 from anti-HIV-1_LightChain
caguucuuccugacccagcccccgagccucuccgccacccccggccagcgcgugagcaucuccugcagcgggggcggguccaacaucgccaacaacgacgucuucugguuccagcaguuccccggcgcggggccccggcugcugaucuacgacaaccucaagcgccacuacggcacgccggaccgguucagcggcuccaagagcgggaccuccgccacccugggcaucaccgggcugcagacgggcgacgaggccgacuacuacugcgggaccugggacaacagccucuccaccggcggcguguucgggaccggcacgaaggugaccguccug

SEQ ID NO: 9202 - RNA, 333 nt, Artificial Sequence
  derived and/or modified sequence opt1 from anti-HIV-1_LightChain
cagagcgugcugacccagcccccguccgucagcgccgcccccggccagaaggugaccaucuccugcagcggguccggccccaacaucgggagcaacuccgugagcugguaccagcacuuccccggcacggcgccgaagcuccugaucuacgacaacaacaagcgccccuccgggauccccgaccgguucagcggcuccaagagcggcaccuccgccacccuggggaucaccggccuccagacgggggacgaggccgacuacuacugcggcaccugggaccgcagccuguccgccgggggcgucuucggcaccgggaccaaggugacggugcug

SEQ ID NO: 9203 - RNA, 333 nt, Artificial Sequence
  derived and/or modified sequence opt1 from anti-HIV-1_LightChain
cagagcgugcugacccagucccccagcgccuccggcaccccggggcagcgcgucacgaucagcugcuccggcagcuccagcaacaucggguccaacaccgugagcugguuccagcaccuccccggcaccgcccccaagcugcugaucuacgagaacaacaagcggcccuccgggaucccggaccgcuucagcggcuccaagagcggcaccuccgcgacgcucgggaucaccggccugcagaccggggacgaggccgacuacuacugcggcaccuggcacagcucccugagcgccgggggcguguucggcacggggaccaaggucaccgugcuc

SEQ ID NO: 9204 - RNA, 333 nt, Artificial Sequence
  derived and/or modified sequence opt1 from anti-HIV-1_LightChain
cagagcgugcugacccagcccccguccgucagcggcgcgcccgggcagaacgugaucaucuccugcagcggcuccagcuccaacaucgggaagaacuacguggccugguaccagcagcuccccggcaccgcgcccaagaucgucaucuacgagacgaccaaccgcccgagcgggauccccgcccgguucuccggcagcaaguccggcaccagcgccacccuggggaucacgggccugcaggccggggacgaggccgacuacuacugcggcaccugggacuccagccucaacgccgggggcguguucggcaccgggaccaaggugacgguccug

SEQ ID NO: 9205 - RNA, 333 nt, Artificial Sequence
  derived and/or modified sequence opt1 from anti-HIV-1_LightChain
cagagcgugcugacccagcccccguccgucagcgccgcccccggccagaaggugaccaucuccugcagcggguccagcuccaacaucggcaacaacuuccucagcugguaccagcaccuccccgggacggcgccccgccugcugaucuacgacaacgaccagcggccguccggcauccccgaccgcuucagcggguccaagagcggcaccuccgccacccugggcaucaccgggcugcagacgggcgacgaggccgacuacuacugcgggaccuggcacagcucccucagcgccggcgggguguucggcaccggcaccaaggucacggugcug

SEQ ID NO: 9206 - RNA, 333 nt, Artificial Sequence
  derived and/or modified sequence opt1 from anti-HIV-1_LightChain
cagagcgugcugacccagcccccguccgccagcggcacccccgggcagaaggucacgaucuccugcagcggcuccagcuccaacaucgggaacaacuacgugagcugguaccagcagcuccccggcaccgcccccaagcugcugaucuacgagaacaacaagcgcccguccgggauccccgaccgguucagcggcuccaagagcggcaccuccgcgacccucgggaucacgggccugcagaccggggacgaggccgacuacuacugcggcaccugggacagcucccugagcaccgggggcguguucggcacggggaccaaggucaccgugcuc

SEQ ID NO: 9207 - RNA, 333 nt, Artificial Sequence
  derived and/or modified sequence opt1 from anti-HIV-1_LightChain
cagagcgugcugacccagcccccguccgucagcgccgcccccggccagaaggugaccaucuccugcagcgggacgaccuccaacaucggcaaccacuacgugagcugguaccagcaguuccccgggaccgcgcccaagcucaucaucuacgagaccgaccgccggccguccggcauccccgcccgcuucagcggguccaagagcggcacguccgccacccuggccaucgccggccugcagaccggggacgaggcggacuacuacugcggcaccugggacagcucccucagcaccgggggcgucuucgggacgggcaccaaggugaccgugcug

SEQ ID NO: 9208 - RNA, 333 nt, Artificial Sequence
  derived and/or modified sequence opt1 from anti-HIV-1_LightChain
cagcuggugcucacccagcccccgagcgucuccgccgcccccggccagaaggugaccaucagcugcuccgggagcuccagcaacaucggcaacaacuacguguccugguaccagcagcugcccgggacggcgcccaagcugcucaucuacgagaacaacaagcgcccgagcggcauccccgaccgguucuccgggagcaaguccggcaccagcgccacccugggcaucaccgggcugcagacgggcgacgaggccgacuacuacugcgggaccugggacuccagccucuccaccggcggggucuucggcaccggcacgaaggugaccgugcug

SEQ ID NO: 9209 - RNA, 333 nt, Artificial Sequence
  derived and/or modified sequence opt1 from anti-HIV-1_LightChain
cagagcgugcugacccagcccccguccgucagcgccgcccccggccagcgcgugaccaucuccugcagcgggggcuccagcaacaucgggaacaaccacguguccugguaccagcaccuccccggccgggcgccccagcugcugaucuacgacacgacccagcgcccgagccggauccccgaccgcuucuccgggagcaaguccggcaccagcgccacccucggcaucacggggcugcagaccggcgacgaggccgacuacuacugcgggaccugggacaacucccugagcaccggcggggucuucggcacgggcaccaaggugaccgugcuc

SEQ ID NO: 9210 - RNA, 333 nt, Artificial Sequence
  derived and/or modified sequence opt1 from anti-HIV-1_LightChain
cagagcgugcugacccagcccccguccgucagcgccgcccccggccagaagaucaccaucuccugcagcgggucccgcagcaacaucggcaacaacuacguguccugguaccagcaguuccccgggacggcgcccaagcuccugaucuacgacaacaaccagcggccgagccgcauccccgaccgguucuccggcagcaaguccgggaccagcgccacccugggcaucaccggccuccagacgggggacgaggccgacuacuacugcggcaccugggacuccagccuguccgccgggggcguguucgggaccggcaccaaggucacggugcug

SEQ ID NO: 9211 - RNA, 321 nt, Artificial Sequence
  derived and/or modified sequence opt1 from anti-HIV-1_LightChain
cagagcgugcugacccagcccccguccgucagcgccgcccccggccagcgcgugaccaucuccugcuucgggagccgguucuccagcguguccugguaccagcagcuccccggcacggcgcccaagcugcugaucuacccgaacggggagcgccccagcggcauccccgaccgguucuucggguccgagagcggcaccuccgccacccucggcaucaccgggcugcagacgggcgacgaggccgacuacuacugcgccaccugggacagcucccugagcgccgggggcgucuucgggaccggcaccaagcucacggugcug

SEQ ID NO: 9212 - RNA, 333 nt, Artificial Sequence
  derived and/or modified sequence opt1 from anti-HIV-1_LightChain
cagagcgugcugacccagcccccgucccucagcgccgcccccggccagaaggucaccaucuccugcagcggguccagccugaacaucggcaaccacuacguguccugguaccagcagguccccgggacggcgcccaagcugcucaucuacgaggacaacaagcgcccgagcggcauccccgaccgguucuccgggagcaaguccggcaccagcgccacccugggcaucaccgggcugcagacgggcgacgaggccgacuacuacugcgggaccuggcacuccagccucuccgccggcgggguguucggcaccggcaccaaggugacggugcug

SEQ ID NO: 9213 - RNA, 333 nt, Artificial Sequence
  derived and/or modified sequence opt1 from anti-HIV-1_LightChain
caguucgugcugacccagcccccgagcgucuccgccgcccccggccagaaggugaccgugagcugcuccgggacgaccagcgacaucggcgagaacuacgucuccugguaccagaaguuccccgaggcggcccccaagcuccugaucuacgacaacgacaagcgcccgagcgggauccccgaccgguucuccggcagcaaguccgggaccagcgccacccugggcaucacgggccuccagaccggggacgaggccgacuacuacugcggcaccugggaccgcucccugagcgccgggggcguguucgggaccggcacgaaggugaccguccug

SEQ ID NO: 9214 - RNA, 333 nt, Artificial Sequence
  derived and/or modified sequence opt1 from anti-HIV-1_LightChain
cugagcgugcucacccagcccccguccgucagcgccgcccccggccagcaggucaccaucuccugcagcgggacgaccuccaacaucggcaccaacuacgugagcugguaccagcagaugccgcccaccgcgcccaagcugcugaucuacgagaacaacaagcgccccuccgggauccccgaccgguucagcggcuccaagagcgggacguccgccacccucggcaucaccggccugcagaccggggacgaggccgacuacuacugcggcacgugggacagcucccugagcgccgggggcguguucgggaccggcaccaaggugaccgugcuc

SEQ ID NO: 9215 - RNA, 336 nt, Artificial Sequence
  derived and/or modified sequence opt1 from anti-HIV-1_LightChain
cagagcaugcugacccagcccccguccgugagcggcgcccccgggcagcgcgucaccaucuccugcacgggcagccgguccaacaucggggccggcuacgacgugcacugguaccuccagcugcccgggaccgcgcccaagcugcucaucuacgagaacaacaagcgcccgagcggcauccccgaccgguucuccggcagcaaguccgggaccagcgccacccugggcaucacggggcugcagaccggcgacgaggccgacuacuacugcgggaccugggacaacucccucagcaccggcggcguguucgggacgggcaccaaggucaccgugcug

SEQ ID NO: 9216 - RNA, 333 nt, Artificial Sequence
  derived and/or modified sequence opt1 from anti-HIV-1_LightChain
cagagcgugcugacccagcccccguccgucagcgccacccccggccagaaggugacgaucuccugcagcgggucccgcagcaacaucggcucccacuacgugagcugguaccagcaguuccccgaguccgcccccacccuccugaucuacgagaacgucgagcggccgagcgggauccccgaccgcuucuccggcagcaaguccgggaccagcgcgacccugggcaucacgggccuccagaccggggacgaggccgacuacuacugcggcaccugggacuccagccuguccgccgggggcguguucgggaccggcacgaaggugaccguccug

SEQ ID NO: 9217 - RNA, 333 nt, Artificial Sequence
  derived and/or modified sequence opt1 from anti-HIV-1_LightChain
caguucuuccugacccagcccccgagccucuccgccacccccggccagcgcgugagcaucuccugcagcgggggcggguccaacaucgccaacaacgacgucuucugguuccagcaguuccccggcgcggggccccggcugcugaucuacgacaaccucaagcgccacuacggcacgccggaccgguucagcggcuccaagagcggggccaccggcacccuggagaucaccgaggugcagacggccgacgaggccgacuacuacugcgggaccugggacuccagccuguccgccggcgggguguucggcaccggcaccaaggucacggugcuc

SEQ ID NO: 9218 - RNA, 333 nt, Artificial Sequence
  derived and/or modified sequence opt1 from anti-HIV-1_LightChain
cagagcgugcugacccagcccccguccgucagcgccgcccccggccagaaggugaccaucuccugcagcgggggcuccagcaacaucggggacaacuccgugagcugguaccagcagcuccccggcacggcgcccaagcugcugaucuacgagaacaacaagcgcccguccgggauccccgaccgguucagcggcuccaagagcggcaccuccgccacccucgggaucaccggccugcagacgggggacgaggccgacuacuacugcggcaccugggacagcucccugagcaccgggggcgucuucggcaccgggacgaaggugaccgugcuc

SEQ ID NO: 9219 - RNA, 333 nt, Artificial Sequence
  derived and/or modified sequence opt1 from anti-HIV-1_LightChain
cagagcgugcugacccagcccccguccgucagcgccgcccccggccagaccgugacgaucuccugcagcggguccgcgagcaacaucggccgcaacuccgugagcugguaccaguacguccccggggccgcccccaagcggcucaucuacgagaacaacaagcgcccguccggcauccccgaccgguucagcggguccaagagcggcaccuccgccacccugggcaucaccgggcugcagacgggcgacgaggccgacuacuacugcgggaccugggacaccagccucuccgcgggcgggguguucggcaccggcacgaaggugaccguccug

SEQ ID NO: 9220 - RNA, 333 nt, Artificial Sequence
  derived and/or modified sequence opt1 from anti-HIV-1_LightChain
cagagcgugcuggcccagcccccguccgucagcgccgcccccggccagaaggugaccaucuccugcagcgggcgcaccuccaacaucggcaacuacuucgugagcugguaccagcaguuccccgggacggcgccccggcuccugaucuacgacaacgaccagcgcccguccggcauccccgaccgguucagcggguccaagagcggcaccuccgccacccugggcaucaccgggcuccagacgggcgacgaggccgacuacuacugcgggaccugggacagcucccugagcgccggcggggucuucggcaccggcaccaaggugacggugcug

SEQ ID NO: 9221 - RNA, 333 nt, Artificial Sequence
  derived and/or modified sequence opt1 from anti-HIV-1_LightChain
cagagcgcccugacccagcccgccuccgugagcgcggccccgggccagaaggucaccaucuccugcagcggguccagcuccaacaucggcaacaucuacgugagcugguaccagcagcuccccgggacggcccccaagcugcugaucuacgagaacaacaagcgccccuccggcaucccggaccgguucagcggguccaagagcggcaccuccgccacccucggcaucaccgggcugcagacgggcgacgaggccgacuacuacugcgggaccuggcacagcucccugagcgcgggcgggguguucggcaccggcaccaaggucacggugcuc

SEQ ID NO: 9222 - RNA, 333 nt, Artificial Sequence
  derived and/or modified sequence opt1 from anti-HIV-1_LightChain
cagagcgugcugacccagcccccguccgucagcgccacccccggccagcgcgugacgguguccugcagcggguccagcuccaacaucggcaaccacuacgucagcugguaccagcagguccccgggaccgcccccaagcuccugaucuacgacaacuccaaccggccgagcggcauccccgaccgcuucuccgggagcaaguccggcaccagcgcgacccugggcaucacggggcuccagaccggcgacgaggccgacuacuacugcgggaccugggacuccagccuguccgccggcgggguguucggcaccggcacgaaggugaccgugcug

SEQ ID NO: 9223 - RNA, 333 nt, Artificial Sequence
  derived and/or modified sequence opt1 from anti-HIV-1_LightChain
cagagcgugcugacccagcccccgucccucagcgccgcccccggccagcgcgucaccguguccugcagcggguccagcuccaacaucggcgacaacuacgugagcugguaccagcagcugcccggggcggcgccccggcugcucaucuacgacaacuccauccgcccgagcgccauccccgcccgguucuccggcagcaaguccgggacgagcgccacccuggccaucaccggccugcagaccggcgacgaggccgacuacuacugcgggacgugggacuccagccucuccgccggcggggucuucggcaccgggaccaaggugaccgugcug

SEQ ID NO: 9224 - RNA, 336 nt, Artificial Sequence
  derived and/or modified sequence opt1 from anti-HIV-1_LightChain
cagagcgcccugacccagcccgccuccgugagcggcuccccggggcagagcaucaccaucuccugcacgggcaccagcuccgacgucgggggcuacgacuacgugagcugguaccuccagcugcccgggaccgcgcccaagcugcucaucuacgagaacaacaagcgccccuccggcaucccggaccgguucagcggcuccaagagcgggaccuccgccacgcugggcaucaccgggcugcagaccggcgacgaggccgacuacuacugcgggaccugggacagcucccucagcgccggcggcguguucgggacgggcaccaaggucaccgugcug

SEQ ID NO: 9225 - RNA, 333 nt, Artificial Sequence
  derived and/or modified sequence opt1 from anti-HIV-1_LightChain
cagagcgugcugacccagcccccguccgucagcgccgcccccggccagcgcgugaccguguccugcagcggguccagcuccaacaucggcaacaacuacgucagcugguaccagcaguuccccgggacggcgcccaagcucgugaucuacgacaccgacaagcggccguccggcauccccgaccgcuucagcggguccaagagcggcaccuccgccacccugggcaucacggggcugcagaccggcgacgaggccgacuacuacugcgccaccugggacagcucccucagcgccgggggcguguucgggaccggcacgaaggucaccgugcug

SEQ ID NO: 9226 - RNA, 336 nt, Artificial Sequence
  derived and/or modified sequence opt1 from anti-HIV-1_LightChain
cagagcgugcugacccagcccccguccgucagcggcgcccccgggcagcgcgugaccaucuccugcacgggcaacagcuccaacaucggggccggcuacgacgugcacugguaccagcagcuccccgggaccgcgcccaagcugcugaucagcgagaacaacaagcggccguccggcauccccgaccgcuucagcggcuccaagagcgggaccuccgccacccucggcaucacggggcugcagaccggcgacgaggccgacuacuacugcgggaccugggacagcucccugagcgccggcggcgucuucgggaccggcacgaaggugaccgugcuc

SEQ ID NO: 9227 - RNA, 333 nt, Artificial Sequence
  derived and/or modified sequence opt1 from anti-HIV-1_LightChain
cagagcgugcugacccagcccccguccgccagcggcacccccgggcagcgcgucacgaucuccugcagcggcuccagcuccaacaucgggagcaacuacguggacugguaccagcagcuccccggcaccgcccccaagcugcugaucuacgagaacaacaagcggccguccgggauccccgaccgcuucagcggcuccaagagcggcaccuccgcgacccucgggaucacgggccugcagaccggggacgaggccgacuacuacugcggcaccuggcacagcucccugagcgccgggggcguguucggcaccgggacgaaggucaccgugcuc

SEQ ID NO: 9228 - RNA, 333 nt, Artificial Sequence
  derived and/or modified sequence opt1 from anti-HIV-1_LightChain
cagagcgugcugacccagcccccguccgucagcgccacccccggccagacggugaccaucuccugcagcggguccagcuccaacaucggcaacaacuaccucagcugguaccgccagcugccccggaccgcccccaagcugcucaucuacgagaacaaccgccggccguccggggugcccgcgcgcuucagcggcuccaagagcgggaccuccgccacgcuggccaucaccggccugcagaccggcgacgaggccgacuacuacugcgggaccugggacagcucccucagcgccggcggggucuucggcacggggaccaaggugaccgugcug

SEQ ID NO: 9229 - RNA, 321 nt, Artificial Sequence
  derived and/or modified sequence opt1 from anti-HIV-1_LightChain
cagagcgugcugacccagcccccguccgucagcgccgcccccggccagcgcgugaccaucuccugcuucgggagccgguucuccagcguguccugguaccagcagcuccccggcacggcgcccaagcugcugaucuacccgaacggggagcgccccagcggcauccccgaccgguucuucggguccgagagcggcaccuccgccacccucggcaucaccgccguccagacgggggacgaggccgacuacuacugcggcaccugggacgacagccuguccaccgggggcguguucgggaccggcacgaaggugaccguccug

SEQ ID NO: 9230 - RNA, 333 nt, Artificial Sequence
  derived and/or modified sequence opt1 from anti-HIV-1_LightChain
cagagcgugcugacccagcccccguccgucagcgccgcccccggccagaaggugacccucuccugcagcgggacguccagcaacaucggcaacaacuacguguccugguaccagcagguccccggggcggcccccaaggugcugaucuacgagaacgacaagcgcccgagcggcauccccgaccgguucuccgggagcaaguccggcaccagcgccacccugggcaucaccgggcuccagacgggcgacgaggccgacuacuacugcgggaccugggaccgcucccugagcgccggcgggguguucggcaccggcaccaaggucacggugcug

SEQ ID NO: 9231 - RNA, 333 nt, Artificial Sequence
  derived and/or modified sequence opt1 from anti-HIV-1_LightChain
cagagcgugcugacccagcccccguccgucagcgccgcccccggccagaaggugaccaucuccugcagcggguccaacagcaacaucggcaacaacuacguguccugguaccagcagcuccccgggacggcgaccaagcugcugaucuacgagaacgacaagcgccccagcggcaucccggaccgguucuccgggagcaaguccggcaccagcgccacccucggcaucacggggcugcagaccggcgacgaggccgacuacuacugcgggaccuggcacuccagccuguccgccggcggggucuucggcaccggcacgaaggugaccgugcuc

SEQ ID NO: 9232 - RNA, 333 nt, Artificial Sequence
  derived and/or modified sequence opt1 from anti-HIV-1_LightChain
cagagcgugcugacccagcccccgucccucagcgccgcccccggccagcaggucuccaucagcugccuggggcgcuccagcaacaucggcaccaacuacguguccugguaccagcaguuccccgggacggcgcccaagcugcucaucuacgagaacaagaagcggccgagcgagauccccgaccgcuucuccggcagcaaguccgggaccagcgccacccugggcaucaccggccugcagcccggggacgaggccgacuacuacugcggcacgugggacuccagccucuccgccgggggcguguucgggaccggcaccaaggucaccgugcug

SEQ ID NO: 9233 - RNA, 336 nt, Artificial Sequence
  derived and/or modified sequence opt1 from anti-HIV-1_LightChain
cagagcgcccugacccagcccccguccgccagcggcucccccgggcagagcgugaccaucuccugcacgggcaccagcuccgacgucggggcguacaacagcguguccugguaccagcagcuccccggcaccgcccccaagcugcugaucagcgagaacaacaagcgcccguccgggauccccgaccgguucagcggcuccaagagcggcaccuccgccacgcucgggaucaccggccugcagaccggggacgaggccgacuacuacugcggcaccugggacagcucccugagcgccgggggcguguucggcacggggaccaaggucaccgugcuc

SEQ ID NO: 9234 - RNA, 333 nt, Artificial Sequence
  derived and/or modified sequence opt1 from anti-HIV-1_LightChain
cagagcgcccugacccagcccccguccgccagcggcucccccgggcagagcgugaccaucuccugcagcggcggguccagcaacaucggcaacaaccacgucuccugguaccagcaccuccccgggcgcgcgccccagcugcugaucuacgacacgacccagcggccgagccgcauccccgaccgguucuccggcagccgcuccggcaccagcgccacccucgccaucacggggcugcagaccggcgacgaggccguguacuacugcgggaccugggacaacucccugagcaccggcgggguguucggcacgggcaccaaggucaccgugcuc

SEQ ID NO: 9235 - RNA, 333 nt, Artificial Sequence
  derived and/or modified sequence opt1 from anti-HIV-1_LightChain
cagagcgugcugacccagcccccguccgucagcgccgcccccggccagcgcgugaccaucuccugcagcgggggcacguccaacaucgggaacgaguacgugagcugguaccagcagcuccccggcaccgcgcccaagcugcugaucuacgagaacaacaagcggccguccgggauccccgaccgcuucagcggcuccaagagcggcaccuccgccacccucgggaucacgggccugcagaccggggacgaggccgacuacuacugcggcaccugggacagcucccugagcgccgggggcgucuucggcaccgggacgaaggugaccgugcuc

SEQ ID NO: 9236 - RNA, 333 nt, Artificial Sequence
  derived and/or modified sequence opt1 from anti-HIV-1_LightChain
cagagcgugcugacccagcccccguccgucagcgccgcccccggccagcgcgugaccguguccugcagcggguccagcuccaacaucggcaacaacuacgucagcugguaccagcagcuccccggggcggcccccaagcugcugaucuacgacacggacaagcggccguccggcauccccgaccgcuucagcggguccaagagcggcaccuccgccacccucggcaucaccgggcugcagacgggcgacgaggccgacuacuacugcgggaccugggaccggagccuguccgccggcgggguguucggcaccggcaccaaggugacgguccuc

SEQ ID NO: 9237 - RNA, 333 nt, Artificial Sequence
  derived and/or modified sequence opt1 from anti-HIV-1_LightChain
cagagccugcucacccagcccccguccgugagcgccgcccccggccagaaggucaccaucuccugcagcgggggcaacuccgacaucgggaagaacuucgugagcugguaccagcagucccccggcgccgcgccccgccugcugaucuacgagaacgaccggcgcccgagcgggauccccgaccgguucuccggcagcaaguccggcacgagcgccacccucgggaucaccggccugcagaccggggacgaggccgacuacuacugcggcacgugggaccgcucccugagcgccgggggcguguucggcaccgggaccaaggucaccgugcuc

SEQ ID NO: 9238 - RNA, 333 nt, Artificial Sequence
  derived and/or modified sequence opt1 from anti-HIV-1_LightChain
cagagcgugcugacccagcccccguccgucagcgcggcccccggccagaaggugaacaucuccugcagcggguccagcuccaacaucggcaagaacuacgugagcugguaccagcagauccccgggaccgcgcccaagguccucaucuacgagaacaacaagcgcccguccggcauccccgaccgguucagcggguccaagagcggcacguccgccacccugggcaucgccgggcugcagaccggcgacgaggccgacuacuacugcgccaccugggacagcucccucagcgccgggggcguguucgggacgggcaccaaggugaccguccug

SEQ ID NO: 9239 - RNA, 333 nt, Artificial Sequence
  derived and/or modified sequence opt1 from anti-HIV-1_LightChain
cagagcgugcugacccagcccccguccgucagcgccgcccccggccagaaggugaccaucuccugcagcggguccagcuccaacaucggcaaccgccacgugagcugguaccagcagcuccccgggacgguccccaagcugcugaucuacgagaccaacaagcggccguccggcauccccgaccgcuucagcggguccaagagcggcaccuccgcgacccucggcaucacggggcugcagaccggcgacgaggccgacuacuacugcgggaccugggacaacagccuguccaccggcgggguguucggcacgggcaccaaggugaccguccuc

SEQ ID NO: 9240 - RNA, 336 nt, Artificial Sequence
  derived and/or modified sequence opt1 from anti-HIV-1_LightChain
cagagcgugcugacccagcccccguccgucagcggcgcccccgggcagcgcgugaccaucuccugcacgggcagcuccagcaacaucggggccggcuacgacgugcacugguaccagcagcuccccgggaccgcgcccaagcugcugaucuucggccacgacaagcggccguccggcauccccgaccgcuucagcggguccaagagcggcaccuccgccacccucgggaucacgggccugcagaccggggacgaggccgacuacuacugcggcaccugggacagcucccugagcgccggcggggucuucggcaccgggacgaaggugaccgugcuc

SEQ ID NO: 9241 - RNA, 333 nt, Artificial Sequence
  derived and/or modified sequence opt1 from anti-HIV-1_LightChain
cagagcgugcugacccagcuccccuccgccagcggccugccggggcagaccgucacgaucuccugcagcggcuccaccagcuccaucgggagcaaccacguguacugguaccagcaggucgccggcaccgcgcccaagcugcucaucuacgagaacaacaagcgccccuccgggauccccgaccgguucagcggcuccaagagcggcaccuccgccacgcuggggaucaccggccugcagaccggggacgaggccgacuacuacugcgccaccugggacagcucccucagcgccggcgggguguucggcacgggcaccaaggugaccgugcug

SEQ ID NO: 9242 - RNA, 333 nt, Artificial Sequence
  derived and/or modified sequence opt1 from anti-HIV-1_LightChain
cagagcgugcugacccagacccccuccgccagcggcgccccggggcagggcgucacgaucuccugcagcggguccagcuccaacgugggccgcaacuacgugagcugguaccagcagcuccccgggaccgcgcccaagcugcugaucuacgagaacaccaagcggcccuccggcaucccggaccgcuucagcggcuccaagagcgggaccuccgccacgcucggcaucaccgggcugcagaccggcgacgaggccgacuacuacugcgggaccugggaccggagccuguccgccggcggcgucuucgggacgggcaccaaggugaccgugcuc

SEQ ID NO: 9243 - RNA, 333 nt, Artificial Sequence
  derived and/or modified sequence opt1 from anti-HIV-1_LightChain
cagagcgugcugacccagcccccguccgucagcgccgcccccggccagaaggugaccaucuccugcagcggguccagcuccaacaucggcaacaacuacgugagcugguaccagcaguuccccgggacggcgcccaagcuccugaucuccgacaacaacaagcgcccgagcggcauccccgaccgguucuccgucagcaaguccgggaccagcgccacccugggcaucaccggccuccaggccggggacgaggccgacuacuacugcggcacgugggacuccagccuguccgccgggggcguguucgggaccggcaccaaggugaccguccug

SEQ ID NO: 9244 - RNA, 333 nt, Artificial Sequence
  derived and/or modified sequence opt1 from anti-HIV-1_LightChain
cagagcgugcugacccagcccccguccgucagcgccgcccccggccagaaggugaccaucuccugcagcggguccaacagcaacaucggcaacaacuacgugacgugguaccagcaguuccccgggaccgcgcccaagguccucaucuacgacaacucccgccggccgagcggcauccccgaccgcuucuccgggagcaaguccggcaccagcgccacccugggcaucacggggcugcagaccggcgacgaggccgacuacuacugcgggaccugggacuccagccucuccgccggcgggguguucggcaccggcacgaaggugaccguccug

SEQ ID NO: 9245 - RNA, 333 nt, Artificial Sequence
  derived and/or modified sequence opt1 from anti-HIV-1_LightChain
cagagcgugcugacccagcccccguccgucagcggcgcccccgggcagcgcgugaccaucuccugcagcggcuccagcuccaacaucgggaacaacuacgugagcugguaccagcagcuccccggcacggcccccaagcugcugaucuacgagaacaccaagcggccguccgggauccccgaccgcuucagcggcuccaagagcggcaccuccgcgacccucgggaucacgggccugcagaccggggacgaggccgacuacuacugcggcaccugggaccggagccuguccgccgggggcgucuucggcaccgggacgaaggugaccgugcuc

SEQ ID NO: 9246 - RNA, 333 nt, Artificial Sequence
  derived and/or modified sequence opt1 from anti-HIV-1_LightChain
cagagcgugcugacccagcccccguccgucagcgccgcccccggccagaccgugacgaucuccugcagcggguccaccagcaacaucggccagaacuuccucuccugguuccagcacgugcccgggaccgcgcccaagcugcugaucuacgagaacaacaagcgcccgagcggcauccccgaccgguucuccgggagcaaguccggcaccagcgccacgcucggcaucaccgggcugcagaccggcgacgaggccgacuacuacugcgggaccuggcacuccagccuguccgccggcggggucuucggcacgggcaccaaggugaccgugcuc

SEQ ID NO: 9247 - RNA, 333 nt, Artificial Sequence
  derived and/or modified sequence opt1 from anti-HIV-1_LightChain
aacuucaugcugacccagcccccgagcgccuccggcacccccgggcagcgcgugacgaucagcugcuccggcagcuccagcaacaucggguccaaguacgucagcugguaccagcagcuccccggcaccgcccccaagcugcugaucuacgagaacaccaagcggccguccgggauccccgaccgcuucagcggcuccaagagcggcaccuccgcgacgcucgggaucaccggccugcagaccggggacgaggccgacuacuacugcggcaccugggaccggagccuguccgccgggggcguguucggcacggggaccaaggugaccguccuc

SEQ ID NO: 9248 - RNA, 333 nt, Artificial Sequence
  derived and/or modified sequence opt1 from anti-HIV-1_LightChain
cagagcgugcugacccagcccccguccgucagcgccgcccccggccagaaggugaccaucuccugcagcggguccagcuccaacaucggcaacaacuacgugagcugguaccagcuccugcccgggacggcgcccaagcugcucaucuacgagaacaacaagcgcccguccggcauccccgaccgguucagcggguccaagagcggcaccuccgccacccugggcaucaccgggcugcagacgggcgacgaggccgacuacuacugcgggaccugggacaacagccucuccaccggcggggucuucggcaccggcacgaaggugaccgugcug

SEQ ID NO: 9249 - RNA, 333 nt, Artificial Sequence
  derived and/or modified sequence opt1 from anti-HIV-1_LightChain
cagagcgugcugacccagcccccguccgucagcgccgcccccggccagaaggugaccaucuccugcagcggguccagcuccaacaucggcaacaacuacgugagcugguaccagcagcuccccgggacggcgcccaagaucaucaucuacgacaacaacaagcgcccguccggcauccccgaccgguucagcggguccaagagcggcaccuccgccacccugggcaucaccgggcugcagacgggcgacgaggccgacuacuacugcgggaccuggcacagcucccucagcgccggcggggucuucggcaccggcaccaaggugacggugcug

SEQ ID NO: 9250 - RNA, 333 nt, Artificial Sequence
  derived and/or modified sequence opt1 from anti-HIV-1_LightChain
cagagcgugcugacccagcccccguccgccagcgccacccccggccagcgcgucacgaucuccugcagcggguccagcuccaacaucggcagcaagcacguguacugguaccagaagcuccccgggaccgcgcccaagcugcugaucuacgagaacaccaagcggccguccggcauccccgaccgcuucagcggguccaagagcggcaccuccgccacgcucggcaucaccgggcugcagaccggcgacgaggccgacuacuacugcgggaccugggaccggagccuguccgccggcgggguguucggcacgggcaccaaggucaccgugcuc

SEQ ID NO: 9251 - RNA, 432 nt, Artificial Sequence
  derived and/or modified sequence opt1 from anti-HIV-1_HeavyChain
caggcccagcugguggagagcggcgggggcgucgugcagcccgggcgcucccuccggcugagcugcgccgcguccggcuucaccuucagcuccuacgggauccacugggugcgccaggccccgggcaagggccuggagugggucgccgugaugagcuccgacgggaccuacaaguacuacggcgacagcaugaaggggcgguucacgaucucccgcgacaacagcaagaacucccucuaccugcagaugaacagccugcgggccguggacaccgccgucuacuacugcgcgaaggaccucggcgagggggagaacgaggagugggccaccgacuacuacgacuucuccaucggcuaccccggccaggacccccgcgggguggugggcaccuucgacaucugggggcagggcacgauggucaccgugagcucc

SEQ ID NO: 9252 - RNA, 426 nt, Artificial Sequence
  derived and/or modified sequence opt1 from anti-HIV-1_HeavyChain
caggugcagcuggucgagagcggcgggggcguggugcagcccgggcgcucccuccggcugagcugcgccgccuccggcuucaccuucagcuccuacgggaugcacuggguccgccaggcgccgggcaagggccuggaguggguggccgugaucagcgacgacggguccaacaaguacuacgccgacagcgucaagggccgguucaccaucucccgcgacaacagcaagaacacgcucuaccugcagaugaacucccugcgggccgaggacaccgccguguacuacugcgcgaaggaccucggggagagcgagaacgaggagugggccuccgacuacuacgacuucggcagcgacuaccccgggcaggacccccgcgccguggucggcgccuucuggggccaggggaccauggugaccguguccagc

SEQ ID NO: 9253 - RNA, 432 nt, Artificial Sequence
  derived and/or modified sequence opt1 from anti-HIV-1_HeavyChain
caggugcagcuggucgagagcggcgggggcguggugcaguccgggcgcagccuccggcuguccugcgccgccagcggcuucaccuucuccgcguacgcccugcacuggguccgccaggcccccgggaagggccucgaguggguggccgugaucagcuacgacggccgggacaaggacuacgccgacuccgucaaggggcgcuucaccaucagccgggacaacuccaagaacacgcuguaccugcagaugaacagccuccgcgcggaggacaccgccguguacuacugcgccaaggaccugggcgaguccgagaacgaggagugggccagcgacuacuacgacuucggguccgacuacccgggccaggacccccgggcgguggucggggccuucgacaucuggggccagggcaccauggugaccgugagcucc

SEQ ID NO: 9254 - RNA, 432 nt, Artificial Sequence
  derived and/or modified sequence opt1 from anti-HIV-1_HeavyChain
caggugcagcugguccagagcggcgggggccucgugcagcccgggcgcucccugcggcugagcugcguggccuccggcuuccgcuucagcuuccacgggaugcacuggguccggcaggccccgggcaagggccucgaguggguggcgguggucuccgacgacgggagcgaccagaaguacguggacuccgugaagggccgccugaccaucagccgggacaacuccaagaacaccgucuaccugcagaugaacagccuccgcgccgaggacacggccguguacuacugcgccaaggaccugggggaguccgagaacgaggagugggccagcgacuacuacgacuucggcuccgacuaccccgggcaggacccccgggcgguggucggcgccuucgacaucuggggccaggggaccauggugaccgugagcucc

SEQ ID NO: 9255 - RNA, 432 nt, Artificial Sequence
  derived and/or modified sequence opt1 from anti-HIV-1_HeavyChain
gaggugcaccuggucgagagcggcgggggcguggugcagcccgggcggucccuccggcugagcugcgccgccuccggcuucaccuucaacagcuacgcgaugaucuggguccgccaggccccggggaagggccuggaguggguggccgugaucuccuacgacggcaacaacaaguacuacgccgacagcgucaaggggcgguucaccaucucccgcgagaacagcaagaacacgcucuaccugcagaugaacucccugcgggccgaggacaccgcgguguaccacugcgccaaggaccucggcgagagcgagaacgaggagugggccuccgacuacuacgacuucgggcgcgacuaccccggccaggacccccgcgggguggucggcaccuucgacaucuggggccacgggaccauggugacggugagcucc

SEQ ID NO: 9256 - RNA, 432 nt, Artificial Sequence
  derived and/or modified sequence opt1 from anti-HIV-1_HeavyChain
caggugcagcuggucgagagcggcgggggcguggugcgccccgggggcucccuccggcugagcugcaccgccuccggguuccacuucaacaaguacggcaugaacuggguccgccaggccccgggcaaggggcuggcgcucguggccuucauccagagcggcgccuccuacaacuacuacgccgacagcgugaaggggcgguucaccaucucccgcgacaacagcaagaacacgcuguaccugcagaugaacucccuccgggccgaggacaccgcggucuacuacugcgccaaggaccugggcgacagcgagaacgaggagugggccuccgacuacuacgacuucgggcgcgacuaccccggccaggacccccggggcguggugggggccuucgacaucuggggccacgggaccauggucaccgugagcucc

SEQ ID NO: 9257 - RNA, 432 nt, Artificial Sequence
  derived and/or modified sequence opt1 from anti-HIV-1_HeavyChain
caggugcaccuggucgagagcggcgggggcguggugcagcccgggaagucccucaccaucuacugcgccgucagcgaguucacccuguccaacuacgccaugcacugggugcgccugacgccgggcaaggggcuccaguggguggcggucaucagcuacgacggcuccaacaaguacuacgccgacagcgugaagggccgguucaccaucucccgcgacaacagcaagaacacccuguaccugcagaugaacucccuccgggccgaggacaccgccguguacuacugcgccaaggaccugggggagagcgagaacgaggagugggcguccgacuacuacgacuucggccgcgacuaccccgggcaggacccccggggcgucguggggguguucgacaucuggggccagggcacgauggucaccgugagcucc

SEQ ID NO: 9258 - RNA, 432 nt, Artificial Sequence
  derived and/or modified sequence opt1 from anti-HIV-1_HeavyChain
gaggugcagcugcucgagagcggcgggggcgucgugcagcccgggcgcucccugcggcugagcugcgccgccuccggcuucaccuucagcaccuacgcgcuccacugggugcgccaggccccggggaagggccuggagugggucgccgugaucuccuacgacggcagcacgaaguucuacgccgacuccgugaaggggcgguucaccaucagccgcgacaacuccaagaacacccuguaccuccagaugaacagccugcgggccgaggacaccgcggucuacuacugcgccaaggaccugggcgaguccgagaacgaggagugggccagcgacuacuacgacuucggguccgacuaccccggccaggacccccgcgccguggugggggcguucgacaucuggggccagggcacgauggucaccgugagcucc

SEQ ID NO: 9259 - RNA, 432 nt, Artificial Sequence
  derived and/or modified sequence opt1 from anti-HIV-1_HeavyChain
caggugcagcuggucgagagcggcgggggcguggugcagcccgggggcucccuccgccugagcugcgccgccuccggguucaccuucagcuccuacggcaugcacuggguccggcaggcgccgggcaaggggcuggaguggguggccuucauccgcuacgacggcagcaacaaguacuacgccgacuccgugaaggggcgguucaccaucagccgcgagaacuccaagaacacgcucuaccugcagaugaacagccugcgggccgaggacaccgccgucuaccacugcgcgaaggaccucggcgaguccgagaucgaggaguggaccagcgacuacuacgacuucgggcgcgacuaccccggccaggacccccggggcguguucgggaccuucgacaucuggggccacgggacgauggugaccgucuccagc

SEQ ID NO: 9260 - RNA, 432 nt, Artificial Sequence
  derived and/or modified sequence opt1 from anti-HIV-1_HeavyChain
gaggugcagcuggucgagagcggcgggggcguggugaagcccgggggcucccuccgccugagcugcgucguguccggguucaccuucagcaacgccuggauguccugggugcggcaggccccgggcaagggccuggagugggucgcggugaucagcgacgacggguccaacaaguacuacgccgacagcgugaagggccgcuucaccaucucccgggacaacagcaagaacacgcucuaccugcagaugaacucccugcgcgccgaggacaccgccgucuacuacugcgccaaggaccucggggagagcgagaacgaggagugggcguccgacuacuacgacuucggcagcgacuaccccgggcaggacccccgggccguggugggcgccuucgacaucuggggccaggggaccauggucaccguguccagc

SEQ ID NO: 9261 - RNA, 432 nt, Artificial Sequence
  derived and/or modified sequence opt1 from anti-HIV-1_HeavyChain
caggugcagcuggucgagagcggcgggggcguggugcagcccgggggcucccuccgccugagcugcgccgccuccggguucaccuucagcaccuacggcaugcacuggguccggcaggcgccgggcaaggggcuggaguggguggccuucauccgcuacgacggccggaacaagaacuacgccgacuccgugaaggggcgcuucacgaucagccgggacaacuccaagaacacccucuaccugcagaugaacagccugcgcgccgaggacaccgccgucuacuacugcgcgaaggaccucggcgaguccgagaacgaggagugggccaccgacuacuacgacuucagcaucggguaccccggccaggacccccggggcgugguggggaucuucgacaucuggggccaggggacgauggucaccguguccagc

SEQ ID NO: 9262 - RNA, 432 nt, Artificial Sequence
  derived and/or modified sequence opt1 from anti-HIV-1_HeavyChain
caggugcaccuggucgagagcggcgggggcguggugcagcccgggggcucccuccgccugagcugcgccgccuccggguucagcuucuccaucuacggcaugcacuggguccggcaggcgccgggcaaggggcuggagugggugaccuucacccgcuacgacggcagcaacaaguacuacacggacuccgugaaggggcgguucaccaucagccgcgacaacuccaagaacacccucuaccugcagaugaacagccugcggaccgaggacacggccgucuacuacugcgccaaggaccucggcgaguccgagaacgaggagugggccagcgacuacuacgacuucggguccgacuaccccggccaggacccccgcgccguggugggcgcguucgacaucugggggcagggcaccauggucaccgugagcucc

SEQ ID NO: 9263 - RNA, 432 nt, Artificial Sequence
  derived and/or modified sequence opt1 from anti-HIV-1_HeavyChain
caggugcagcuggucgagagcggcgggggcguggugcagcccgggggcucccuccgccugagcugcgccgccuccggguucaccuucagcuccuacggcaugcacuggguccggcaggcgccgggcaaggggcuggaguggguggccuucauccgcuacgacggcagcaacaaguacuacgccgaccccgugaaggggcgguucaccaucucccgcgacaacagcaagaacacgcucuaccugcagaugaacucccugcgggccgaggacaccgccgucuacuacugcgcgaaggaccucggcgagagcgagaacgaggagugggccuccgacuacuacgacuucgggcgcgacuaccccggccaggacccccggggcguggugggggucuucgacaucuggggccaggggaccauggugaccgccagcucc

SEQ ID NO: 9264 - RNA, 432 nt, Artificial Sequence
  derived and/or modified sequence opt1 from anti-HIV-1_HeavyChain
gagaugcagcugguggagagcggcgggggccucguccagcccgggggcucccugcgccugagcugcgccgccuccggguucaccuucagcuccuacuggaugagcugggugcggcaggcgccgggcaagggccucgaguggguggccgucaucuccuacgacgggaacaacaaguacuacgccgacagcgugaagggccgcuucaccaucucccgggagaacagcaagaacacgcuguaccugcagaugaacucccuccgcgccgaggacaccgccguguacuacugcgcgaaggaccugggggagagcgagaacgaggagugggccuccgacuacuacgacuucggcagcgacuaccccgggcaggacccccggggcgucgugggcaccuucgacaucugggggcacggcaccauggugacggucuccagc

SEQ ID NO: 9265 - RNA, 432 nt, Artificial Sequence
  derived and/or modified sequence opt1 from anti-HIV-1_HeavyChain
caggugcagcuggucgagagcggcgggggcguggugcagcccgggcgcucccuccggcugagcugcgccgccuccggcuucaccuucagcuccugcgcgaugcacuggguccgccaggccccggggaagggccuggaguggguggccgugaucagcuacgacggcaacaacaagcacuacgccgacuccgucaaggggcgguucaccaucagccgcgacaacuccaagaacacgcucuaccugcagaugaacagccugcgggccgaggacauggcgguguacuacugcgccaaggaccucggcgaguccgagaacgaggagugggccagcgacuacuacgacuucuggcgcgacuaccccgggcaggacccccggggcuggguggggaccuucgacaucuggggccagggcaccauggucaccguguccagc

SEQ ID NO: 9266 - RNA, 432 nt, Artificial Sequence
  derived and/or modified sequence opt1 from anti-HIV-1_HeavyChain
caggugcagcuggucgagagcggcgggggcguggugcagcccgggcgcucccuccggcugagcugcgccgccuccggcuucaccuucagcaacuacgggaugcacuggguccgccaggcgccgggcaagggccuggagugggugaccgugaucuccagcgacggguccaagaaguacuacgccgacagcgucaagggccgguucacgaucucccgcgacaacagcaagaacacccucuaccugcagaugaacgggcugcgggccgacgacaccgccguguacuacugcgccaaggaccucggcgacuccgagaacgaggagugggcgagcgacuacuacgacuucgggcgcgacuaccccggccaggacccccggggcguggucggggccuucgacaucuggggccacgggaccauggugacgguguccagc

SEQ ID NO: 9267 - RNA, 432 nt, Artificial Sequence
  derived and/or modified sequence opt1 from anti-HIV-1_HeavyChain
caggugcagcuggucgagagcggcgggggcguggugcagcccgggggcucccuccgccugagcugcgccgccuccggguucaccuucagcuccuacggcaugcacuggguccggcaggcgccgggcaaggggcuggaguggguggccuucauccgcuacgacggcagcaacaaguacuacgccgacuccgugaaggggcgguucaccaucagccgcgacaacuccaagaacacgcucuaccugcagaugaacagccugcgggccgucgacaccgccguguacuacugcgcgaaggaccucggcgagggggagaacgaggagugggccaccgacuacuacgacuucuccaucggcuaccccggccaggacccccgcgggguggucggcgccuucgacaucugggggcagggcaccauggugacggugagcucc

SEQ ID NO: 9268 - RNA, 432 nt, Artificial Sequence
  derived and/or modified sequence opt1 from anti-HIV-1_HeavyChain
caggugcagcuggucgagagcggcgggggcguggugcagcccgggcgcucccuccggcugagcugcgccgccuccggcuucaccuuccgcaacuacgggaugcacuggguccggcagagcccgggcaagggccuggaguggguggcggugaucuccuacgacgggaagaucaucaacuacaucgacuucgucaagggccgcuucaccaucagccgggagaacuccaagaacacgcucuaccugcagaugaacagccugcgcgccgaggacaccgccguguacuacugcgccaaggaccucggggaguccgagaacgaggagugggccagcgacuacuacgacuucggcuccgacuaccccgggcaggacccccggggcguggucggcaccuucgacaucugggggcacggcaccauggugacggugagcucc

SEQ ID NO: 9269 - RNA, 432 nt, Artificial Sequence
  derived and/or modified sequence opt1 from anti-HIV-1_HeavyChain
gaggugcagcugcucgagagcggcgggggccugguccagcccgggcgcucccugcggcucagcugcgccgccuccggcuucaccuucagcuccuacgugaugcacugggugcgccaggcgccggggaagggccuggagugggucgccgugaucagcuacgacggcuccaacaagcacuacgccgacagcgugaaggggcgguucaccaucucccgcgacaacagcaagaacacgcuguaccuccagaugaacucccugcgggccgaggacaccgccgucuacuaccgcgcgaaggaccugggcgagagcgagaacgaggagugggccuccgacuacuacgacuucgggcgggacuaccccggccaggacccccgcgggguggugggcguccucuacaucuggggccaggggaccauggugaccgugagcucc

SEQ ID NO: 9270 - RNA, 432 nt, Artificial Sequence
  derived and/or modified sequence opt1 from anti-HIV-1_HeavyChain
gaggugcagcuggucgagagcggcgggggccucgugaagcccgggggcucccugcgccugagcugcgccgccuccggguucaccuucagcaccuacuccaugcacugggugcggcaggcgccgggcaagggccucgagugggucgccgugaucagcuacgacgggaacaacaaguacuacgccgacuccgugaagggccgcuucacgaucagccgggagaacuccaagaacacccuguaccugcagaugaacagccuccgcgccgaggacaccgccgucuaccacugcgcgaaggaccugggggaguccgagaacgaggagugggccagcgacuacuacgacuucggccgggacuaccccgggcaggacccccgcggcguggugggcaccuucgacaucugggggcacggcacgauggucaccguguccagc

SEQ ID NO: 9271 - RNA, 432 nt, Artificial Sequence
  derived and/or modified sequence opt1 from anti-HIV-1_HeavyChain
caggugcagcuggucgacagcggcgggggcguggugcagcccgggcgcucccuccggcuguucugcgccgucagcggcuucaccuucuccaccuacacgaugcacugggugcgccaggccccggggcggggccuggaguggguggcggucaucagcuacgacggcuccaccaaguacuacgccgacagcgugcaggggcgcuucaccaucucccgggacaacagcaagaacacccucuaccugcagaugaacucccugcgcgccgaggacacggccguguacuacugcgccaaggaccucggcgagagcgagaacgaggagugggcguccgacuacuacgacuucgggagcgacuaccccggccaggacccccgggccgucgugggggccuucgacaucuggggccagggcaccauggugaccgucuccagc

SEQ ID NO: 9272 - RNA, 426 nt, Artificial Sequence
  derived and/or modified sequence opt1 from anti-HIV-1_HeavyChain
caggugcagcuggucgagagcggcgggggcguggugcagcccgggcgcucccuccggcugagcugcgccgccuccggcuucaccuucagcuccuucgggaugcacuggguccgccaggcgccgggcaagggccuggaguggguggccgugaucagcuacgacgggaacaacaaguacuacgccgacuccgucaagggccgguucaccaucagccgcgagaacuccaagaacacgcucuaccugcagaugaacagccugcggcccgaggacaccgccguguacuacugcgccaaggaccucggggaguccgagaacgaggagugggcgagcgacuacuacgacuucggccgcgacuaccccgggcaggacccccggggcguggucggcaccuucgacaucugggggcacggcaccauggugacggug

SEQ ID NO: 9273 - RNA, 432 nt, Artificial Sequence
  derived and/or modified sequence opt1 from anti-HIV-1_HeavyChain
caggugcagcuggucgagagcggcgggggcguggugcagcccgggcgcucccuccggcugagcugcgccgccuccggcuucauguucagccgcuacgggaugcacuggguccggcaggcgccgggcaagggccuggaguggguggccgugaucucccacgacgggagcaacaaguacuacgccgacuccgucaagggccgcuucaucaucagccgggacaacuccaagaacacccucuaccugcagaugaacagccugcgcgccgacgacaccgccguguacuacugcgcgaaggaccucggggaguccgagaacgaggagugggccagcgacuacuacgacuucuggaucggcuaccccgggcaggacccccggggcguggucggcgccuucgacaucugggggcagggcacgauggugaccguguccagc

SEQ ID NO: 9274 - RNA, 432 nt, Artificial Sequence
  derived and/or modified sequence opt1 from anti-HIV-1_HeavyChain
caggugcagcuggucgagagcggcgggggcguggugcagcccgggggcucccuccgccugagcugcgccgccuccgcguucaccuucagcuccuacgggaugcacuggguccggcaggccccgggcaagggccuggaguggguggccuucauccgcuacgacgggagcaacaaguacuacgccgacuccgugaagggccgguucaccaucagccgcgacaacuccaagaacacccucuuccugcagaugaacagccugcgggccgaggacauggcggucuacuacugcgccaaggaccucggggaguccgagaacgaggagugggccagcgacuacuacgacuucuggcgcgacuaccccggccaggacccccgggggugggugggcacguucgacaucuggggccaggggaccauggugaccgucuccagc

SEQ ID NO: 9275 - RNA, 426 nt, Artificial Sequence
  derived and/or modified sequence opt1 from anti-HIV-1_HeavyChain
caggugcagcuggucgagagcggcgggggcguggugcagcccgggcgcucccuccggcugagcugcgccgccuccggcuucaccuucagcuccuucgggaugcacuggguccgccaggcgccgggcaagggccuggaguggguggccgugaucagcuacgacggguccaacaaguacuacgucgacagcgugaagggccgguucaccaucucccgcgacaacagcaagaacacgcucuaccugcagaugaacucccugcgggccgaggacaccgccguguacgccaaggaccucggggagagcgagaacgaggagugggcguccgacuacuacgacuucggcagcgacuaccccgggcaggacccccgcggcgucgugggcaccuucgacaucuggucccaggggaccauggugacggucagcucc

SEQ ID NO: 9276 - RNA, 432 nt, Artificial Sequence
  derived and/or modified sequence opt1 from anti-HIV-1_HeavyChain
caggugcagcuggucgagagcggcgggggcguggugcagcccgggggcucccuccgccugagcugcgccgccuccggguucaccuucagcaccuacggcaugcacuggguccggcaggcgccgggcaaggggcuggacuggguggccuucauccgcuacgacggcucccacaaguacuacgccgacagcgugaaggggcgguucacgaucucccgcgagaacagcaagaacacccucuaccugcagaugaacucccugcggcccgaggacaccgccgucuacuacugcgccaaggaccucggcgagagcgagaacgaggagugggcguccgacuacuacgacuucgggcgcgacuaccccggccaggacccccggggcgugguggggaccuucgacaucuggggccacgggacgauggucaccgugagcucc

SEQ ID NO: 9277 - RNA, 432 nt, Artificial Sequence
  derived and/or modified sequence opt1 from anti-HIV-1_HeavyChain
caggugcagcuggucgagagcggcgggggcguggugcagcccgggcgcucccuccggcugagcugcgccgccuccggcuucaccuucagcuccuacgcgaugcacuggguccgccaggccccggggaagggccuggaguggguggccgugaucagcuacgacggcuccggggacuacuacgccgacagcgucaagggccgguucaccaucucccgcgacaacagcaaguccacgcucuaccugcagaugaacagccugcggcccgaggacaccgccguguacuacugcgcgaaggaccucggggaguccgagaacgaggagugggccagcgacuacuacgacuucggccgcgacuaccccgggcaggacccccggggcguggucggcaccuucgacaucugggggcacggcaccauggugacgguguccagc

SEQ ID NO: 9278 - RNA, 432 nt, Artificial Sequence
  derived and/or modified sequence opt1 from anti-HIV-1_HeavyChain
caggugcaccuggucgagagcggcgggggcguggugcagcccgggggcucccuccgccugagcugcgccgccuccggguucaccuucagcaccuacggcaugcaguggguccggcaggcgccgggcaaggggcuggaguggguggccuucaucaagaacgacggcacgaacgaguucuacggggacuccgugaagggccgcuucaccaucagccgggacaacuccaagaacaccgucagccuccacauggacucccugcgccccgaggacaccgcccuguacuacugcgccaaggaccucggggagagcgagaacgaggagugggccuccgacuacuacgacuucggcagcgacuaccccggccaggacccccgggcgguggugggggccuucgacaucuggggccaggggacgauggucaccguguccagc

SEQ ID NO: 9279 - RNA, 432 nt, Artificial Sequence
  derived and/or modified sequence opt1 from anti-HIV-1_HeavyChain
caggugcagcuggucgagagcggcgggggcguggugcagcccgggggcucccuccgccugagcugcgucgccuccggguucaccuucagcuccuacggcaugcacugggugcggcaggccccgggcaaggggcuggaguggguggcguucauccgcuacgacggccggaacaaguacuacgccgacagcgucaaggggcgcuucaccaucucccgggacaagagcaagaacacgcucugccugcagaugaacucccugcgcguggaggacaccgccguguacuacugcgccaaggaccucggcgacagcgagaacgaggagugggccuccgacuacuacgacuucgggcgggacuaccccggccaggacccccgcggcgucgugggggcguucgacaucuggggccacgggaccauggugaccgucagcucc

SEQ ID NO: 9280 - RNA, 432 nt, Artificial Sequence
  derived and/or modified sequence opt1 from anti-HIV-1_HeavyChain
caggugcagcuggucgagagcggcgggggcguggugcagcccgggcgcucccuccggcugagcugcgccgccuccggcuucaccuucagcuccuacgggaugcacuggguccgccaggcgccgggcaagggccuggaguggguggccgugaucagcuacgacggguccaacaaguacuaccgggacagcgucaagggccgcuucaccaucucccgggacaacagcaagaacacgguguaccuccagaugaacucccugcgcgccgaggacaccgccguguacuacugcgccaaggaccugggggagagcgaguccgaggagugggcgagcgacuacuacgacuucggccgggacuaccccgggcaggacccccgcggcgucgugggcgcccucgacaucugggggcagggcaucauggugaccgucuccagc

SEQ ID NO: 9281 - RNA, 432 nt, Artificial Sequence
  derived and/or modified sequence opt1 from anti-HIV-1_HeavyChain
gaggugcagcuggucgagagcggcgggggcauggugcagcccgggcgcccgcuccggcuguccugcgccgccagcggcuucaucuucuccggguucggccugcacugggugcgccaggcgcccggcaaggggcucgagugggucgccagcaucuccuacgacggcgggaacaaguacuacgccgacagcgugcggggccgcuucaccaucucccgggacaacagcaagaacacccuguaccugcagaugaacucccuccgcgccgaggacacggccguguacuacugcgcgaaggaccugggggagagcgagaacgaggagugggccuccgacuacuacgacuucggcagcgacuaccccggccaggacccccgggccgucgugggggccuucgacaucuggggccaggggaccauggugaccgucuccagc

SEQ ID NO: 9282 - RNA, 432 nt, Artificial Sequence
  derived and/or modified sequence opt1 from anti-HIV-1_HeavyChain
gaggugcagcuggucgagagcggcgggggcguggugcgccccgggggcucccuccggcugagcugcgccgccuccggguucaccuucaacgacuacggcauggcguggguccgccaggccccgggcaaggggcuggaguggguggccgacaucagcuacgacggcuccaacaaguacuacgccgacagcgugaaggggcgguucaccaucucccgcgacaacagcaagaacacgcucuaccugcagaugaacucccugcgggccgaggacaccgcggucuacuacugcgccaaggaccucggcgagagcgagaacgaggagugggccuccgacuacuacgacuucgggcgcgacuaccccggccaggacccccggggcguggugggggccuucgacaucuggggccaggggaccauggucaccgugagcucc

SEQ ID NO: 9283 - RNA, 429 nt, Artificial Sequence
  derived and/or modified sequence opt1 from anti-HIV-1_HeavyChain
caggugcagcuggucgagagcggcgggggcguggugcagcccgggcgcucccuccggcugagcugcgccgccuccggcuucaccuucagcuccuacgggaugcacuggguccgccaggcgccgggcaagggccuggaguggguggccguggucagcuacgacgaguccaaguacuacgccgacagcgugaaggggcgguucaccaucucccgcgacaacagcaagaacacgcucuaccugcagaugaacucccugcgggccgaggacauggccguguacuacugcgcgaaggaccucggcgagagcgagaacgaggagugggccuccgacuacuacgaguucuggcgcgacuaccccgggcaggacccccggggcugggucgggaccuucgacaucuggggccagggcaccauggugaccgugagcucc

SEQ ID NO: 9284 - RNA, 432 nt, Artificial Sequence
  derived and/or modified sequence opt1 from anti-HIV-1_HeavyChain
caggugcagcuggucgagcccggccgcgggguggugcacccgggcgggagccuccggcuguccugcgucaccagcggcuucaccuucgagaacuuccccaugcacugggugcgccaggcccccgggaagggccuggaguggguggcccucaucuccuacgacggcagcgacaaguacuacuccgacagcgucaaggggcgguucacgaucucccgcgacaacagcaagaacacccuguaccugcagaugaacucccuccgggcggaggacaccgccguguacuacugcgccaaggaccugggcgagagcgagaacgaggagugggccuccgacuacuacgacuucgggagcgacuaccccggccaggacccgcgcgggguggucggcaccuucgacaucuggggccacgggacgauggugaccguguccagc

SEQ ID NO: 9285 - RNA, 432 nt, Artificial Sequence
  derived and/or modified sequence opt1 from anti-HIV-1_HeavyChain
caggcccagcugguggagagcggcgggggcgucgugcagcccgggcgcucccuccggcugagcugcgccgcguccggcuucagcuucgccacccacgccaugcacugggugcgccgguccccggggaagggccuggagugggucgccaccaucagcuacggcgggaagaacgaguacuacgccgacuccgugaagggccgcuucacgaucagccgggagaacuccaagaacacccucuaccugcagaugaacagccugcgcgcggaggacaccgccguguacuacugcgccaaggaccucggggaguccgagaacgaggagugggccagcgacuacuacgacuucggcuccgacuaccccgggcaggacccccggggcgucgugggcaccuucgacaucugggggcacggcacgauggugaccgucagcucc

SEQ ID NO: 9286 - RNA, 432 nt, Artificial Sequence
  derived and/or modified sequence opt1 from anti-HIV-1_HeavyChain
gccgugcagcuggucgagagcggcgggggccucgugaagcccgggggcucccugcgccugagcugcgccgcguccggguucaccuucuucaacaccuggaugagcugggugcggcaguccccgggcaagggccucgagugggucgccgacaucagcuacgacggguccaacaaguacuacgccgacagcgugaagggccgcuucacgaucucccgggacaacagcaagaacacccuguaccugcagaugaacucccuccgcgccgaggacaccgccguguacuacugcgcgaaggaccugggggagagcgagaacgaggagugggccuccgacuacuacgacuucggccgggacuaccccgggcaggacccccgcggcgucgugggcguguucgacaucugggggcagggcaccauggucacggugagcucc

SEQ ID NO: 9287 - RNA, 432 nt, Artificial Sequence
  derived and/or modified sequence opt1 from anti-HIV-1_HeavyChain
caggugcagcuggucgagagcggcgggggcguggugcagcccgggcgcucccuccggcugagcugcgccgccuccggcuucaccuucagcuccuacgggaugcacuggguccgccaggcgccgggcaagggccuggaguggguggccgugaucagcuacgacggguccaacaaguacuacgccgacagcgucaagggccgguucaccaucucccgcgacaacagcaagaacacgcucuaccugcagaugaacucccugcgggccgaggacaccgccguguacuacugcgcgaaggaccucggggagagcgagaacgaggagugggccuccgacuacuacgacuucggcagcgacuaccccgggcaggacccccgcgccguggucggcgccuucgacaucuggggccaggggaccauggugaccguguccagc

SEQ ID NO: 9288 - RNA, 432 nt, Artificial Sequence
  derived and/or modified sequence opt1 from anti-HIV-1_HeavyChain
caggugcgccuggucgagagcggcgggcggguggugcagcccggcgggucccuccgccugagcugcgucgccuccggcuucaccuucagcuccuacgggauccacugggugcggcaggccccgggcaagggccuggagugggugaccuucaucuggcacgacgggcgcgacacguacuacgcggacgccgucaagggccgguucaccaucagccgcgacaacuccaagaacacccucuaccugcagaugaacagccugcgggccgaggacaccgccguguacuacugcgccaaggaccucggggaguccgagaacgaggagugggcgacggacuacuacgacuucuggaccggcuaccccgggcaggacccccgcgccguggucggcgccuucgacaucuggggccaggggaccauggugaccgugagcucc

SEQ ID NO: 9289 - RNA, 432 nt, Artificial Sequence
  derived and/or modified sequence opt1 from anti-HIV-1_HeavyChain
caggugcaccuggucgagagcggcgggggcguggugcagcccgggcgcucccuccggaucuacugcgccgucagcgaguucaccuuccgcaacuacgccaugcacugggugcggcuggcgccgggcaaggggcugcaguggguggccgucaucuccuacgacggcagcaacaaguacuacggcgacuccgugaaggggcgcuucaccaucagccgggacaacuccaagaacacgcucuaccugcagauggacagccugcgcgccgaggacaccgccguguacuacugcgccaaggaccucggcgaguccgagaacgaggagugggcgagcgacuacuacgacuucgggcgggacuaccccggccaggacccccgcggggucgugggcaccuucgacaucuggggccacgggaccauggugacggucuccagc

SEQ ID NO: 9290 - RNA, 432 nt, Artificial Sequence
  derived and/or modified sequence opt1 from anti-HIV-1_HeavyChain
gaggugcagcuggucgagagcggcgggggccucgugaagcccgggggcucccugcgccugagcugcgccgccuccggguucaccuucagcgacgcguggauguccugggugcggcaggccccgggcaagggcauggagugggucgccgugaucagcuacgacggguccaacaaguacuacgccgacagcgugaagggccgcuucaccaucucccgggacaacagcaagaacacgcucuaccugcagaugaacucccugcgcgccgucgacaccgcgguguacuacugcgccaaggaccucggggagggcgagaacgaggagugggccaccgacuacuacgacuucagcaucggguaccccggccaggacccccggggcguggucggggccuucgacaucuggggccaggggaccauggugacgguguccagc

SEQ ID NO: 9291 - RNA, 432 nt, Artificial Sequence
  derived and/or modified sequence opt1 from anti-HIV-1_HeavyChain
gaggugcaggucguggagagcggcgggggccuggugaagcccgggggcucccuccgccugagcugcgaggccuccggguucaccuucagcaacgccuggauguccuggguccggcaggcgccgggcaagggccuggaguggguggccgugaucagcuacgacgggaacaacaaguacuacgccgacuccgucaagggccgcuucaccaucagccgggagaacuccaagaacacgcucuaccugcagaugaacagccugcgcgccgaggacaccgccguguaccacugcgcgaaggaccucggggaguccgagaacgaggagugggccagcgacuacuacgacuucggccgggacuaccccgggcaggacccccgcggcguggucggcaccuucgacaucugggggcacggcaccauggugacgguguccagc

SEQ ID NO: 9292 - RNA, 432 nt, Artificial Sequence
  derived and/or modified sequence opt1 from anti-HIV-1_HeavyChain
caggugcagcuggucgagagcggcgggggcguggugcagcccgggggcucccuccgccugagcugcgccgccuccggguucaccuucagcuccuacggcauccacuggguccggcaggcgccgggcaaggggcuggaguggguggccuucauccgcagcgacgccaccaacaaguacuacgccgacuccgugaagggccgguucacgaucagccgcgagaacuccaagaacacccucuaccugcagaugaacagccugcgggccgaggacaccgcggucuacuacugcgccaaggaccucggggaguccgagaacgaggagugggccagcgacuacuacgacuucggcuccgacuaccccgggcaggacccccgcggcguggugggcaccuucgacaucugggggcacggcacgauggucaccgugagcucc

SEQ ID NO: 9293 - RNA, 432 nt, Artificial Sequence
  derived and/or modified sequence opt1 from anti-HIV-1_HeavyChain
caggugcagcuggucgagagcggcgggggcguggugcagcccgggcgcucccuccggcugagcugcgccgccuccggcuucaccuucagcuccuucgggaugcacuggguccgccaggcgccgggcaagggccuggaguggguggccgugaucagcuacgacgggaacaacaaguacuacgccgacuccgucaagggccgguucaccaucagccgcgagaacuccaagaacacgcucuaccugcagaugaacagccugcgggccgaggacaccgccguguacuacugcgcgaaggaccucggggaguccgagaacgaggagugggccagcgacuacuacgacuucggcuccgacuaccccgggcaggacccccgcggcguggucggcaccuucgacaucugggggcacggcaccauggugacggugagcucc

SEQ ID NO: 9294 - RNA, 432 nt, Artificial Sequence
  derived and/or modified sequence opt1 from anti-HIV-1_HeavyChain
caggugcagcuggucgagagcggcgggggcguggugcagcccgggcgcucccuccggcugagcugcgccgccuccggcuucaccuucagcaacuacgcgauggacuggguccgccaggccccggggaagggccuggaguggguggccgugaucuccuacgacggcagcaacaaguacuacgccgacuccgucaaggggcgguucaccaucagccgcgacaacuccaagaacacgcucuaccugcagaugaacagccugcgggccgaggacaccgcgguguacuacugcgccaaggaccucggcgaguccgagaacgaggagugggccaccgacuacuacgacuucuggaccggguaccccggccaggacccccgcgccguggucggggcguucgacaucuggggccagggcacgauggugaccgugagcucc

SEQ ID NO: 9295 - RNA, 432 nt, Artificial Sequence
  derived and/or modified sequence opt1 from anti-HIV-1_HeavyChain
caggugcagcuggucgagagcggcgggggcguggugcagcccgggcgcucccuccggcugagcugcgccgccuccggcuucaccuucagcuccuacgggaugcacuggguccgccaggcgccgggcaagggccuggaguggguggccguggucagcuacgacgaguccaacaaguacuacgccgggagcgugaagggccgguucaccaucucccgcgacaacagcaagaacacgcucuaccugcagaugaacucccugcggaccgaggacauggccguguacuacugcgccaaggaccucggggagagcgagaacgaggagugggcguccgacuacuacgacuucggccgcgaguaccccgggcaggacccccggggcugggucggcaccuucgacaucugggggcagggcaccauggugacggugagcucc

SEQ ID NO: 9296 - RNA, 432 nt, Artificial Sequence
  derived and/or modified sequence opt1 from anti-HIV-1_HeavyChain
caggugcagcuggucgagagcggcgggggcguggugcagcccgggcgcucccuccggcugagcugcgccgccuccggcuucaccuucagcuccuacgggaugcacuggguccgccaggcgccgggcaagggccuggaguggguggccgugaucagcuacgacggguccaacaaguacuacgucgacagcgugaagggccgguucaccaucucccgcgacaacagcaagaacacgcucuaccugcagaugaacucccugcgggccgaggacaccgccguguacuacugcgccaaggaccucggggagagcgagaacgaggagugggcgaccgacuacuacgacuucuccaucggcuaccccgggcaggacccccgcggcgucgugggcaucuucgacaucugggggcagggcaccauggugacggucagcucc

SEQ ID NO: 9297 - RNA, 432 nt, Artificial Sequence
  derived and/or modified sequence opt1 from anti-HIV-1_HeavyChain
caggugcagcuggucgagagcggcgggggcguggugcagcccgggcgcucccuccggcugagcugcgccgccuccggcuucaccuucagcaccuccgggaugcacuggguccgccaggcgccgggcaagggcauggaguggguggccgugaucagcuacgacggguccaacaaguacuacgccgacagcgucaagggccgguucacgaucucccgcgacaacagcaagaacacccuguaccuccagaugaacucccugcgggccguggacaccgccguguacuacugcgcgaaggaccugggggagggcgagaacgaggagugggccaccgacuacuacgacuucagcaucggguaccccggccaggacccccgcggcgucgugggggccuucgacaucuggggccaggggacgauggugaccgucuccagc

SEQ ID NO: 9298 - RNA, 363 nt, Artificial Sequence
  derived and/or modified sequence opt1 from anti-HIV_C38-VRC18.02_HeavyChain
caggugcgccugguccagagcggcaaccaggugcggaagcccggggccuccgugcgcaucagcugcgaggccuccggcuacaaguucaucgaccacuucauccacuggguccgccaggugccggggcacggccucgaguggcugggguggaucaacccccggggcggcggggugaacuacagccgguccuuccagggcaagcugagcaugaccaugacccgcgacaacuucgaggagacggcguaccucgaccuguccaagcugaaccccggggacaccgccgucuacuucugcgcccggggcuucgccggguacgaguggagcuucaucuggggccagggcacccucgugaucguguccagc

SEQ ID NO: 9299 - RNA, 396 nt, Artificial Sequence
  derived and/or modified sequence opt1 from anti-HIV_44-VRC13.02_HeavyChain
caggugcagcugguccagagcggcaccgcccucaagucccccgggagcuccgccaagcugagcugcaccgugcugggcgacgaguucgggacguacuucaucuccuggauccgccaggcgccgggccaggggcucgagugggugggcggcaucgucccccacagccagcugcaguccagcgcccagaaguuccacgggcggaucaucaucuccgccggcgccggggugaccccgcccguggucagccugcagcucaccaaccugaccuucgaggacacgggcaccuacuucugcgcccgcgagcgggggcgccaccgggaccccaagaccggcgacgcgcugcgcggccgguacuucgacuucugggggcgcggcaccgggcuccggguguccacg

SEQ ID NO: 9300 - RNA, 321 nt, Artificial Sequence
  derived and/or modified sequence opt1 from anti-HIV-1_LightChain
gacaucaagcugacccagagccccgccuuccucuccgccagcgugggcgagcgcgucaccuucacgugccgggcgucccaggacaucagccacgaccuggugugguuccagcagaaggccgggcgcgccccgucccugcucauguucuacggcagcacccuggagcgcggggugccgccccgguucuccggccggcgcagcgggaccgaguucaccgucacgaucgacucccugcagcccgaggacgugggcaccuacuacugccagcagcucagcgccuucccccugaccuucggcgggggcaccacgguggacaucaag

SEQ ID NO: 9301 - RNA, 321 nt, Artificial Sequence
  derived and/or modified sequence opt1 from anti-HIV-1_LightChain
gacaucaagaugacccagagccccgccuuccuguccgccagcgugggcgagcgcgucaccuucacgugccgggcgucccaggacaucagccacgacguggugugguuccagcagaaguccgggagcgccccgaagcuccugauguucuacggcuccacccuggagcgcggggucccgccccgguucagcggccgccgguccgggaccgaguucaccgugacgaucgacggccuccagcccgaggacgugggcaccuacuacugccagcagcugagcgccuucccccugaccuucgggggcgggaccacggucgacaucaag

SEQ ID NO: 9302 - RNA, 321 nt, Artificial Sequence
  derived and/or modified sequence opt1 from anti-HIV-1_LightChain
gacaucaagcugacccagagccccgccuuccucuccgccagcgugggcgagcgcgucaccuucacgugccgggcgucccaggacauccgccacgagcuggugugguaccagcagaagccggggcggggccccaagcugcucaucuacuacgggagcacccuggagggcggggugcccucccgcuucagcggccggcgcuccggcaccgaguucaccgucacgaucagcucccugcagcccgaggacguggggaccuacuacugccagcagcucaacagcuucccgcugaccuucggcgggggcaccacgguggacauccgg

SEQ ID NO: 9303 - RNA, 321 nt, Artificial Sequence
  derived and/or modified sequence opt1 from anti-HIV-1_LightChain
gacauccagcugacccagagccccuccuuccucagcgccuccgugggcgaccgcgucagcaucacgugccgggccucccaggggaucaagcacgagcuggcgugguaccagcagaagccgggccgcgcccccagccugcucaucuacuacgccuccacccuggcccgcggggugcccagccgguucuccgccagcugguccggcacccuguucacccucaccaucaacgggcugcagcccgaggacuucgcgacguacuucugccagcagaugaacagccugccgcucaccuucggcggcgggaccaagauggacgugcgg

SEQ ID NO: 9304 - RNA, 321 nt, Artificial Sequence
  derived and/or modified sequence opt1 from anti-HIV-1_LightChain
gacauccagcugacccagagccccuccuuccucagcgccuccgugggcgacaaggucaccaucacgugccgcgccagccacggggugcggaacgagcuggcgugguaccagcagaagccgggcaaggcccccaaccugcucaucuacuacgccuccacccugcagagcggggugcccucccgcuucagcgccaccggcuccgggacccacuucacgcugaccgucagcucccuccagcccgaggacuucgccaccuacuucugccagcacaugagcuccuacccgcugaccuucggcggcgggacgaagguggagaucaag

SEQ ID NO: 9305 - RNA, 321 nt, Artificial Sequence
  derived and/or modified sequence opt1 from anti-HIV-1_LightChain
gacauccagcugacccagagccccuccuuccucagcgccuccgugggcgacaaggucaccuucacgugccgcgccagccagggggugcggaacgagcuggcgugguaccagcagaagccgggcaaggcccccaaccugcucaucuacuacgccuccacccugcagagcggggugcccucccgcuucagcgccaccggcuccgggacccacuucagccugacggucuccagccuccagcccgaggacuucgccaccuacuucugccagcacauguccagcuacccgcugaccuucggcggcgggaccaagguggagaucaag

SEQ ID NO: 9306 - RNA, 321 nt, Artificial Sequence
  derived and/or modified sequence opt1 from anti-HIV-1_LightChain
gacauccagcugacccagagccccuccuuccucagcgccuccgugggcgacaaggucaccaucacgugccgcgccagccagggggugcggaacgagcuggcgugguaccagcagaagccgggcaaggcccccaaccugcucaucuacuacgccuccacccugcagagcggggugcccucccgcuucagcgccaccggcuccgggacccacuucacgcugaccgucagcucccuccagcccgaggacuucgccaccuacuucugccagcacaugagcuccuacccgcugaccuucggcggcgggacgaagguggagaucaag

SEQ ID NO: 9307 - RNA, 366 nt, Artificial Sequence
  derived and/or modified sequence opt1 from anti-HIV-1_HeavyChain
agccaguaccuggcccagcccggcgccgagguggcgaagccgggggccuccgucaaggugagcugcaaggugcacggcgacaacuuccgcgggcacuaccuccacuggguccggcaggcccccggccaggggcugcaguggaucggcggcaucaaccccuucuccggggaggccgccuacggcaagcgcuucgaggggcggcugcgccucacccgggacaccagcgugaacacggcguacauggagcuggccaagcugacccccgacgacaccgccguguacuucugcgcccgcgacaagaccuacaacgacgaguucacggcgauggacaucuggggccacgggaccaccgucaucguguccagc

SEQ ID NO: 9308 - RNA, 366 nt, Artificial Sequence
  derived and/or modified sequence opt1 from anti-HIV-1_HeavyChain
agccaguaccuggcccagcccggcgccgagguggcgaagccgugggccuccgucaaggugagcugccgcgugcacggggacaacuuccggggcuucuaccuccacuggguccgccaggcccccgggcagggccuggaguggaucgggggcaucaaccccuucuccggcgaggccgccuacgggcggcgcuucgagggccggcugcgccucacccgggacaccagcaucaacacggcguacauggaggugaccaagcugaccuccgacgacaccgccguguacuucugcgcccgcgacaagacguacaacgacgaguucaccgccauggacaucugggggcagggcaccaccgucaucgugagcucc

SEQ ID NO: 9309 - RNA, 366 nt, Artificial Sequence
  derived and/or modified sequence opt1 from anti-HIV-1_HeavyChain
agccaguaccuggcccaguccggcagcgaggugaagaagcccggggccuccgucaaggugagcugccgccuccacggcgacaaguucggggcgcacuacauccacugggugcggcaggccccgggccaggggcuggaguggcugggcuucuuccaccccggcaccggggacgccgucuccgcccagaaguuccagggccgcaucagccucacccgggacacguccaucagcaccggguaccuggaggugcgccggcuguccagcgacgacaccgccguguacuacugcgcgcgcgacaagaccuacuccgacgaggccacgggcauggacaucugggggcagggcaccaccgucaucgugagcucc

SEQ ID NO: 9310 - RNA, 366 nt, Artificial Sequence
  derived and/or modified sequence opt1 from anti-HIV-1_HeavyChain
agccuggagcucgugcaguccggcaccgaggucaagaagcccggggccagcgugaagguguccugcaagcuguucggcgacaccaucacgagcgggccgauccacuggguccgccaggcccccggccaggggcuggaguggaugggcuggaccaacccccacuccggcgacaccgcgaccgcccccaaguuccaggggcggguguacaugacgaacgacaagaagaucaacaccgccuuccucgacgugacccgccuggccagcgacgacaccgccaucuacuucugcgcgcgggacauguacuacuccaacgaggccgucggcauggacgugugggggcagggcacgaccgugagcgucuccagc

SEQ ID NO: 9311 - RNA, 366 nt, Artificial Sequence
  derived and/or modified sequence opt1 from anti-HIV-1_HeavyChain
caggaggugcugguccagagcggcgccgaggugaagaagcccggggccuccgugaaggucagcugccgcgcguucggcuacaccuucaccgcccacgcccuccacugggugcggcaggccccggggcagggccuggaguggcugggguggaucaacccccacuccggcgacacgaccaccagccagaaguuccagggccgcguguacaugacccgggacaaguccaucaacacggccuaccucgaggucacccgccugaccagcgacgacaccgcgaucuucuacugcgcccgggacaaguacuacggggacgaggccgugggcauggacgugugggggcagggcacguccgucaccgugagcucc

SEQ ID NO: 9312 - RNA, 366 nt, Artificial Sequence
  derived and/or modified sequence opt1 from anti-HIV-1_HeavyChain
caggaggugcugguccagagcggcgccgaggugaagaagcccggggccuccgugaaggucagcugccgcgcguucggcuacaccuucaccgggaacgcccuccacugggugcggcaggccccgggccaggggcuggaguggcugggcuggaucaacccccacuccggcgacacgaccaccagccagaaguuccaggggcgcguguacaugacccgggacaaggccaucaacacggccuaccucgacgucacccgccugaccuccgacgacaccgcgaucuacuacugcgcccgggacaaguacuacggcaacgaggccguggggauggacguguggggccaggggacgagcgucaccguguccagc

SEQ ID NO: 9313 - RNA, 366 nt, Artificial Sequence
  derived and/or modified sequence opt1 from anti-HIV-1_HeavyChain
caggaggugcugguccagagcggcgccgaggugaagaagcccggggccuccgugaaggucagcugccgcgcguucggcuacaccuucaccgggaacgcccuccacugggugcggcaggccccgggccaggggcuggaguggcugggcuggaucaacccccacuccggcgacacgaccaccagccagaaguuccaggggcgcguguacaugacccgggacaaguccaucaacacggccuuccucgacgucacccgccugaccagcgacgacaccggcaucuacuacugcgcccgggacaaguacuacgggaacgaggcggugggcauggacgugugggggcagggcacguccgucaccgugagcucc

SEQ ID NO: 9314 - RNA, 303 nt, Artificial Sequence
  derived and/or modified sequence opt1 from anti-HIV_45_LightChain
agccugacccagucccccggcacccucagccuguccccgggggagacggccaucaucagcugccgcaccucccaguacggcagccuggccugguaccagcagcggcccgggcaggcgccccgccucgugaucuacuccggcagcacccgggccgccgggauccccgaccgcuucuccggcagccgguggggcccggacuacaaccugaccaucuccaaccuggagagcggggacuucggcguguacuacugccagcaguacgaguucuucgggcagggcacgaagguccagguggacaucaag

SEQ ID NO: 9315 - RNA, 303 nt, Artificial Sequence
  derived and/or modified sequence opt1 from anti-HIV_45_LightChain
gugcugacccagagccccggcacccucucccugagcccgggggagacggccaccaucuccugccgcaccagccaguacggcucccuggccugguaccagcagcggcccgggcaggcgccccgccucgucaucuacagcggcuccacccgggccgccgggauccccgaccgcuucagcggcucccggagcggcccggacuacacgcugaccaucuccaaccuggagagcggggacuucggcguguacuacugccagcaguacgaguucuucgggcagggcaccaaggugcagcaggacaacaag

SEQ ID NO: 9316 - RNA, 303 nt, Artificial Sequence
  derived and/or modified sequence opt1 from anti-HIV_45_LightChain
gugcugacccagagccccggcacccucucccugagcccgggggagacggccaucaucuccugccgcaccagccaguacggcucccuggccugguaccagcagcggcccgggcaggcgccccgccucgucaucuacagcggcuccacccgggccgccgggauccccgaccgcuucagcggcucccgguggggcccggacuacaaccugaccaucagcaaccuggaguccggggacuucggcguguacuacugccagcaguacgaguucuucgggcagggcacgaaggugcaggucgacaucaag

SEQ ID NO: 9317 - RNA, 363 nt, Artificial Sequence
  derived and/or modified sequence opt1 from anti-HIV_45_HeavyChain
caggugcgccugagccaguccggcgggcagaugaagaagcccggcgagagcaugcggaucuccugccgcgccagcggguacgaguucaucgacugcacccucaacuggauccggcuggccccgggccgccggcccgaguggaugggguggcugaagccccgcggcggcgcggucaacuacgcccggguguuccaggggcgcgugaccaugacgcgggacgucuacuccgacaccgccuuccucgagcugcgcagccugaccgccgacgacaccgccguguacuucugcacgcggggcaagaccguggacuacaacugggacuucgagcacgucgggcccggcaccccggugaccguguccagc

SEQ ID NO: 9318 - RNA, 363 nt, Artificial Sequence
  derived and/or modified sequence opt1 from anti-HIV_45_HeavyChain
caggugcgccugagccaguccggcgggcagaugaagaagcccggcgagagcaugcggaucuccugccaggccagcggguacgaguucaucgacugcacccucaacuggguccgccuggccccgggccggcgccccgaguggaugggguggcugaagccccggggcggcgcggugaacuacgcccgcaucuuccaggggcgggugaccaugacgcgcgacgucuacuccgacaccgccuuccucgagcugcggagccugaccgccgacgacaccgccguguacuucugcacgcgcggcaagaacugcgacuacaacugggacuucgagcacguggggcccggcuacccggucaccguguccccc

SEQ ID NO: 9319 - RNA, 375 nt, Artificial Sequence
  derived and/or modified sequence opt1 from anti-HIV_45_HeavyChain
caggugcgccugagccaguccggcgggcagaugaagaagcccggcgacagcaugcggaucuccugccgcgccagcggguacgaguucaucaacugcccgaucaacuggauccggcucgcccccggcaagcgccccgaguggaugggguggaugaagccccggggcggcgcggucuccuacgcccgccagcugcaggggcgggugaccaugacccgcgacauguacagcgagacggccuuccuggagcuccggucccugaccagcgacgacaccgccguguacuucugcacccgcggcaaguacugcacggcccgggacuacuacaacugggacuucgagcacugggggcagggcaccccggucaccguguccagc

SEQ ID NO: 9320 - RNA, 435 nt, Artificial Sequence
  derived and/or modified sequence opt1 from anti-HIV_cap256-206-252885_VR-Chain
caggagcagcugguggagagcggcgggggcgucgugcccccgggguccagccucacccuguccugcguggccagccgcuucaccuucuccgccuucggcaugcacuggguccggcaggcgcccgggaagggccuggaguggguggccggcgugagcuucgucgggaucaagaaguacuacgccgacuccgugaagggccgcuucacgaucagccgggacaacuccaagaacacccucuuccugcagaugaacgggcugcgcggcgaggacaccgggcucuacuacugcgugaaggacaugcgguaccuggagugcgaggagugggccagcgacuacuacgacuucggcaagcccaaccagcccugccuggaccgccggggcgucuccgggaucagcgccuucuggggccaggggaccacggugaccguguccagc

SEQ ID NO: 9321 - RNA, 438 nt, Artificial Sequence
  derived and/or modified sequence opt1 from anti-HIV_cap256-206-249183_VR-Chain
caggugcugcucgucgagagcggcgggggcgugguggagcccgggaccucccugacccugagcugcgccgccucccgcuucacguucagcaacuucggcaugcacuggguccggcagacccccgggggcggccucgaguggguggcguccaucagcaacgaggggaacaagaaguaccacgccgaguccguguggggccgcuucaucaucagccgggacaacuccaagaacaccgucuuccugcacaugagcucccugcgcccggacgacagcgcccucuacuucugcgugcgggaccgccaggaggacgacugcgagguguggugguccgacuacgaggccuucgggcgggagauccccugccgccaguaccggggccaggggcuggccggcaucuucgacaucuggggccgcgggaccauggucacggugagcucc

SEQ ID NO: 9322 - RNA, 438 nt, Artificial Sequence
  derived and/or modified sequence opt1 from anti-HIV_cap256-206-220956_VR-Chain
cagaugaugcugguggagagcggcggggacgucguggagcccggccgcucccucacccugagcugcgccaccucccaguucacguucagcaacuacgggaugcacugggugcggcaggccccgggccgcgggcuggagugggucgcguccaucagcaacgagggcaacaagaaguaccacgccgaguccguguggggccggcucaucaucagccgcgacaacuccaagaacacccuguuccugcacaugagcucccuccgggccgacgacagcgcccuguacuucugcgugcgcgaccggcaggaggacgagugcgaggaguggugguccaacuacuacgccuucgggcgcggcgggcccugccggaaguaccgcggccaggggcuggcgggcaucuucgacgucuggggccgggggaccauggugaccgugagcucc

SEQ ID NO: 9323 - RNA, 432 nt, Artificial Sequence
  derived and/or modified sequence opt1 from anti-HIV_cap256-206-220629_VR-Chain
caggagcagcugguggagagcggcgggggcgucgugcccccggggaagucccucaagcugagcugcguggccucccgguucagcuucggcgccuucgggaugcacuggguccggcaggcgcccggcaagggccuggaguggguggccgggaucuccuucgccggcaucaagaaguacuacggggacagcgugaagggccgcuucuacaucucccgggacaacagccagaacacccucuuccuggagaugaacgggcugcgcggcgacgacaccgcccgguacuacugcgucaaggaccuccgcgagcuggagugcgaggagugggccuccgacuacuacgacuucggcaagccccagcccugccuggacagccgcgggguguccggcaucagcgcgaugugggggccgggcacgauggugaccgucuccagc

SEQ ID NO: 9324 - RNA, 381 nt, Artificial Sequence
  derived and/or modified sequence opt1 from anti-HIV_cap256-206-200599_VR-Chain
caggagaagcugguggagagcggcgggggcgccguccagcccgggggcucccuccgccugagcugcguggccuccggguucaccuucaacggcuucggcaugcacugggugcggcaggcgccggggaagggccuggagugggucgccaccaucagcuucuccgggguguacaucagccgcgagaacuccaagaacacgcucuaccugcagaugaacggccugcgcggggaggacaccgcccucuacuacugcgccaaggaccugcgguaccuggagugcggcgaguggagcaccuacuacccccagcccugccucgacacccggggcguguccgggaucagcaacgucuggggccccgggacgcgcgugaccguguccagc

SEQ ID NO: 9325 - RNA, 432 nt, Artificial Sequence
  derived and/or modified sequence opt1 from anti-HIV_cap256-206-186347_VR-Chain
caggagcugcucguggagagcggcgggggcgucgugcccccggggaagucccugaccaucagcugcguggccucccgcuucaccuucagcgccuucggcaugcacuggguccggcaggcgcccgggaagggccugcaguggguggccuccaucagcuucgccggcacgaagaaguacuacgccgacuucgugaaggggcgcuucaccaucucccgggacaacagcaagaacaccaucuuccuccagaugaacggccugcgcggggaggacaccgcccuguaccacugcgucaaggacaugcggcagcucgagugcgaggaguggacguccgacuacuacgacuucggccgcccccagcccugcaucgaccggcgcggggugagcggcaucuccgcgauguggggcccggggaccauggugaccgucagcucc

SEQ ID NO: 9326 - RNA, 438 nt, Artificial Sequence
  derived and/or modified sequence opt1 from anti-HIV_cap256-206-186226_VR-Chain
cagaugcugcucguggagagcggcgggggcgucguggagcccgggcgcucccugacccugagcugcgccaccucccaguucacguucagcaacuacggcaugcacugggugcggcagaccccggggaccggccucgagugggucgccuccaucagcaacgagggcaacaagaaguaccacggggaggcgguguggggccgcuucaucaucucccgggacaacagcaagaagacccuguuccugcacauguccaaccuccgcgccgacgacagcgggcuguacuucugcgugcgggaccgccaggaggacgagugcgaggaguggugguccgacuacuacagcuucggccgcgggggccccugccggaaguaccacggccaggggcuggccggcaucuucgacaucugggggcggggcacgcucgucaccguguccagc

SEQ ID NO: 9327 - RNA, 435 nt, Artificial Sequence
  derived and/or modified sequence opt1 from anti-HIV_cap256-206-179686_VR-Chain
caggagcagcugguggagagcggcgggggcgucgugcccccguggaagucccucacccugagcugcgaggccucccgcuucaccuucagcgccuucgggaugcacugggugcggcaggcgcccggcaaggggcuggagugggucgccggcaucuccuucgccggcaucaagaaguacuacgccgacagcgugaaggggcgcuucuucaucucccgggacaacagcaagaaccgcgugcuccuggagaugaacggccugcggcgcgaggacacggcccgguacuucugcgucaaggaccuccgcgagcuggagugcgaggagugggcguccgacuacuacgacuucgggaagcccaaccagcccugccuggaccggcgcggcgugagcgggaucuccgccauguggggccagggcaccauggugaccgucagcucc

SEQ ID NO: 9328 - RNA, 417 nt, Artificial Sequence
  derived and/or modified sequence opt1 from anti-HIV_cap256-206-173707_VR-Chain
caggagaagcugguggagagcggcgggggcgccguccagcccgggggcucccuccgccugagcugcguggccuccggguucaccuucaagggcuucggcaugcacugggugcggcaggcgccggggaagggccuggagugggucgccaccaucagcuucuccggggugaagaaguacuacggcaacagcgccaaggggcgcuucuucaucucccgggacaaccucaagaacacgguguaccuggagaugaacggccugcgcggcgaggacaccgcccucuacuacugcgccaaggaccugcgguaccuggagugcggggaguggagcaccuacuacccccagcccugccucgacacccgcggcgucuccgggaucagcaacguguggggccccggcacgaaggugaccgucuccagc

SEQ ID NO: 9329 - RNA, 432 nt, Artificial Sequence
  derived and/or modified sequence opt1 from anti-HIV_cap256-206-173339_VR-Chain
caggagcugcucguggagagcggcgggggcgucgugcccccggggaagucccugaagcugagcugcguggccucccgguucaccuucggcgccuucgggaugcacuggguccggcaggcgcccggcaagggccucgaguggguggccgggaucagcuucgccggcaccaagaacuacuacgccgacuccgugaaggggcgcuucacgaucagccgggacaaccccaagaacacccuguuccugcagaugaacggccuccgcggggacgacaccggccuguacuacugcgucaaggacaugcgggagcuggagugcgagcucuggaccuccgacuacuacgacuucggccgcccccagccgugcaucgaccagcgcggggugagcggcaucuccgccaugugggggcagggcacgauggugaccaucagcucc

SEQ ID NO: 9330 - RNA, 438 nt, Artificial Sequence
  derived and/or modified sequence opt1 from anti-HIV_cap256-206-172689_VR-Chain
cagaugaugcugguggagagcggcgggggcgucguggagcccgggcgcucccucacccugagcugcgccaccucccacuucacguucagcaacuacggcaugcacugggugcggcaggcccccgggggccgccuggagugggucgcguccaucagcaacgccggcaacaagaaguaccacggggacuccguguggggccggcucaucaucagccgcgacaacuccaagaacacccuguuccugcacaugagcucccuccggguggacgacagcgcccuguacuucugcguccgcgaccggcaggaggacgagugcgaggaguggugguccgacuacuacgccuucgggcgcggcgggccgugccggaaguaccgcggccagggccuggccgggaucuucgacaucuggggccgggggaccauggugaccgugagcucc

SEQ ID NO: 9331 - RNA, 432 nt, Artificial Sequence
  derived and/or modified sequence opt1 from anti-HIV_cap256-206-162744_VR-Chain
caggagaagcugguggagagcggcgggggcgucgugcccccggggaagucccuccgccugagcugcguggccuccggcuucaccuucagcgccuucgggaugcacuggguccggcaggcgcccggcaagggccuggaguggguggccgggaucuccuucgccggcaucaagaacuacuacgccgacagcgugaaggggcgcuucaccaucucccgggacaacagcaagaacucccucuuccugcagaugaacggccugcgcggggacgacacggcccgguacuacugcgucaaggacaugcgcgagcucgagugcgaggaguggaccagcgacuacuacgacuucggcaagccccagcccugcaucgaccggcgcggcguguccgggaucagcgcgauguggggccaggggaccauggugaccaucuccagc

SEQ ID NO: 9332 - RNA, 438 nt, Artificial Sequence
  derived and/or modified sequence opt1 from anti-HIV_cap256-206-146057_VR-Chain
cagaugcagcugguggagagcggcgggggcgucgugcagcccgggaccucccucacccugagcugcguggccucccaguucacguucagcaacuacggcaugcacuggauccgccaggccccggggcagggccuggagugggucgcguccaucagcaacgacggcgggaagcgguaccacggcgacgccgugugggcccgcuucaucaucucccgggacaacagcaagaacaccguguuccuccagaugaccucccugcgcgccgaggacaccgcccgguacuucugcguccgcgaccggcaggaggacgagugccuggagugguggagcgacuacuacaacuucgggcgccagcuccccugcgcgaaguuccggggccuggggcuggccggcguguucgacaucuggggccacgggacgauggugaccgucuccagc

SEQ ID NO: 9333 - RNA, 435 nt, Artificial Sequence
  derived and/or modified sequence opt1 from anti-HIV_cap256-206-139519_VR-Chain
caggagcagcugguggagagcggcgggggcgucgugcccccggggaccucccuccggcugagcugcguggccucccgguucagcuucggcuccuucgggaugcacuggguccgccaggcccccggcaagggccuggaguggguggcggggaucagcuucgugggcaucaagaaguacuacggggacuccgucaagggccgguucuucaucagccgcgacaacuccaagaacacccucuuccuggagaugaacgggcugcggggcgaggacacggcccgcuacuacugcgugaaggacaugcgggagcucgagugcgaggagugggccagcgacuacuacgacuucggcaagcccaaccagcccugccuggaccgccgcgggguguccggcaucagcgccaugugggggccgggcaccaugcugaccgucuccagc

SEQ ID NO: 9334 - RNA, 432 nt, Artificial Sequence
  derived and/or modified sequence opt1 from anti-HIV_cap256-206-136316_VR-Chain
caggagcagcugguggagagcggcgggggcgucgugcccccggggaagucccucacccugagcugcguggccuccggcuucaccuucagcgccuucgggaugcacuggguccggcaggcgcccggcaagggccuggaguggguggccgggaucuccuucgugggcaucaagaaguacuacggggacagcgucaagggccgguucacgaucucccgcgacaacagcaagaacacccucuuccugcagaugaacgggcugcggggcgacgacaccgcccucuaccacugcgugaaggacaugcgccagcuggagugcgaggaguggaccuccgacuacuacgacuucggcaagccccagcccugcaucgacccgcgcggggugagcggcaucuccgccaugugggggcagggcacgauggucaccgugagcucc

SEQ ID NO: 9335 - RNA, 438 nt, Artificial Sequence
  derived and/or modified sequence opt1 from anti-HIV_cap256-206-116098_VR-Chain
cagaugaugcugguggagagcggcgggggcgucguggagcccgggcgcucccucacccugagcugcgccgccucccaguucaccuucagcaacuacggcaugcacugggugcggcaggcgccggggcgcgagcuggagugggucgccuccaucagcaacgccggcaacaagaaguaccacggcgaggccgugugggggcggcucaucaucucccgcgacaacagcaagaacacgcuguuccugcacauguccaaccuccggcccgacgacagcgcccuguacuucugcgugcgcgaccggcaggaggacgagugcgaggaguggugguccgacuacuacgcguucggccgcgggggccccugccggaaguaccacgggcagggccuggccggcaucuucgacaucugggggcgcggcaccauggucaccgugagcucc

SEQ ID NO: 9336 - RNA, 432 nt, Artificial Sequence
  derived and/or modified sequence opt1 from anti-HIV_cap256-206-115862_VR-Chain
caggagcagcugguggagagcggcgggggcgucgugcccccggggaagucccuccgccugagcugcgugggcucccgguucaccuucagcgccuucgggaugcacuggguccgccaggcccccggcaagggccuggaguggguggcguccaucagcuucgccgggaccaagaaguacuacguggacuccgucaagggccgguucuucaucagccgcgacaacuccaagaacacgguguuccucgagaugaacgggcugcggggcgaggacaccgggcuguacuacugcgugaaggacaugcgcgagcucgagugcgaggagugggccagcgacuacuacgacuucggcaagccccagcccugccuggaccggcgcggcgucuccgggaucagcgccauguggggccaggggacccuggugaucaucuccagc

SEQ ID NO: 9337 - RNA, 435 nt, Artificial Sequence
  derived and/or modified sequence opt1 from anti-HIV_cap256-206-107018_VR-Chain
caggagcagcugguggagagcggcgggggcgucgugcccccggggaagucccucacccugagcugcguggccucccgcuucagcuucuccgccuucggcaugcacuggguccggcaggcgcccgggaagggccuggaguggguggccagcaucuccuucgugggcaucaagaaguacuacggggacagcgucaagggccgcuucuucaucucccgggacaacagcaagaacaccguguuccucgagaugaacgggcugcgcggcgaggacacggggcuguacuacugcgugaaggacaugcgggagcucgagugcgaggagugggccuccgacuacuacgacuucggcaagcccaaccagcccugccuggaccgccggggcgucagcgggaucuccgccauguggggccaggggacccuggugaucgugagcucc

SEQ ID NO: 9338 - RNA, 438 nt, Artificial Sequence
  derived and/or modified sequence opt1 from anti-HIV_cap256-206-098644_VR-Chain
cagaugcugcucguggagagcggcgggggcgucguggagcccgggcgcucccugacccugagcugcgccgccucccaguucaccuucagcaacuacggcaugcacugggugcggcaggcgcccgggggcggccucgagugggucgccuccaucagcaacgaggggaacaagcgcuaccacggcgaguccgugugggggcgguucgugaucagccgcgacaacuccaagaacacgcuguuccugcacaugagcacccuccggccggacgacuccgcccuguacuucugcguccgcgaccggcaggaggacgagugcgaggagugguggagcgacuacuacgccuucggccgcgggggccccugccggaaguaccacggccaggggcuggccggcaucuucgacgugugggggcgcggcaccauggugaccggccucuuc

SEQ ID NO: 9339 - RNA, 417 nt, Artificial Sequence
  derived and/or modified sequence opt1 from anti-HIV_cap256-206-098135_VR-Chain
caggagaagcugguggagagcggcgggggcgccguccagcccgggggcucccuccggcugagcugcguggccuccggguucaccuucagcggcuucggcaugcacugggugcggcaggcgccggggaagggccuggagugggucgccaccaucuccuucagcgggaugaagaaguacuacggcacguccgccaaggggcgcuucagcaucuaccgggacaacuccaagaacacccucuaccugcagauggacggccugcgcgagaaggacaccgcccucuacuacugcgccaaggaccugcgguaccuggagugcggcgaguggagcaccuacuacccccagcccugccucgaccgccgcgggguguccggcaucagcaacgugugggggcccggcacgauggucaccguguccagc

SEQ ID NO: 9340 - RNA, 435 nt, Artificial Sequence
  derived and/or modified sequence opt1 from anti-HIV_cap256-206-096276_VR-Chain
caggagcagcugguggagagcggcgggggcgucgugcccccgggguccagccuccgccuguccugcguggccagccgguucaccuucuccgccuucggcaugcacuggguccgccaggcgcccgggaagggccuggaguggguggccggcaucagcuucguggggaucaagaaguacuacgccgacuccgucaagggccgguucaccaucagccgcgacaacuccaagaacacccucuuccugcagaugaacgggcugcggggcgaggacacggggcucuacuacugcgugaaggacaugcgcgagcuggagugcgaggaguggcggagcgacuacuacgacuucggcaagcccaaccagcccuaccuggaccgccggggcguguccgggaucagcgccuucuggggccaggggaccauggucaccguguccagc

SEQ ID NO: 9341 - RNA, 438 nt, Artificial Sequence
  derived and/or modified sequence opt1 from anti-HIV_cap256-206-092794_VR-Chain
cagaugaugcugguggagagcggcgggggcgucguggagcccgggcgcucccucacccugagcugcgccaccucccaguucacguucagcaacuacggcaugcacugggugcggcaggccccggggcgcggccuggagugggucgcguccaucagcaacgagggcaacaagcgguaccacggggaguccguguggggccgcuucaucaucagccgggacaacuccaagaacacccucuuccugcacaugagcacccugcgcgccgacgacuccgcccucuacuucugcgugcgggaccgccaggaggacgagugcgaggagugguggagcgacuacuacgccuucgggcggggcgggcccugccgcaaguaccacggccagggccuggccgggaucuucgacaucgucggccgggggacccuggugacgguguccagc

SEQ ID NO: 9342 - RNA, 432 nt, Artificial Sequence
  derived and/or modified sequence opt1 from anti-HIV_cap256-206-086817_VR-Chain
caggagcagcugguggagagcggcgggggcgucgugcccccggggaagucccuccgccugagcugcgccgccuccggcuucagcuucggggcguucggcaugcacugggugcggcaggcccccggcaaggggcuggagugggucgccggcaucuccuucguggggaucaaguacuacuacgccgacagcgugaagggccgcuucaccaucucccgggacaacagcaagaacaccgucuuccuccagaugaacgggcugcgcggcgacgacacgggccgguacuacugcgugaaggacaugcgcgagcuggagugcgaggaguggaccuccgacuacuacgacuucgggaagccccagcccugcaucgaccggcgcggcgugagcgggaucuccgccauguggggccagggcaccauggucaccaucagcucc

SEQ ID NO: 9343 - RNA, 432 nt, Artificial Sequence
  derived and/or modified sequence opt1 from anti-HIV_cap256-206-086446_VR-Chain
caggagcagcugguggagagcggcgggggcgucgugcccccggggaagucccuccgccugagcugcguggccucccgguucaccuucagcgccuucggcaugcacuggguccgccaggcgcccgggaagggccuggaguggguggccggcaucuccuucguggggaucaagaaguacuacagcgacgccgucaagggccgguucuacaucucccgcgacaacagcaagaacacccucuuccuggagaugaacgggcugcggggcgacgacacggcccgcuacuacugcgugaaggaccuccgggagcuggagugcgaggagugggccuccgacuacuacgacuucgggaagccccagcccugccuggacagccgcggcguguccggcaucagcgcgaugugggggcagggcaccauggucaccguguccagc

SEQ ID NO: 9344 - RNA, 432 nt, Artificial Sequence
  derived and/or modified sequence opt1 from anti-HIV_cap256-206-086180_VR-Chain
caggagcagcuggaggagagcggcgggggcguggugcccccggggaagucccuccgccugagcugcgucgccucccgguucaccuucagcgccuucggcaugcacugggugcgccaggcgcccgggaagggccuggagugggucgccggcaucuccuucguggggaucaagaaguacuacgccgacagcgugaagggccgguucaccaucucccgcgacaacagcaagaacacccucuuccugcagaugaacgggcugcggggcgacgacacggggcucuacuucugcgucaaggacaugcgcgagcuggagugcgagcaguggaccuccgacuacuacgacuucggcaagccccagcccugcaucgacccgcggggcgugagcgggaucuccgccauguggggccaggggaccauggugacggucagcucc

SEQ ID NO: 9345 - RNA, 435 nt, Artificial Sequence
  derived and/or modified sequence opt1 from anti-HIV_cap256-206-083708_VR-Chain
caggagcagcugguggagagcggcgggggcgucaucccgcccgggcagucccuccgccugagcugcguggccucccgguucaccuucagcgccuucggcaugcacugggugcgccaggcgcccgggaagggccuggagugggucuccagcguguccuucgccggcaucaagaaguacuacgccgacagcgugaaggggcgguucuucaucucccgcgacaacagcaagaacaccgucuuccucgagaugaacggccugcgcggggaggacacgggccuguacuacugcgugaaggacaugcgggagcucgagugcgaggagugggccuccgacuacuacgacuucgggaagcccgaccagcccugccuggaccggcgcggcgugagcggcaucuccgccaugugggggcagggcacccuggucaucgugagcucc

SEQ ID NO: 9346 - RNA, 432 nt, Artificial Sequence
  derived and/or modified sequence opt1 from anti-HIV_cap256-206-079556_VR-Chain
caggagcagcugguggagagcggcgggggcgucgugcccccggggaagucccuccggcugagcugcguggccuccggcuucaccuucagcggguucggcaugcacuggguccggcaggcccccggcaaggggcuggaguggguggcgggcaucuccuucguggggaucaaguacuacuacgccgacagcgucaagggccgcuucuccaucagccgggacaacuccaagaacacccucuuccugcagaugaacgggcugcgcggcgacgacacggcccucuacuacugcgugaaggacaugcgggagcuggagugcgaggaguggaccagcgacuacuacgacuucggcaagccccagcccugcaucgaccgccgcgggguguccggcaucagcgccaugugggggcagggcaccauggucaccguguccagc

SEQ ID NO: 9347 - RNA, 438 nt, Artificial Sequence
  derived and/or modified sequence opt1 from anti-HIV_cap256-206-078657_VR-Chain
cagaugcugcucguggagagcggcgggggcgucguggagcccgggcgcucccugacccugagcugcgccaccucccaguucacguucagcaacuacggcaugcacugggugcggcaggccccggggcgcggccucgagugggucgcguccaucagcaacgagggcuccaagaaguaccacggggagcccguguggggccgguucaucaucagccgcgacaacuccaagaagacccuguuccugcacaugagcaaccuccggguggacgacuccgcccuguacuucugcguccgcgaccggcaggaggacgagugcgaggagugguggagcgacuacuacgccuucgggcgcggcgggcccugccggaaguaccacggccagggccuggccgggaucuucgacaucuggggccgcgggaccauggugaccguguccagc

SEQ ID NO: 9348 - RNA, 438 nt, Artificial Sequence
  derived and/or modified sequence opt1 from anti-HIV_cap256-206-075802_VR-Chain
cagaugcugcucguggagagcggcggggacgucguggagcccggcaagucccugacccugagcugcgccaccucccgcuucacguucagcaacuacgggaugcacugggugcggcaggccccgggcgggggccucgagugggucgcguccaucagcaacgagggcaacaagaaguaccacggggaguccguguggggccgcuucaucaucagccgggacaacuccaagaacacccuguuccugcacaugagcgcccuccgcaccgacgacuccgcccuguacuucugcgugcgggaccgccaggaggacgagugcgaggagugguggagcgacuacuacgccuucgggcggggcgggcccugccgcaaguaccacggccagggccuggccgggaucuucgacaucuggggccgggggaccauggucacgguguccagc

SEQ ID NO: 9349 - RNA, 438 nt, Artificial Sequence
  derived and/or modified sequence opt1 from anti-HIV_cap256-206-069097_VR-Chain
cagaugcugcucguggagagcggcgggggcgucguggagcccgggcgcucccugacccugagcugcgccaccucccgguucacguucagcaacuacggcaugcacugggugcgccaggccccggggcgggagcucgagugggucgcguccaucagcaacgagggcaacaagaaguaccacgccgaguccguguggggccgcuucaucaucagccgggacaacuccaagaacacccuguuccugcacaugagcaacgugcgcggggacgacuccgcccucuacuucugcguccgggaccgccaggaggacgagugcgaggagugguggagcgacuacuacgccuucggccgcgggggccccugccggaaguaccacgggcagggccuggccggcaucuucgacgugugggggcggggcaccguggucaccguguccagc

SEQ ID NO: 9350 - RNA, 438 nt, Artificial Sequence
  derived and/or modified sequence opt1 from anti-HIV_cap256-206-067758_VR-Chain
cagaugcugcucguggagagcggcgggggcgucguggagcccgggcgcucccugacccugagcugcgccgccucccaguucaccuucagccacuacggcaugcacugggugcggcaggcgccggggcgcggccucgagugggucgccuccaucagcaacgagggcaacaagcgguaccacggggaguccguguggggccgcuucaucaucagccgggacaacuccaagaacacgcuguuccugcacaugagcgcccuccgcaccgacgacuccgcccuguacuucugcgugcgggaccgccaggaggacgagugcgaggagugguggagcgacuacuacgccuucgggcggggcgggcccugccgcaaguggcacggccagggccuggcggggaucuucgacaucuggggccgggggaccgucgugaccguguccagc

SEQ ID NO: 9351 - RNA, 417 nt, Artificial Sequence
  derived and/or modified sequence opt1 from anti-HIV_cap256-206-057019_VR-Chain
caggagaagcugguggagagcggcgggggcgccguccagcccgggggcucccuccgccugagcugcguggccuccggguucagcuucuccggcuacggcaugcacugggugcggcaggcgccggggaagggccuggaguggcucgccaccaucagcuucuccggggucaagaaguacuacggcaccagcgccaaggggcgcuucuacaucuaccgggacaacacgaagaacaccauguaccuggagaugaacggccugcgcggcgaggacaccgcccucuacuacugcgccaaggaccugcgguaccuggagugcggggagugguccaccuacuacccccagcccugccucgacacgcgcggcgugagcgggaucuccaacguguggggccccggcaccauggucaccgugagcucc

SEQ ID NO: 9352 - RNA, 438 nt, Artificial Sequence
  derived and/or modified sequence opt1 from anti-HIV_cap256-206-055385_VR-Chain
cagaugaugcugguggagagcggcgggggcgucguggagcccgggcgcucccucacccugagcugcgccgccuccaaguucaccuucagcaacuacggcaugcacugggugcggcaggcgccggggcgcggccuggagugggucgccuccaucagcaacgagggcaacaagaaguaccacggggagcccguguggggccggcucaucaucucccgcgacaacagcaagaacacgcuguuccugcacauguccgaccuccgggccgacgacagcgcccuguacuucugcgugcgcgaccggcaggaggacgagugcgaggaguggugguccaacuacuacgccuucgggcgcggcgggcccugccggaaguggcgcggccagggccuggcggggaucuucgacgucuggggccgggggaccauggugaccgugagcucc

SEQ ID NO: 9353 - RNA, 435 nt, Artificial Sequence
  derived and/or modified sequence opt1 from anti-HIV_cap256-206-053187_VR-Chain
caggagcagcugguggagagcggcgggggcgucgugcccccgggguccagccuccgccuguccugcguggccagccgguucaccuucuccgccuucggcaugcacuggguccgccaggcgcccgggaagggccuggaguggguggccggcaucagcuucguggggaucaaguacuacuacgccgacuccgucaagggccgguucaccaucagccgcgacaacuccaagaacacccucuuccugcagaugaacgggcugcggggcgaggacacggggcucuacuacugcgugaaggacaugcgcgagcuggagugcgaggagugggccagcgacuacuacgacuucggcaagcccaaccagcccugccuggaccggcgcggcguguccgggaucagcgccuucuggggccaggggaccauggucaccguguccagc

SEQ ID NO: 9354 - RNA, 438 nt, Artificial Sequence
  derived and/or modified sequence opt1 from anti-HIV_cap256-206-053139_VR-Chain
cagaugcugcucguggagagcggcggggacgucguggagcccggccgcucccugacccugagcugcgccaccucccaguucacguucagcaacuacgggaugcacugggugcggcaggccccgggccgcgggcucgagugggucgcguccaucagcaacgagggcuccaagaaguaccacggcgagagcgugugggggcgguucaucaucucccgcgacaacagcaagaacacccuguuccugcacaugaccacccuccggcccgacgacuccgcccuguacuucugcgugcgcgaccggcaggaggacgagugcgaggagugguggagcgacuacuacgccuucggccgcgggggccccugccggaaguaccacgggcagggccuggccggcaucuucgacaucugggggcgcggcacgauggucaccguguccagc

SEQ ID NO: 9355 - RNA, 432 nt, Artificial Sequence
  derived and/or modified sequence opt1 from anti-HIV_cap256-206-050350_VR-Chain
caggagcagcugguggagagcggcgggggcgucgugcccccggggaagucccucaagcugagcugcguggccucccgcuucagcuucggcgccuucgggaugcacuggguccggcaggcgcccggcaagggccuggaguggguggccgggaucuccuucgugggcaucaagaaguacuacgccgacagcgucaaggggcgcuucuacaucucccgggacaacagcaagaacaccguguuccucgagaugaacgcccugcgcggcgaggacaccgcccuguaccacugcgugaaggacaugcgggagcucgagugcgaggagugggcguccgacuacuacgacuucgggaagccccagcccugccuggaccgccggggcgucagcggcaucuccgccaugugggggccgggcacgauggugaucgugagcucc

SEQ ID NO: 9356 - RNA, 432 nt, Artificial Sequence
  derived and/or modified sequence opt1 from anti-HIV_cap256-206-046207_VR-Chain
caggagcagcugguggagagcggcgggggcgucgugcccccggggaccucccuccgccugagcugcguggccucccgguucaccuucagcgccuucggcaugcacuggguccgccaggcgcccgggaagggccuggaguggguggccggcaucuccuucgccgggaucaagaaguacuacgccgacagcgugaagggccgguucacgaucucccgcgacaacagcaagaacucccucuuccuggagaugaacgggcugcggggcgacgacaccgcccucuacuacugcgucaaggaccugcgcuaccuggagugcgagcucuggaccagcgacuacuacgacuucgggcggccccagcccugcaucgacucccgcggcgugagcggcaucuccgcgaugugggggccgggcaccauggugacggucagcgcc

SEQ ID NO: 9357 - RNA, 417 nt, Artificial Sequence
  derived and/or modified sequence opt1 from anti-HIV_cap256-206-043389_VR-Chain
caggagaagcugguggagagcggcgggggcgccguccagcccgggggcucccuccgccugagcugcguggccuccggguucaccuucagcggcuucggcaugcacugguuccggcaggcgccggggaagggccuggaguggguggccaccaucuccuucagcgggaucaagaaguacuacaacacguccgccaagggccgcuucuucaucagccgggacaacaccaaggacacccucuaccugcagauggacgggcugcaggagaaggacaccgcccucuaccugugcgccaaggaccugcgcuaccucgagugcggcuacugguccacguacuacccccagcccugccuggacacccggggcgucagcgggaucuccaacguguggggccccgggaccauggugaccgucagcucc

SEQ ID NO: 9358 - RNA, 432 nt, Artificial Sequence
  derived and/or modified sequence opt1 from anti-HIV_cap256-206-042555_VR-Chain
caggagcagcugguggagagcggcgggggcgucgugcccccggggaagucccuccgccugagcugcguggucuccggcuucaccuucagcgccuucgggaugcacugggugcggcaggcccccggcaagggccuggaguggguggcggggaucuccuucgccggcaccaagagcuacuacgccgaguccgucaaggggcgcuucacgaucagccgggacaacuccaagaacagccucuuccugcagaugaacggccugcgcggggacgacaccgcccucuacuacugcgugaaggacaugcgggagcuggagugcgagcuguggaccuccgacuacuacgacuucggccgcccccagcccugcaucgaccggcgcggcgugagcgggaucuccgccauguggggccaggggaccauggucacgaucagcucc

SEQ ID NO: 9359 - RNA, 432 nt, Artificial Sequence
  derived and/or modified sequence opt1 from anti-HIV_cap256-206-029720_VR-Chain
caggagaagcugguggagagcggcgggggcgucgugcagcccgggcgcucccucacccugagcugcguggccucccacuucaccuucagcggcgucgggaugcacugggugcggcaggccccgggcaagggccuggaguggguggcggggaucuccuucgccggcacgcgcaaguacuacgccgacagcgucaaggggcgguucaccaucucccgcgacaacagcaagaacaccguguaccuccagaugaacggccugcgcggggaggacaccgcccuguaccacugcgccaaggaccuccgggagcuggagugcgagcuguggacguccgacuacuacgacuucggccggccccagcccugcaucgaccgccggggcgugagcgggaucugcgacauguggggccaggggaccauggucaucguguccagc

SEQ ID NO: 9360 - RNA, 432 nt, Artificial Sequence
  derived and/or modified sequence opt1 from anti-HIV_cap256-206-028848_VR-Chain
caggagcagcugguggagagcggcgggggcgucgugcccccggggaagucccuccggcugagcugcguggccuccggcuucaccuucagcggguucggcaugcacuggguccggcaggcccccggcaaggggcugcaguggguggcgggcaucuccuucgccgggaccaaguacuacuacgaggacagcgugaagggccgcuucacgaucucccgggacaacagcaagaacaccgucuuccuccagaugaacgggcugcgcggcgacgacaccgcccuguacuacugcgugaaggacaugcgggagcucgagugcgaggaguggaccuccgacuacuacgacuucggcaagccccagcccugcaucgaccgccgcggggugagcggcaucuccgccaugugggggcagggcacgauggucaccaucagcucc

SEQ ID NO: 9361 - RNA, 432 nt, Artificial Sequence
  derived and/or modified sequence opt1 from anti-HIV_cap256-206-027652_VR-Chain
caggagcagcugguggucagcggcggggacguggugcccccgggcaagucccuccggcugagcugcgucgccuccggguucaccuucagcgccuucggcaugcacugggugcggcaggcgcccgggaagggccuggaguggguggccuccaucagcuucgccggcaccaaguacuacuacgccgacuccgucaaggggcgcuucgccaucagccgggacaacuccaagaacacccucuuccugcagaugaacggccugcgccgggaggacacggggcucuacuacugcgugaaggacaugcgccagcuggagugcgaggaguggaccagcgacuacuacgacuucggccggccccagcccugcaucgaccgccgcgggguguccggcaucagcgcgauguggggccaggggaccauggucacgaucuccagc

SEQ ID NO: 9362 - RNA, 417 nt, Artificial Sequence
  derived and/or modified sequence opt1 from anti-HIV_cap256-206-024075_VR-Chain
caggagaagcugguggagagcggcgggggcgccguccagcccgggggcucccuccgccugagcugcguggccuccggguucaccuucagcggcuucggcaugcacugggugcggcaggcgccggggaagggccuggaguggcucgccaccaucuccuucagcggggucaagaaguacuacggcacguccgccaaggggcgcuucuacaucagccgggacaacaccaagaacaccguguaccugcagauggacggccugcgcggcgacgacaccgccaucuacuacugcgccaaggaccuccgguuccuggagugcgggcugugguccacguacuacccccagcccugccucgacacccgcggcgugagcgggaucuccaacgucuggggccccggcaccauggugaccgugagcucc

SEQ ID NO: 9363 - RNA, 417 nt, Artificial Sequence
  derived and/or modified sequence opt1 from anti-HIV_cap256-206-008748_VR-Chain
caggagaagcugguggagagcggcgggggcgccguccagcccgggggcucccuccgccugagcugcguggccuccggguucaccuucaacggcuucggcaugcacugggugcggcaggcgccggggaagggccuggagugggucgccaccaucagcuucuccggggugaagaaguacuacggcacgagcgccaaggggcgcuucuucaucucccgggagaacagcaagaacacccucuaccugcagaugaacggccugcgcggcgaggacaccgcccucuacuacugcgccaaggaccugcgguaccuggagugcggggagugguccaccuacuacccccagcccugccucgacacgcgcggcgugagcgggaucuccaacgucuggggccccggcacccgggugaccgugagcucc

SEQ ID NO: 9364 - RNA, 432 nt, Artificial Sequence
  derived and/or modified sequence opt1 from anti-HIV_cap256-206-008530_VR-Chain
caggagcagcugguggagagcggcgggggcgucgugcccccggggaagucccuccggcugagcugcguggccuccggcuucagcuucggggccuucggcaugcacuggguccggcaggcgcccggcaaggggcuggaguggguggccggcaucuccuucguggggaucaaguacuacuacgccgacagcgucaagggccgcuucaccaucucccgggacaacagcaagaagacccucuuccugcagaugaacgggcugcgcggcgacgacacggcccucuacuacugcgugaaggacaugcgggagcuggagugcgaggaguggaccuccgacuacuacgacuucggcaagccccagcccugcaucgaccgccgcggggugagcggcaucuccgccuucugggggcagggcaccauggucaccaucagcucc

SEQ ID NO: 9365 - RNA, 432 nt, Artificial Sequence
  derived and/or modified sequence opt1 from anti-HIV_cap256-176-723043_VR-Chain
caggagcagcugguggagagcggcgggggcgucgugcccccggggaagucccuccgccugagcugcguggccuccggcuucaccuucagcgccuucgggaugcacuggguccggcaggcgcccggcaagggccuggaguggguggccgggguguccuucgccggcaucaaguacuacuacgccgacagcgucaaggggcgcuucaccaucucccgggacaacagcaagaacacccucuuccugcagaugaacggccugcgcggggacgacacggcccucuacuacugcgugaaggaccugcgggagcuggagugcgaggaguggaccuccgacuacuacgacuucggccgcccccagcccugcaucgacccgcggggcgugagcgggaucuccgcgauguggggccaggggaccgucgugacgaucagcucc

SEQ ID NO: 9366 - RNA, 432 nt, Artificial Sequence
  derived and/or modified sequence opt1 from anti-HIV_cap256-176-600049_VR-Chain
gaggugcagcugguccagagcggcgggggcguggugcagcccgggcgcucccuccggcugagcugcgccgccccguacuucgaguucggccgcuacggguuccacuggguccggcaggcgcccggcaagggccuggaguggguggccuccaucagcuucgccgggcgcggcuacuaccacucccccagcgugugggggcgguucaccaucucccgcgacaacagcaagaacacccucuaccugcagaugaacucccugcggaucgaggacacggcccucuacuucugcgcccgcgaccugcgggagagcgagugcgaggagugggaguccgacuacuacgacuucggcaagaaggggcccugcgucaagccgcgcggcguggcgggcgggcuggaccucuggggccaggggaccauggugaucgucagcucc

SEQ ID NO: 9367 - RNA, 432 nt, Artificial Sequence
  derived and/or modified sequence opt1 from anti-HIV_cap256-176-531926_VR-Chain
caggugcagcuggucgagagcggcgggggcguggugcccccggggaagucccucacccugagcugcgucgccucccgcuucaccuucagcgccuucggcaugcacugggugcggcaggcgcccgggaagggccuggaguggguggccggcaucuccuucgucgggauccgcaaguacuacgccgacagcgugaagggccgguucuccaucagccgcgacaacuccaagaacacgguguuccucgagaugaacgggcugcggggcgaggacaccgggcuguacuacugcgucaaggacaugcgcgagcucgagugcgaggagugggccagcgacuacuacgacuucggcaagccccagcccugccuggaccggcgcggcguguccgggaucagcgccauguggggccaggggacccuggugaucaucuccagc

SEQ ID NO: 9368 - RNA, 432 nt, Artificial Sequence
  derived and/or modified sequence opt1 from anti-HIV_cap256-176-504134_VR-Chain
gaggugcagcuggucgagagcggcgggggcguggugcccccggggaagucccuccgccugagcugcgucaccucccggcuggccuucggcgccuucgggaugcacugggugcgccaggcgcccggcaagggccucgaguggguggccagcaucuccuucgccgggaucaagaaguacuacgccgacagcgucaagggccgguucaccaucucccgcgacaacagcaaggacacgguguuccuggagaugaacgggcugcggggcgacgacaccgggcucuacuacugcgugaaggacaugcgcuaccuggagugcgaggagugggccuccgacuacuacgacuucggccggccccagcccugccuggacccgcgcggcgucagcgggaucuccgcgauguggggccaggggacccucgugaucaucagcucc

SEQ ID NO: 9369 - RNA, 432 nt, Artificial Sequence
  derived and/or modified sequence opt1 from anti-HIV_cap256-119-186229_VR-Chain
cagaugcagcugguggagagcggcgggggcgucgugcagcccgggggcucccuccgccugcugugcagcgccuccggguucaccuucagcaccuacggcaugcacugggugcggcaggccccgggcaaggggcucgagugggucgcguccaucagcuacgacggcuccgacaaguaccacgccgggcugguguggggccgcuucaucaucagccgggacaacuccaagaacacgcuguaccuccagaugaacagccugcgcgccgaggacaccgcccuguacuacugcgugcgggacgagcgcgaguccgagugcgagcucugggagagcgacuacuacaacuucgggaagaagcugcccugcgucaagccccggggcguggccggcacccuggacaucugggggcagggcaccacggugaucgucuccagc

SEQ ID NO: 9370 - RNA, 432 nt, Artificial Sequence
  derived and/or modified sequence opt1 from anti-HIV_cap256-119-183891_VR-Chain
caggugcagcuggucgagagcggcgggggcguggugcagcccgggggcucccuccgccugagcugcgccgccuccggguucaccuucagcuccuacggcaugcacuggguccggcaggcgccgggcaaggggcuggaguggguggccuucacccgcuacgacggcagcgacaaguacuaccucgacuccgugaaggggcgguucacgaucagccgcgacaacuccaaguacacccuguuccugcagauggucagccuccggaccgaggacaccgcccuguacuucugcgcccgcgaccugcgggaguccgagugcgaggagugggagagcuacuacuacgacuucggcaagaaggggcccugcgugaagccccgcggcguggucggcgugcucgacaucugggggcagggcacgcuggugaccgucuccagc

SEQ ID NO: 9371 - RNA, 435 nt, Artificial Sequence
  derived and/or modified sequence opt1 from anti-HIV_cap256-119-183631_VR-Chain
caggugcagcugguccagagcggcgggggcguggugcagcccgggcgcucccuccggcugagcugcgccgccuccaaguucaccuucagcaccuacacgcugcacuggguccgccaggcgccgggcaaggggcucgaguggguggccgugaucucccacgacggcggcaaccgguucuacgccgacagcgucaaggggcgcuucaccaucucccgggacaacagcaagaacaaccuguuccugcagaugaacucccuccgcguggaggacaccgcccuguacuacugcgcccgggaccugcgcgagauggagugcgaggaguggacccucuacaacuacuacgacuucggcagccgggggcccugcguggacccccgcggcgucgugggguccuucgacguguggggccagggcacgauggucaccgugagcucc

SEQ ID NO: 9372 - RNA, 432 nt, Artificial Sequence
  derived and/or modified sequence opt1 from anti-HIV_cap256-119-182676_VR-Chain
caggugcagcuggucgagagcggcgggggcguggugcagcccgggaagucccuccgccugagcugcgucguguccggcuucaccuucagcaacuacccgaugcacugggugcggcaggcccccgggaagggccuggagugggucgccuccaucagcuucgcgggcaucaagaaguacuacggggacuccgugaagggccgcuucaccaucagccgggacaacuccaagaacacgcucuaccugcagauggacgggcugcgcggcgaggacaccgcccucuacuacugcgccaaggaccugcgggagcuggagugcgaggagugggccagcgacuacuacgacuucgggcgcccccagcccugccucgacccgcggggcguguccggcaucagcaacgucugggggcagggcaccauggugaccguguccagc

SEQ ID NO: 9373 - RNA, 432 nt, Artificial Sequence
  derived and/or modified sequence opt1 from anti-HIV_cap256-119-180772_VR-Chain
caggugcagcuggucgagagcggcgggggcguggugcagcccgggcgcucccuccggcugagcugcgccgccuccgaguucaccuucagcaacuacgcgaugcacuggguccgccaggccccgggcaaggggcuggaguggguggccuccaucagcuucgacggccgggacaaguaccacuccagccucguguggggccgccugaccaucucccgggacaacagcaaguccacgcuguuccuccagaugaacagccugcgccccgaggacaccgcccuguacuacugcgcccgggacguccgcgaguccgagugcgaggaguggcagagcgacuacuacgcguucuaccggaagcuccccugcgugaagccccgcgggguggccggcacccuggacaucugggggcagggcaccauggucacgguguccagc

SEQ ID NO: 9374 - RNA, 435 nt, Artificial Sequence
  derived and/or modified sequence opt1 from anti-HIV_cap256-119-180508_VR-Chain
caggugcaccuggucgagagcggcgggggcguggugcagcccgggcgcucccuccggcugagcugcgccgccucccacuucagccuguccagcuacggcaugcacuggguccgccagaccccggggaagggccucgaguggguggcgggcaucuccuucgccggggugaagaccuacuacggcacgagcgucaaggggcgguucaccaucucccgcgacaacagcaagaacaaccuguaccugcagaugaacucccuccggcccgaggacaccgcccuguacuacugcgcccgcgaccugcgggagauggagugcgaggaguggaagcucuacaacuacuacgacuuccgcacccggggccccugcguggacccccgcgggguggucggcagcuucgacguguggggccaggggacgguggucaccguguccagc

SEQ ID NO: 9375 - RNA, 432 nt, Artificial Sequence
  derived and/or modified sequence opt1 from anti-HIV_cap256-119-180260_VR-Chain
gaggugcagcuggucgagagcggcgggggcguggugcgccccgggggcucccuccggcugagcugcgccgccucccaguucaccuucagcaacuucgggaugcacuggguccgccaggcgccgggcaagggccuggaguggguggccuccaucagcuucguggggaucaagacccacuacgccaacuccguccggggccgcuucacgaucagccgggaccaguccaagaacacccucuaccugcagaugaacagcgugcgcguggaggacaccgggcgguacuacugcgcccgcgacaugcgggaguacgagugcgagcugugggccuccgacuacuacgacuucggcaagccccagcccugcgaggacccccgcggggucgugggcaccuucgacauguggggccucgggacgcuggugaccgucagcucc

SEQ ID NO: 9376 - RNA, 432 nt, Artificial Sequence
  derived and/or modified sequence opt1 from anti-HIV_cap256-119-180173_VR-Chain
gaggugcagcuggucgagagcggcgggggccucgugcagcccgggggcucccugcgccugagcugcgccgccuccggguucaccgugagcuccaacuacaugagcuggguccggcaggcgccgggcaagggccucgaguggguggccuccaucagcuucgccgggaccaagaagcacuacggcaacuccgugaaggggcgcuucacgaucagccgggacaacuccaagaacacccuguaccugcagaugaacagccuccgcggcgaggacaccgcccuguacuacugcgccaaggaccugcgggaguacgagugcgaggaguggaccuccgacuacuacgacuucgggcgcccccagcccugcaucgacagccggggcgucgugggcauccucgacaucuggucccaggggacgauggugaccgucagcucc

SEQ ID NO: 9377 - RNA, 432 nt, Artificial Sequence
  derived and/or modified sequence opt1 from anti-HIV_cap256-119-179839_VR-Chain
caggugcagcuggucgagagcggcgggggcguggugcagcccgggcgcucccuccggcugagcugcgccgccuccggcuucagcuucgggaccuccgacguccacugggugcgccaggcgccgggcgagggccuggaguggguggcccucaucagcuucgacgggcggcagaaggaccuggccgacuccguccgcggccgguucaccaucagccgcgacuccagcaagaacacgcuguaccucgagaugaacucccugcggcccgaggacaccgcccuguacuacugcgccaaggacaugcgcggguacgagugcgaggaguggaccagcgacuacuacgacuucggccggccccagcccugcaucgacucccgcgggguggugggcaccuucgacgucuggggccaggggacgauggugaccgugagcucc

SEQ ID NO: 9378 - RNA, 423 nt, Artificial Sequence
  derived and/or modified sequence opt1 from anti-HIV_cap256-119-179262_VR-Chain
caggugcagcuggucgagagcggcgggcgcguggugcaguccggcgggagccuccggcuguccugcggcgccagcggguucuccuucaccaccagcgccaugcacuggguccgccaggcgcccggcaagggccuggaguggguggccaucaacggggccaacaagcacuacgccgaguccgugaagggccgguucacgaucagccgcgacaacuccaagaacacccucuuccuggagaugaacagccugcggccggacgacaccgcccucuacuucugcgucaaggaccagcgcgaggacgagugcgaggaguggugguccgacuacuacgacuucgggcgggagcagcccugccuggacccccgcggcgugguggggaucuucgaccuguggggccagggcaccauggucacggugagcucc

SEQ ID NO: 9379 - RNA, 432 nt, Artificial Sequence
  derived and/or modified sequence opt1 from anti-HIV_cap256-119-178995_VR-Chain
caggugcagcuggucgagagcggcgggggcguggugcagcccgggaagucccuccggcugagcugcgccgccuccggcuucacccugacccgguucgcgaugcacuggguccgccaggccccggggaagggccucgaguggguggccgugaucugguacgacggcagcaacaaguacuacgccgacuccgucaaggggcgguucacggugagccgcgacaacuccaagaacacccuguaccugcagaugaacagccuccggaccgaggacaccgcccuguacuacugcgugcgcgaccggcgcgaguccgagugcgagcugugggagagcgacuacuacaacuucggccggcgccuccccugcgucaagccccgcgggguggcgggcauccuggacaucugggggcagggcacgaccgugaccgucuccccc

SEQ ID NO: 9380 - RNA, 432 nt, Artificial Sequence
  derived and/or modified sequence opt1 from anti-HIV_cap256-119-178455_VR-Chain
gaggugcagcuggucgagagcggcgggggccucgugcagcccgggggcucccugcgccugagcugcguggucuccggguucaccuucagcaacuucuggauguccugggugcggcaggccccgggcaagggccucgaguggguggccagcaucuccuacgacgggcgcgacaaguaccacagcucccuggucuggggccggcugaccaucagccgcgacaacuccaagagcacccucuuccugcagaugaacucccugcgggcggaggacacggcccucuacuacugcgcccgcgaccugcgggagagcgagugcgaggaguggcaguccgacuacuacgccuucuacaagaagcugcccugcgugaagccccgcgggguggccggcacccucgacaucugggggcagggcaccauggucacggugagcucc

SEQ ID NO: 9381 - RNA, 438 nt, Artificial Sequence
  derived and/or modified sequence opt1 from anti-HIV_cap256-119-177993_VR-Chain
caggugcaccuggucgagagcggcgggggcguggugcagcccgggaagucccuccgcaucuacugcgccgucagcgaguucaccuucuccaacuacgccaugcacugggugcggcuggccccgggccgcgggcugcaguggcucgccgugaucagcuacgacggcuccaagaaguacuacgccgacagccuggagggccgguucaccaucuccaaggacaacagcaagaacacgcuguuccuccagaugaacucccugcgcgucgaggacaccgcccuguacuucugcgugaaggaccagcgggaggacgagugcgaggagugguggagcgacuacuacgacuucggggagcgcgcgccccuccccaaggugcccggcccggggcccggcuggaaccuggacaugugggggcacggcaccauggucaccguguccagc

SEQ ID NO: 9382 - RNA, 438 nt, Artificial Sequence
  derived and/or modified sequence opt1 from anti-HIV_cap256-119-177727_VR-Chain
caggugcagcuggucgagagcggcgggggcguggugcagcccgggcgcucccuccggcugagcugcgccgccuccggcuucacccugagccgcuacgacaugcacuggguccggcaggcgccggggaagggccucgaguggguggccuccaucagcaaggacggcaccaagaaguaccacggggacuccguguggggccgcuucaucaucagccgggacaacuccaagaacacgcuguuccugcagaugagcucccuccgcgccgaggacaccgcccuguacuucugcguccgggaccagcgcgaggccgagugcgaggagugguggagcgacuacuacgacuucgggcgggagcugcccugccgcaaguuccggggccucgggcuggcgggcaucuucgacaucuggggccacgggaccauggugaccguguccagc

SEQ ID NO: 9383 - RNA, 432 nt, Artificial Sequence
  derived and/or modified sequence opt1 from anti-HIV_cap256-119-176746_VR-Chain
gaggugcagcuggucgagagcggcgggggccucgugcagcccgggggcucccugcggcugagcugcgccgccuccgacuucaccuucgacgacuacgcgaugcacugggugcggcaggccccggggaagggccucgagugggucggcgggaucagcuacgacggcuccgacaaguaccacaccaacagcgugugggggcgcuucaucgugucccgggacaacagcaagaacacgcuguaccugcagaugaacucccuccgccccgaggacaccgcccuguacuacugcguccgggaccgccgggagagcgagugcgaggagcgcugguccgacuacuacgacuucggcaagcagcugcccugcgugaagccccgcgggguggccggcaucuucgacaucuggggccaggggaccauggucaccgugagcucc

SEQ ID NO: 9384 - RNA, 432 nt, Artificial Sequence
  derived and/or modified sequence opt1 from anti-HIV_cap256-119-176241_VR-Chain
caggugcagcuggucgagagcggcgggggcguggugcagcccgggcgcucccuccggcugagcugcgccgccuccggcuucaccuucagcaacuacgcgaugcacuggguccgccaggccccggggaagggccuggaguggguggccgugaucuccuacgacggcagcaacaaguacuacgccgacuccgucaaggggcgguucaccaucagccgcgacaacuccaagaacacgcucuaccugcagauggacggccugcgcggggaggacaccgcccucuacuacugcgcgaaggaccugcgggagcuggagugcgaggagugggccagcgacuacuacgacuucggccggccccagcccugccucgacccccgcgggguguccggcaucagcaacguguggggccaggggaccauggucaccguguccagc

SEQ ID NO: 9385 - RNA, 432 nt, Artificial Sequence
  derived and/or modified sequence opt1 from anti-HIV_cap256-119-175215_VR-Chain
caggugcagcuggucgagagcggcgggggcguggugcagcccgggcggucccuccggcugagcugcgccgucucccaguucaccuucggccgcuacgggauguacugggugcggcaggccccgggcaagggccuggaguggguggcggggaucagcuacgacggcuccgacaaguaccacaccaacagcgucugggggcgcuucaucgugucccgggacaacagcaagaacaugcucuaccugcagaugaacaaccugcgccccgaggacacggcccucuacuacugcgugcgggaccgccgggaguccgagugcgaggagcgcuggagcgacuacuacgacuucggcaagcagcugcccugcgucaagccccgcgggguggccggcaucuucgacaucuggggccaggggaccauggugaccgucuccagc

SEQ ID NO: 9386 - RNA, 432 nt, Artificial Sequence
  derived and/or modified sequence opt1 from anti-HIV_cap256-119-173928_VR-Chain
ggcguggagcugcucgagagcgggggcgggcuggucgagcccggcgggucccugcgccucagcugcgugggcucccaguucagcuucgaccgguacggcaugcacugggugcgccaggccccggggaagggccuggagugggucgccgcgguguccuucgacgggaccgacaaguaccacgccgacgacguguggggccgguucaccaucagccgcgacaacuccaagaacacgcuguaccuccagaugaacagccugcgggccgaggacaccgcccuguacuacugcgccaaggaccuccgcgaggacgagugcgaggaguggugguccgacuacuacgaccuggggaagcagcugcccugccgcaagagccggggcgucgcgggcgugcucgacaagugggggcugggcaccauggugaccgucuccagc

SEQ ID NO: 9387 - RNA, 432 nt, Artificial Sequence
  derived and/or modified sequence opt1 from anti-HIV_cap256-119-173495_VR-Chain
caggugcagcuggucgagagcggcgggggcguggugcagcccgggaagucccuccgccugagcugcgccgccucccgguucaccuucaaccgcuacggcaugcacuggguccggcaggcgccggggaagggccuggaguggguggccgccaucagcuucgacggcaccgacaaguaccacuccgacgacgugugggggcgcuucacgaucagccgggacaacuccaagaacacccucuaccugcagaugaacagccugcgcgccgaggacaccgccgucuacuacugcgcgaaggaccuccgggaggacgagugcgaggagcgcugguccgacuacuacgacuucggcaagcagcugcccugccggaagucccgcgggguggccggcaucuucgacaacugggggcagggcaccauggugacggucagcagc

SEQ ID NO: 9388 - RNA, 432 nt, Artificial Sequence
  derived and/or modified sequence opt1 from anti-HIV_cap256-119-172882_VR-Chain
caggugcagcuggucgagagcggcgggggcguggugcagcccgggcgcucccucacccugagcugcgaggucuccggcuucaccuucaagacguacgggaugcacugggugcggcaggccccgggcaagggccuggaguggguggccagcaucuccuacgacgggagcgacaaguaccacgcggaccgcgucuggggccgguucaccaucucccgcgacaacagcaagaacacccucuaccugcagaugaacucccugcgggccgaggacaccgcccucuacuacugcgugcgcgacgcccgggagagcgagugcgagcugugggaguccgacuacuacaacuucgggcgcaagcugcccugcgugaagccccggggcgucgccgggacgcucgacaucuggggccagggcaccauggugaccgugagcucc

SEQ ID NO: 9389 - RNA, 432 nt, Artificial Sequence
  derived and/or modified sequence opt1 from anti-HIV_cap256-119-172429_VR-Chain
gaggugcagcuggucgagaccggcgggggccucauccagcccgggggcagccugcgccuguccugcguggccagccaguucaccuucuccgggugcggccuccacugggugcggcaggccccgggcaaggggcuggagugggucgcgagcaucuccuucgccggcacgaagaagcacuacgggaacagcgugaagggccgcuucaccaucucccgggacaacagcaagaacacccuguaccucgagaugaacacccugcgcgccgaggacacggcccuguacuacugcgccaaggaccuccgggaguacgagugcgaggaguggaccuccgacuacuacgacuucgggcgcccccagcccugcaucgacagccggggcguggucggcauccuggacaucugggggcagggcaccaugguguccgugagcucc

SEQ ID NO: 9390 - RNA, 432 nt, Artificial Sequence
  derived and/or modified sequence opt1 from anti-HIV_cap256-119-172223_VR-Chain
caggugcagcuggucgagagcggcgggggcguggugcagcccgggcgcucccuccggcugagcugcgccgccuccggcuucaccuucagcuccuacgcgaugcacuggguccgccaggccccggggaagggccuggaguggguggccgugaucagcuacgacggccgggacuucuaccacgcccgcuccgucugggggcgguucaccaucagccgcgacaacuccaagaacacgcuccaccuccagaugaacagccugcggcccgaggacaccgcccuguacuucugcgcgcgcgaccugcgggaguccgagugcgaggagugggagagcuacuacuacgacuucggcaagaaggaccccugcgugaagccccgcgggguggucggcgugcuggacaucugggggcagggcacccucgugaccgucuccagc

SEQ ID NO: 9391 - RNA, 432 nt, Artificial Sequence
  derived and/or modified sequence opt1 from anti-HIV_cap256-119-171838_VR-Chain
caggugcagcugggcgagagcgggggcggggucgugcagcccggccgcucccuccggcugagcugcgccgccuccggguucaccuucagcaccuucgcgaugcacugggugcgccaggccccgggcaagggccuggagugggucgccgugaucuccuacgacgggagcaacaaguacuacgccgacuccgugaagggccgguucgccaucagccgcgacaacgcgaagaaccuccugcaccuccagaugaacucccugcggcccgaggacacggcccuguacuacugcgccaaggaccugcaggaggacgagugcgaggagugguggagcgacuacuacgacuucgggaagcagcuccccugccgcaagucccggggcgucgccgggaucuucgacgacuggggccagggcaccauggugaccgugagcucc

SEQ ID NO: 9392 - RNA, 432 nt, Artificial Sequence
  derived and/or modified sequence opt1 from anti-HIV_cap256-119-171587_VR-Chain
gaggugcagcuggucgagagcggcgggggccucgugcagcccgggggcucccugcggcugagcugcgccgccuccggguucaccuucagcgacuacuacauguccuggauccggcaggcgccgggcaagggccucgaguggguggccagcaucuccuucgccgggaccaagcagcacuacggcaacagcgucaaggggcgcuucacgaucucccgggacaacagcaagaacaccguguaccugcagaugaacucccugcgccucgaggacaccgcccuguacuacugcgccaaggaccugcgggaguacgagugcgaggaguggaccagcgacuacuacgacuucggccgcccccagcccugcaucgacucccgcgggguggucggcauccucgacaucuggggccaggggacgauggugaccgugagcucc

SEQ ID NO: 9393 - RNA, 432 nt, Artificial Sequence
  derived and/or modified sequence opt1 from anti-HIV_cap256-119-169596_VR-Chain
cuggugcagcucgucgagagcggcgggggcguggugcagcccgggcggucccugcggcugagcugcaccgccuccggcuucaccuucagcuccuucgccaugcaccgcguccggcagacgccggggaagggccucgaguggguggcgagcaucuccuacgacggcagcgacaaguaccacgccgaccgcgugugggggcgguucaccaucucccgcgacaacagcaagaacacccuguaccugcagaugaacucccuccgggccgaggacaccgcccuguacuacugcguccgcgacgcccgggagagcgagugcgagcugugggaguccgacuacuacaacuucggccgcaagcuccccugcgugaagccccgcgggguggcgggcacgcuggacaucugggggcagggcaccauggucaccgugagcucc

SEQ ID NO: 9394 - RNA, 432 nt, Artificial Sequence
  derived and/or modified sequence opt1 from anti-HIV_cap256-119-169523_VR-Chain
caggugcagcuggucgagagcggcgggggcguggugcagcccggggagucccuccgccugagcugcgccgccuccggcuucagcuucgggaccuccgacguccacugggugcggcaggcgccgggcgagggccuggaguggguggccagcaucuccuucgccgggaucaagaaguacuacggcgacagcgucaaggggcgcuucaccaucucccgggacaacagcaagaacacgcucuaccugcagauggacggccugcgcggggaggacaccgcccucuacuacugcgccaaggaccugcgggagcuggagugcgaggagugggcguccgacuacuacgacuucggccgcccccagcccugccucgacccccggggcgugagcgggaucuccaacguguggggccaggggaccauggucaccgugagcucc

SEQ ID NO: 9395 - RNA, 432 nt, Artificial Sequence
  derived and/or modified sequence opt1 from anti-HIV_cap256-119-169462_VR-Chain
gaggugcagcuggucgagagcggcgggggccucgugcagcccgggggcucccugcgccugagcugcgccgccuccggguucaccuucaccacguacagccuccacugggugcggcaguccccgggcaagggccuggagugggucgcggccaucagcuucgccgggaccaaggagaacuacgccaacuccgugcgcggccgguucaccaucagccgcgacaacuccaagaacacccuguaccuccagaugaacagccugcgggccgaggacacggcgcuguacuacugcaccaaggacaugcgcgaguacgagugcgaggaguggaccuccgacuacuacgacuucgggcggccccagcccugcaucgacagccgcggcguggucgggaccuucgacguguggggccagggcacgauggugaccgucuccagc

SEQ ID NO: 9396 - RNA, 432 nt, Artificial Sequence
  derived and/or modified sequence opt1 from anti-HIV_cap256-119-169092_VR-Chain
gaggugcagcuggucgagagcggcgggggccucgugcagcccgggggcucccugcgccugagcugcgugaucuccggguucaccuucagcuccuacgagaugaacuggguccggcaggccccgggcaagggccucgaguggguggccgggaucagcuacgacggccgcgacaaguaccacgcgcacuucgugugggggcggaucaccaucucccgcgacaacagcaagaacacgcuguaccugcagaugaacucccuccgggccgaggacaccgcccuguaccacugcguccgcgaccugcgggagagcgagugcgagcucugggaguccgacuacuacgacuucggcaagaagcugcccugcgugaagccccgcgggguggccggcaucuucgaccuguggggccaggggaccauggucaccgugagcucc

SEQ ID NO: 9397 - RNA, 432 nt, Artificial Sequence
  derived and/or modified sequence opt1 from anti-HIV_cap256-119-168680_VR-Chain
caggugcagcuggucgagagcggcgggggcguggugcagcccgggcggucccuccgggucagcugcgccgccucccacuucaccuucagccgcuacggcaugcacugggugcggcaggcgccggggaagggccuggaguggguggccuccaucagcuacgacggccgcgacuucuaccacgcccgguccgucugggggcgcuucgccaucagccgggacaacuccaagaacacccugcaccuccagaugaacagccugcgcacggaggacaccgcccuguaccacugcgugcgggaccuccgcgaguccgagugcgagcugugggagagcgacuacuacgacuucggcaagaagcugcccugcgugaagccccgcggggucgcgggcaccuucgaccucugggggcagggcaccauggugacgguguccagc

SEQ ID NO: 9398 - RNA, 438 nt, Artificial Sequence
  derived and/or modified sequence opt1 from anti-HIV_cap256-119-166385_VR-Chain
caggugcagcuggucgagagcggcgggggcguggugcaccccgggcgcucccuccggcugagcugcgccgccuccggcuucagcuucgggaacuucggcaugcacuggguccgccaggcgccgggcaaggggcuggaguggguggccuccaucagcaacgacggcaccaagaaguaccacgccgaguccgugugggaccgguucagcaucuccaaggacaacagcaagaacacccucuuccugcagaugaacucccugcgcgucgaggacacggcccucuacuucugcgugaaggaccagcgggaggacgagugcgaggagugguggagcgacuacuacgacuucgggcgcgagcugcccugccggaagucccgcggccuggggcucgccggcaucuucgacauguggggccacgggaccauggugaccgucagcucc

SEQ ID NO: 9399 - RNA, 432 nt, Artificial Sequence
  derived and/or modified sequence opt1 from anti-HIV_cap256-119-165943_VR-Chain
gaggugcagcuggucgagagcggcgggggccucgugcagcccgggcgcucccugcggcugagcugcgccguguccggcuucaccgucagcuccaacuacaugagcugggugcgccaggccccggggaagggccucgaguggguggcguccaucagcuucgccggcaucaagaaguacuacggggacuccgucaagggccgguucaccaucagccgcgacaacuccaagaacacgcuguaccugcagauggacgggcuccggggcgaggacaccgcccuguacuacugcgccaaggaccugcgcgagcucgagugcgaggagugggccagcgacuacuacgacuucgggcggccccagcccugccuggacccccgcggcguguccggcaucagcaacgugugggggcagggcaccauggucaccguguccagc

SEQ ID NO: 9400 - RNA, 432 nt, Artificial Sequence
  derived and/or modified sequence opt1 from anti-HIV_cap256-119-165738_VR-Chain
gaggugcagcuggucgagagcggcgggggccucgugcagcccgggcgcucccugcggcugagcugcgccgccuccggcuucaccuucgacgacuacgcgaugaacugggugcgccaggccccggggaagggccucgagugggucgccaccaucagcuucgacggcacggacaaguaccacgccgacgacgugugggggcgguucaccaucucccgcgacaacagcaagaagacccuguaccugcagaugaacucccuccgggccgaggacaccgcgcuguacuacugcgccaaggaccugcgcgaggacgagugcgaggagugguggagcgacuacuacgaccucggcaagcagcugcccugccggaagucccgcgggguggccggcguccuggacaagugggggcucggcacgauggugaccgugagcucc

SEQ ID NO: 9401 - RNA, 432 nt, Artificial Sequence
  derived and/or modified sequence opt1 from anti-HIV_cap256-119-164913_VR-Chain
caggaccaccugguggagagcggcgggggcgggguccagcccggcaagucccuccgccugagcugcgccgccuccggguucaccuucagcgcgcacgccaugcacugggugcggcaggccccgggcaagggccccgaguggguggccgucaucucccacgacgggggccagcaguucuaccgcgagagcgugaaggggcgguucaccaucucccgcgacaacagcaagaacacgcuguaccuccagauggacggccugcgcggggaggacaccgcccuguacuacugcgcgaaggaccuccgggagcuggagugcgaggagugggccuccgacuacuacgacuucggccggccccagcccugccuggacccgcgcggcgugagcgggaucuccaacgucuggggccaggggaccauggugaccgugagcucc

SEQ ID NO: 9402 - RNA, 432 nt, Artificial Sequence
  derived and/or modified sequence opt1 from anti-HIV_cap256-119-164167_VR-Chain
gaggugcgccuggucgagagcggcgggggccucauccagcccgggggcucccugcggcugagcugcgccgccuccgggcucaccgugagcuccaaccacaugagcugggugcgccaggcgccgggcaagggccuggagugggucgccuccaucagcuacgacgggcgggacuucuaccacgcccgcuccguguggggccgguucaccaucagccgcgacaacuccaagaacacgcugcaccuccagaugaacagccugcggcccgaggacaccgcccuguacuucugcgcccgcgaccuccgggaguccgagugcgaggagugggagagcuacuacuacgacuucgggaagaagggccccugcgugaagccccgcggggucgugggcgugcuggacaucuggggccaggggacccuggucaccguguccagc

SEQ ID NO: 9403 - RNA, 432 nt, Artificial Sequence
  derived and/or modified sequence opt1 from anti-HIV_cap256-119-163558_VR-Chain
cagaugcagcugguggagagcggcgggggcgucgugcagcccgggcggucccucacccugagcugcgccgccucccaguucaacuucgcgaacuacggcaugcacugggugcggcaggccccggggaagggccuggagugggucgccagcaucuccuacgacggcagcgacaaguaccacgccgaccgcgugugggggcgguucaccaucucccgcgacaacagcaagaacacgcucuaccugcagaugaacucccugcgggccgaggacaccgcgcucuacuacugcgugcgcgacgcccgggagagcgagugcgagcugugggaguccgacuacuacaacuucggccgcaagcugcccugcgucaagccccgcgggguggccggcacccucgacaucugggggcagggcaccauggugacggucagcucc

SEQ ID NO: 9404 - RNA, 432 nt, Artificial Sequence
  derived and/or modified sequence opt1 from anti-HIV_cap256-119-162043_VR-Chain
caggugcagcuggucgagagcggcgggggcguggugcagcccgggcgcucccuccgggucagcugcgccgccucccacuucaccuucagccgcuacggcaugcacugggugcggcaggcgccggggaagggccuggagugggugaccggcaucuccuucgccgccacgaagaccuacuacggggacagcguccgcggccgguucaccgugucccgcgacaucagcaagaacacccuguaccuccagaugaacucccugcggcccgaggacacggccauguacuacugcgcccgcgaccagcgguacuacgagugcgaggagugggcgagcgacuacuacgacuucgggcgcgagcagcccugccaggacccccggggcguggucgggauccuggaccucuggggccagggcaccauggugaccguguccagc

SEQ ID NO: 9405 - RNA, 432 nt, Artificial Sequence
  derived and/or modified sequence opt1 from anti-HIV_cap256-119-161718_VR-Chain
caggugcagcuggucgagagcggcgggggcguggugcagcccgggaagucccuccgccugagcugcgccgccucccacuucagcuucaaccgguacggcaugcacuggguccgccaggcgccggggaagggccuggaguggguggccgccaucuccuacgacggcaccgacaaguaccacgccgaccaggugugggggcgguucaccaucagccgcgacaacuccaagaacacgcucuaccugcagaugaacagccugcggcccgaggacaccgcccucuacuacugcgcgaaggaccugcgcgaggacgagugcgaggaguggugguccgacuacuacgaccugggcaagcagcuccccugccggaagucccgcggggucgccggcaucuucgacaagugggggcagggcaccauggugaccgugagcagc

SEQ ID NO: 9406 - RNA, 432 nt, Artificial Sequence
  derived and/or modified sequence opt1 from anti-HIV_cap256-119-161675_VR-Chain
caggugcagcuggucgagagcggcgggggcguggugcagcccgggcggucccuccggcugagcugcaccgccuccggcuucaccuucagcaucuacuccaugaacuggguccgccaggccccggggaagggccuggacuggguggcgggcaucagcuucgccgccacgaagaccuacuacgggggcuccgugaaggggcgguucaccgucagccgcgacaucuccaagaacacccucuaccugcagaugaacagccugcggcccgaggacacggccauguacuacugcgcccgcgaccagcgguacuacgagugcgaggagugggcguccgacuacuacgacuucggccgcgagcagcccugccaggacccccgcgggguggugggcgucuucgacauguggggccaggggaccauggugaccgugagcucc

SEQ ID NO: 9407 - RNA, 432 nt, Artificial Sequence
  derived and/or modified sequence opt1 from anti-HIV_cap256-119-161053_VR-Chain
caggugcaccuggucgagagcggcgggggcguggugcagcccgggaccucccuccggcugagcugcgucgccuccggcuucaccuucagcaacuucgccaugcacugggugcggcaggcgccggggaagggccuggagugggccgccaucaucuccacgcgcggcaacaaccggaacuacgccgacagcgugcgcgggcgguucaccgucucccgcgacaucagcaagaacacccucuaccugcagaugaacucccugcggcccgaggacaccgccauguacuacugcgcgcgcgaccagcgguacuacgagugcgaggagugggccagcgacuacuacgacuucggccgcgagcagcccugccaggacccccgcgggguggugggcauccucgaccugugggggcagggcacgauggucaccguguccagc

SEQ ID NO: 9408 - RNA, 432 nt, Artificial Sequence
  derived and/or modified sequence opt1 from anti-HIV_cap256-119-159499_VR-Chain
caggugcagcuggucgagagcggcgggggcguggugcagcccgggcgcucccuccggcugagcugcgccgccuccggcuucgcguucagccacuacgggaucuucuggguccgccaggccccgggcaagggccuggaguggguggccuccaucagcuucgacgggcgggacuacuaccacagcccccacguguggggccgccucaccaucucccgggacaacuccaagaacacccuguaccugcagaugaacagccuccgcgccgaggacacggcccuguacuacugcgcgcgggaccugcgcgaguccgagcgggaggagugggagagcgacuacuacgacuucgggaagaagggccccugcgucaagccccgcgggguggccggcucccucgacauguggggccaggggaccauggugaucgucagcucc

SEQ ID NO: 9409 - RNA, 432 nt, Artificial Sequence
  derived and/or modified sequence opt1 from anti-HIV_cap256-119-159114_VR-Chain
gaggugcagcuggucgagagcggcgggggccucgugcagcccgggggcucccugcgccuggccugcgccgcgagcgggcucaccuuccggaagcacggcaugcacugggugcgccaggccccgggcaaggggcuggagugggucuccuacaucagcuccgacggcgugaacaacuaccugaucgacagcgugcgggggcgcuucaccgucucccgggacaacagcaagaacacgcucuaccugcagauggacggccugcgcggggaggacaccgcccucuacuacugcgccaaggaccugcgggagcuggagugcgaggagugggccuccgacuacuacgacuucggccgcccccagcccugccucgacccccggggcgugagcgggaucuccaacguguggggccaggggaccauggucaccgugagcucc

SEQ ID NO: 9410 - RNA, 432 nt, Artificial Sequence
  derived and/or modified sequence opt1 from anti-HIV_cap256-119-156751_VR-Chain
gaggugcagcugcucgagagcggcgggggccugguccagcccgggggcucccugcgccucagcugcgccgccuccggguucgcguucagcuccuacggcaugcacugggugcggcaggccccgggcaaggggcuggaguggguggccagcaucuccuacgacggccgcgacuucuaccacgcccggagcgucugggggcgcuucaccaucucccgggacaacagcaagaacacccugcaccuccagaugaacucccugcgccccgaggacacggcccuguacuucugcgcgcgggaccuccgcgagagcgagugcgaggagugggaguccuacuacuacgacuucggcaagaaggggcccugcgugaagccccggggcguggucggcgugcuggacaucugggggcagggcacccuggugaccgucagcucc

SEQ ID NO: 9411 - RNA, 432 nt, Artificial Sequence
  derived and/or modified sequence opt1 from anti-HIV_cap256-119-155656_VR-Chain
gaggugcagcuggucgagagcggcgggggccucgugcagcccgggggcucccugcgccugagcugcgccgccuccgggaucaccuucagcuccuacggcaugcacugggugcggcaggcgccgggcaaggggcucgagugggucgccuucauccgcuacgacggcagcuccaaguacuacgccgacagcgugaaggggcgguucaccaucucccgcgacaacagcaagaacacgcuguaccugcagauggacggccuccgcggggaggacaccgcccuguacuacugcgccaaggaccugcgggagcucgagugcgaggagugggcguccgacuacuacgacuucggccggccccagcccugccuggacccccgcggcgugagcgggaucuccaacgucuggggccaggggaccauggugaccgugagcucc

SEQ ID NO: 9412 - RNA, 432 nt, Artificial Sequence
  derived and/or modified sequence opt1 from anti-HIV_cap256-119-154420_VR-Chain
caggugcgccuggucgagagcggcgggggcguggugcagcccgggcggucccuccgcaucagcugcgccgccucccaguucauguucagccgguacggcaugcacuggguccgccaggcgccggggaagggccuggaguggguggccuccaucagcuacgacggcaccgacaaguaccacgccgaccuggugugggggcgguucaccaucucccgcgacaacagcaagaacacgcucuaccugcagaugaacucccugcgggccgaggacaccgcccucuacuacugcgcgcgcgaccugcgggagagcgagugcgaggagugggaguccgacuacuacgacuucggcaagaaggggcccugcgucaagccccgcggcguggccgggagccuggacauguggggccagggcaccauggugaucgucuccagc

SEQ ID NO: 9413 - RNA, 432 nt, Artificial Sequence
  derived and/or modified sequence opt1 from anti-HIV_cap256-119-153954_VR-Chain
gaggugcagguccuggagagcggcgggggccucgugcagcccgggggcucccugcgccugagcugcguggccucccaguucaccuucagcgggugcggccuccacuggguccggcaggccccgggcaaggggcuggaguggguggcguccaucagcuucgccggcaccaagaagcacuacgggaacuccgugaagggccgcuucacgaucagccgggacaacuccaagaacaccgucuaccuggagaugaacagccuccgcgccgaggacaccgcccuguacuacugcgccaaggaccugcgggaguacgagugcgaggaguggaccuccgacuacuacgacuucgggcgcccccagcccugcaucgacagccggggcguggugggcauccucgacaucugggggcagggcacgauggucaccguguccagc

SEQ ID NO: 9414 - RNA, 432 nt, Artificial Sequence
  derived and/or modified sequence opt1 from anti-HIV_cap256-119-153864_VR-Chain
caggugcaccuggucgagagcggcgggggcguggugcagcccgggggcucccuccgccugagcugcgccgccuccggguucaccuucagcggcugcggccugcacuggguccggcaggcgccggggaagggccucgaguggguggccuccaucagcuucgccgggaccaagaagcacuacggcuccagcgugcgcgggcgguucuccaucagccgcgacaacuccaagaacacgcuguaccugcagaugaacagccuccggaccgaggacaccgcccuguacuucugcgccaaggaccugcgcgaguacgagugcgaggaguggaccuccgacuacuacgacuucggccggccccagcccugcaucgacagccgcggcgucguggggauccucgacaucuggggccaggggacgauggugaccgucuccagc

SEQ ID NO: 9415 - RNA, 432 nt, Artificial Sequence
  derived and/or modified sequence opt1 from anti-HIV_cap256-119-153793_VR-Chain
gaggugcagcuggucgagagcggcgggggcguggugcagcccgggggcucccuccgccugagcugcgccaccuccggguucaccuucggcacguucggcaugcacuggguccggcaggccccggggaagggccuggacuggguggcguacauccgcuacgacgggaagaccaagaacuacggcgagagcgugaaggggcgguucaccaucucccgcgacaacagcaagaacaccaugucccuccagaugaacagccugcggcccgaggacacggcccuguacuacugcgccaaggaccuccgcgaggacgagugcgaggagcggugguccgacuacuacgacuucggcaagcagcugcccugccgcaagagccggggcgucgccgggguguucgacaacuggggccaggggaccauggugaccgucuccagc

SEQ ID NO: 9416 - RNA, 432 nt, Artificial Sequence
  derived and/or modified sequence opt1 from anti-HIV_cap256-119-153462_VR-Chain
caggugcagcuggucgagagcggcgggggcguggugcagcccgggggcucccuccgccugagcugcgccgccuccggguucaccuucagcaacuacggcaugcaguggguccggcaggcgccgggcaaggggcuggaguggguggccgccaucuccuacgacggccgcaacgaguacuacgccgagagcgugaaggggcgguucaccaucucccgcgacaacuucaagagcacccucuuccugcagaugaacucccugcgggccgaggacacggcgcucuacuacugcgcccgcgaccugcgggagagcgagugcgaggagugggaguccgacuacuacgccuucuaccgcaagcugcccugcgucaagccccggggcguggccgggacccucgacaucuggggccagggcaccauggugacggucagcucc

SEQ ID NO: 9417 - RNA, 438 nt, Artificial Sequence
  derived and/or modified sequence opt1 from anti-HIV_cap256-119-153124_VR-Chain
caggugcagcuggucgagagcggcgggggcguggugcagcccgggcgcucccucacccugagcugcaucgccucccaguucaacuucgccagcuacggcaugcacuggguccggcaggcgccggggaagggccuggaguggguggccuccaucagccacgacggcaccaagaaguaccacgccgaguccgugugggggcgcuucacgaucagcaaggacaacuccaagaacacccucuuccugcagaugaacagccugcgggucgaggacaccgcccucuacuucugcgugaaggaccagcgcgaggacgagugcgaggaguggugguccgacuacuacgacuucggccgggagcugcccugccgcaagagccgggggcugggccucgccgggaucuucgacauguggggccacggcaccauggugacggucuccagc

SEQ ID NO: 9418 - RNA, 438 nt, Artificial Sequence
  derived and/or modified sequence opt1 from anti-HIV_cap256-119-153025_VR-Chain
cagaugcagcugguggagagcggcgggggcgucgugcagcccgggaagucccucacccugagcugcgccgccucccaguucaccuucagcaacuacggcaugcacugggugcgccaggcgccggggaagggccuggagugggucgccuccaucagcaacgacggcaacaagaaguaccacggggacuccguguggggccggcucacgaucagccgcgacaacuccaagaacacccuguuccugcagaugaacagccuccggcccgaggacaccgcccuguacuucugcgugaaggaccagcgcgaggacgagugcgaggaguggugguccgacuacuacgacuucgggcgggagcugcccugccgcaaguuccggggccucgggcuggccggcaucuucgacaucuggggccacgggaccauggucacggugagcucc

SEQ ID NO: 9419 - RNA, 432 nt, Artificial Sequence
  derived and/or modified sequence opt1 from anti-HIV_cap256-119-152713_VR-Chain
gaggugcagcuggucgagagcggcgggggccucgugcgccccgggggcucccugcggcugagcugcgccaccuccggguucaccuucagcucccacuggaugagcugggugcgccaggccccgggcaagggccucgagugggucgcggggaucuccuucgccggcacgaagaccuacuacggggacagcgugaagggccgguucaccguguccaccgacaucagcaagaacacgcuguaccugcaggucaacucccuccgccccgaggacaccgccauguacuacugcgcccgggaccagcgcuacuacgagugcgaggagugggccagcgacuacuacgacuucgggaaggagcagcccugccuggacccccggggcguggugggcaucuucgacaucugggggcagggcaccauggucaccguguccagc

SEQ ID NO: 9420 - RNA, 438 nt, Artificial Sequence
  derived and/or modified sequence opt1 from anti-HIV_cap256-119-151794_VR-Chain
cacgugcagcuggucgagagcggcgggggcguggugcagcccgggaccucccuccgccugagcugcgucgccuccgaguucagcuucaagaacuacggcaugcacugggugcggcaggccccggggaagggccuggaguggguggcguccaucagcaacgacggcaccaagaaguaccacgccgaguccgucugggaccgcuucagcaucuccaaggacaacagcaagaacacccucuuccugcagaugaacucccugcggguggaggacacggcccucuacuucugcgugaaggaccagcgcgaggacgagugcgaggagugguggagcgacuacuacgacuucgggcgggagcugcccugccgcaagucccggggccuggggcucgccggcaucuucgacaugugggggcacggcaccauggucaccgugagcucc

SEQ ID NO: 9421 - RNA, 438 nt, Artificial Sequence
  derived and/or modified sequence opt1 from anti-HIV_cap256-119-150980_VR-Chain
caggugcagcuggucgagagcggcgggggcguggugcagcccgggaagucccuccgccugagcugcgccgccuccggcuucauccugagcaacuacgcgaugcacuggguccggcaggccccggggaagggccucgaguggguggccuccaucagcaacgacggcuccaagaaguaccacggggacagcgugugggcccgcuucaucaucucccgggacaacagcaagaacacccuguuccugcagauguccagccuccgcgccgaggacaccgcgcuguacuucugcguccgggaccaccgcgaggacgagugcgaggaguggugguccgacuacuacgacuucggccgggagcugcccugccgcaaguuccgggggcucggccuggccgggaucuucgacaucuggggccacggcacgauggugaccgugagcucc

SEQ ID NO: 9422 - RNA, 432 nt, Artificial Sequence
  derived and/or modified sequence opt1 from anti-HIV_cap256-119-148895_VR-Chain
caggugcagcuggucgagagcggcgggggcguggugcagcccgggcgcucccuccggcugagcugcgccgccuccggcuucaccuuccgcagcuacgggaugcacuggguccggcaggcgccgggcaagggccuggaguggguggccgugaucuccagcgacggggacaucgaguacuacacccaguccgucaagggccgcuucacgaucagccgggacaacuccaagaacacccucuaccugcagaugaacgcccugcgccccgaggacaccgccauguacuacugcgcccgggaccagcgcuacuacgagugcgaggagugggcgagcgacuacuacgacuucgggcgggagcagcccugccaggacccccgcggcguggugggggucuucgacauguggggccagggcaccauggugacgguguccagc

SEQ ID NO: 9423 - RNA, 438 nt, Artificial Sequence
  derived and/or modified sequence opt1 from anti-HIV_cap256-119-148848_VR-Chain
cagaugcagcugguggagagcggcgggggcgucgugcagcccgggcggucccucacccugagcugcgccgccucccaguucagcuucaccuccuacggcaugcacugggugcggcaggcgccggggaagggccuggagugggucgccagcaucuccaacgacggcacgaagaaguaccacggggagagcgugugggaccgcuucuccaucagccgggacaacuccaagaacacccucuuccugcagaugaacagccugcgcguggaggacaccgcccucuacuucugcgucaaggaccagcgggaggacgagugcgaggaguggugguccgacuacuacgacuucggcaaggagcugcccugccgcaaguggaagacccgcgggguggccggcauccuggacaacugggggcagggcacgaugcucaccgugagcucc

SEQ ID NO: 9424 - RNA, 432 nt, Artificial Sequence
  derived and/or modified sequence opt1 from anti-HIV_cap256-119-148743_VR-Chain
caggugcagcuggucgagagcggcgggggcguggugcagcccgggcgcucccucacccugagcugcgccgccucccaguucaacuucgcgaacuacggcaugcacuggguccggcaggccccggggaagggccuggaguggguggccagcaucuccaacgacggcaccaagaaguaccacgccgagagcgugugggaccgcuucuccaucagcaaggacaacuccaagaacacccucuuccugcagaugaacagccugcgggucgaggacacggcccucuacuucugcgugaaggaccagcgcgaggacgagugcgaggaguggugguccgacuacuacgacuucgggaagaagcugcccugccgcaagagccggggccuggcggggaucuuccacguguggggccacgggaccauggucaccguguccagc

SEQ ID NO: 9425 - RNA, 432 nt, Artificial Sequence
  derived and/or modified sequence opt1 from anti-HIV_cap256-119-148595_VR-Chain
gaggugcagcuggucgagagcggcgggggccucgugcagcccgggggcucccugcgccugagcugcgccgccucccgguucaccuucgacaacuacgggaugcacugggugcgccaggcgccgggcaagggccucgagugggucgcccugcugaacuacgacgggagcaagaaguacuacguggacuccgugaagggccgguucaucaucuuccgcgacaacagcaagaacacccucuuccugcagaugaacucccugcggcccgaggacacggcccucuacuucugcgucaaggaccagcgcgaggacgccugcgaggagugguggagcgacuacuacgacuucgggaagaagcugcccugccggaagucccgcggccuggccgggaucuuccacguguggggccacggcaccauggugaccgucagcucc

SEQ ID NO: 9426 - RNA, 432 nt, Artificial Sequence
  derived and/or modified sequence opt1 from anti-HIV_cap256-119-148490_VR-Chain
caggugcagcuggucgagagcggcgggggcguggugcagcccgggcggucccuccggcugagcugcgucgccuccggcuucaccuucagcgacuacgccaugcacugggugcgccaggcgccggggaagggccuggaguggguggccaccaucuccuucgacggcgccgacaaguaccacgccgacgacgucugggggcgguucacgaucagccgcgacaacuccaagaacacccucuaccugcagaugaacagccugcggcccgaggacaccgcccucuacuacugcgcgaaggaccugcgcgaggacgagugcgaggagcggugguccgacuacuacgacuucggcaagcagcugcccugccgcaagagccgcgggguggccggcguguucgacaacugggggcagggcaccauggucacgguguccagc

SEQ ID NO: 9427 - RNA, 438 nt, Artificial Sequence
  derived and/or modified sequence opt1 from anti-HIV_cap256-119-148470_VR-Chain
caggugcagcuggucgagagcggcgggggcguggugcagcccgggcgcucccuccggcugagcugcgucgccuccggcuucaccuucagcuccuacgggauccacugggugcgccaggccccgggcaagggccuggaguggguggcggucaucagcgacgacggguccaagaaguaccacgaggagagcguguggggccgguucaccaucuccaaggacaacagcaagaacacccucuuccugcagaugaacucccugcgcaucgaggacacggcccucuacuucugcgugaaggaccagcgggaggacgagugcgaggagugguggagcgacuacuacgacuucgggcgcgagcugcccugccggaagucccgcggccuggggcucgccggcaucuucgacauguggggccacgggaccauggucaccgugagcucc

SEQ ID NO: 9428 - RNA, 432 nt, Artificial Sequence
  derived and/or modified sequence opt1 from anti-HIV_cap256-119-148107_VR-Chain
gaggugcagcuggucgagagcggcgggggccucgugcagcccgggggcucccugcgccugagcugcgccgccuccggguucaccgugagcuccaacuacaugaccuggguccggcaggcgccgcgcaagggccucgagugggugggcagcaucuccuacgacgggagcgacaaguaccacacgaacucccuguggggccgguucaucgugagccgcgacaacuccaagaacacccuguaccuccagaugaacaaccugcggcccgaggacaccgcccuguacuacugcguccgcgaccggcgcgagagcgagugcgaggagcggugguccgacuacuacgacuucgggaagcagcuccccugcgugaagccccgcggcguggccgggaucuucgacaucuggggccagggcaccauggucacggugagcucc

SEQ ID NO: 9429 - RNA, 432 nt, Artificial Sequence
  derived and/or modified sequence opt1 from anti-HIV_cap256-119-147933_VR-Chain
gagcugcagcucguggagagcggcgggggccugguccagcccggguggucccugcgccucagcugcgaggccuccggcuucccguucagcgccuucuggaugaccugggugcggcaggcgcccgggaagggccugggcuggguggccuucauccgcuacgacggguccaacaaguacuacgccgacagcgucaagggccgguucaccaucucccgcgacaacagcaugacgacccuguaccuccagaugaacucccugcgggccgaggacgccgcgguguacuacugcgccaaggaccugcgcgaggacgagugcgaggagugguggagcgacuacuacgacuucgggaagcggcuccccugccgcaagucccggggcguggccggggucuucgacaaguggggccagggcaccauggugaccgugagcucc

SEQ ID NO: 9430 - RNA, 432 nt, Artificial Sequence
  derived and/or modified sequence opt1 from anti-HIV_cap256-119-147434_VR-Chain
caggugcagcuggucgagagcggcgggggcguggugcaggccgggcgcucccuccggcugagcugcgccgcgucccaguucaccuucggccgcuacgggaugcacuggguccggcaggcccccggcaagggccuggaguggguggggagcaucuccuacgacggcagcgacaaguaccacaccaacuccgugugggggcgcuucaucgucagccgggacaacuccaagaacacgcucuaccugcagaugaacagccugcgcccggaggacaccgccauguacuacugcgcccgggaccagcgcuacuacgagugcgaggagugggccuccgacuacuacgacuucggccgggagcagcccugccaggacccccgcgggguggugggcgucuucgacauguggggccaggggaccauggugaccgugagcucc

SEQ ID NO: 9431 - RNA, 435 nt, Artificial Sequence
  derived and/or modified sequence opt1 from anti-HIV_cap256-119-146106_VR-Chain
caggugcagcuggucgagagcggcgggggcguggugcagcccgggcgcucccuccggcugagcugcgccgccuccggcuucaccuucagcuccagcgggaugcacuggguccgccaggcgccgggcaagggccugcaguggguggccgugaucuccuacgacgggggcaacaaguacuacgccgacagcgucaaggggcgguucaccaucucccgcgacaacagcaagaacaaccucuaccugcagaugaacucccugcggcccgaggacacggcccucuacuacugcgcccgcgaccugcgggagauggagugcgaggaguggaagcuguacaacuacuacgacuuccgcacccggggccccugcguggacccccgcgggguggucggcagcuucgacguguggggccaggggaccguggucaccguguccagc

SEQ ID NO: 9432 - RNA, 438 nt, Artificial Sequence
  derived and/or modified sequence opt1 from anti-HIV_cap256-119-145604_VR-Chain
gacgugcagcuggccgagagcggcgggggccucguccagcccgggggcucccugcgccugagcugcguggccuccggguucaccuucagcuccuucgagaugcacugggugcggcaggcgccgggcaagggccucgagugggucgccagcaucuccaacgacgggaccaagcgcuaccacgccgagagcgugugggaccgguucuccaucagcaaggacaacuccaagaacacgcuguuccugcagaugaacagccuccgcguggaggacaccgcccuguacuucugcgucaaggaccagcgggaggacgagugcgaggaguggugguccgacuacuacgacuucggccgcgagcugcccugccgcaagagccgggggcucggccuggccgggaucuucgacauguggggccacggcaccauggugaccguguccagc

SEQ ID NO: 9433 - RNA, 438 nt, Artificial Sequence
  derived and/or modified sequence opt1 from anti-HIV_cap256-119-143998_VR-Chain
caggugcagcuggucgagagcggcgggggcguggugcagcccgggcgcucccuccggcugagcugcgccgccuccggcuucaccuuccgcaacuacgggaugcacuggguccggcaggcgccgggcaagggccuggaguggguggccagcaucuccaacgacgggagcaagaaguaccacggcgacuccgugugggcccgcuucaucaucagccgggacaacuccaagaacacccucuuccugcagaugagcucccugcgcgccgaggacacggcccucuacuucugcgucaaggaccagcgggaggacgagugcgaggagugguggagcgacuacuacgacuucgggcgcgagcugcccugccggaagucccgcggccuggggcucgcgggcaucuucgacauguggggccacgggaccauggugaccgugagcucc

SEQ ID NO: 9434 - RNA, 438 nt, Artificial Sequence
  derived and/or modified sequence opt1 from anti-HIV_cap256-119-143441_VR-Chain
gaggugcaccuggucgagagcggcgggggccucgcccagcccgggcgcucccugcggcugagcugcgccgcgucccaguucaacuucgccagcuacggcaugcacugggugcgccaggccccggggaagggccucgaguggguggccuccaucagcaacgacggcaccaagcgguaccacgccgaguccgucugggaccgcuucagcaucuccaaggacaacagcaagaacacccuguuccugcagaugaacucccuccggguggaggacacggcgcuguacuucugcgugaaggaccagcgcgaggacgagugcgaggagugguggagcgacuacuacgacuucgggcgggagcugcccugccgcaagucccggggccucgggcuggccggcaucuucgacaugugggggcacggcaccauggucaccgugagcucc

SEQ ID NO: 9435 - RNA, 432 nt, Artificial Sequence
  derived and/or modified sequence opt1 from anti-HIV_cap256-119-141307_VR-Chain
caggugcaccuggucgagagcggcgggggcguggugcagcccgggcgcucccuccggcugagcugcgccgccucccaguucaccuucaaccgcuacggccugcacuggguccggcaggcgccggggaagggccucgaguggguggccggcaucagcuacgacgggcgcgacaaguaccacgcccacuucguguggggccgguucaucaucucccgcgacaacagcaagaacacccuguaccugcagaugaacucccuccgggccgaggacacggcccuguacuacugcguccgcgaccugcgggagagcgagugcgagcucugggaguccgacuacuacgacuucgggaagcgccugcccugcgugaagccccggggcguggcggggaccuucgaccuguggggccagggcaccauggucaccgugagcucc

SEQ ID NO: 9436 - RNA, 432 nt, Artificial Sequence
  derived and/or modified sequence opt1 from anti-HIV_cap256-119-140896_VR-Chain
gaggugaagcuggucgagagcggcgggggccucgugcagcccgggggcucccugaagcugagcugcgccgccuccggguucaccuucagcuacuacgcgaugcacugggugcgccaggccccgggcaagggccucgagugggucgccgugaucuccuacgacgggagcgacaaguacuacgccgacuccgugaagggccgguucaccaucagccgcgacaacuccaagaacacgcugcaccuccagaugaacagccugcggcccgaggacaccgcccuguacuucugcgcgcgcgaccugcgggaguccgagugcgaggagugggagagcuacuacuacgacuucgggaagaagggccccugcgucaagccccgcgggguggugggcguccucgacaucuggggccaggggacccuggugaccguguccagc

SEQ ID NO: 9437 - RNA, 432 nt, Artificial Sequence
  derived and/or modified sequence opt1 from anti-HIV_cap256-119-140090_VR-Chain
gaggugcagcuggucgagagcggcgggggccucgugcagcccgggggcucccugcgccugagcugcgccgccuccggguucgcguucagcuccuacuggaugaccugggugcggcaggccccgggcaagggccucgagugggucgccgugaucagcuacgacggguccaacaaguacuacgccgacagcgugcgcggccgguucaccaucucccgcgacagcuccaagaacacgcuguaccuggagaugaacagccuccggcccgaggacaccgcccuguacuacugcgcgaaggacaugcgcggguacgagugcgaggaguggaccuccgacuacuacgacuucggccggccccagcccugcaucgacagccgcggggucgugggcaccuucgacguguggggccaggggacgauggucaccguguccagc

SEQ ID NO: 9438 - RNA, 438 nt, Artificial Sequence
  derived and/or modified sequence opt1 from anti-HIV_cap256-119-140037_VR-Chain
caggugcagcuggucgagagcggcgggggccucgugcagcccgggcgcucccugcggcugagcugcgccgccuccggcuucaccuucgacgacuacgugaugcacuggguccgccaggcgccggggaagggccucgaguggguggccagcaucuccaacgacggcaccaagaaguaccacgaggagagcgugugggggcgguucacgaucuccaaggacaacagcaaguccacccuguuccugcagaugaacagccuccgcaucgaggacaccgcccuguacuucugcgucaaggaccagcgggaggacgagugcgaggaguggugguccgacuacuacgacuucggccgcgagcugcccugccgcaagagccgggggcucggccuggccgggaucuucgacauguggggccacggcaccauggugacgguguccagc

SEQ ID NO: 9439 - RNA, 432 nt, Artificial Sequence
  derived and/or modified sequence opt1 from anti-HIV_cap256-119-139135_VR-Chain
gaggugcagcuggucgagagcggcgggggcguggugcgccccgggggcuccguccggcucagcugcguggccuccggguucagcuuccgcuccuacggcaugcacugggugcggcaggccccgggcaaggggcuggagugggucgcgagcaucuccuacgacggccgcgacuucuaccacgcccggagcgugugggggcgcuucaccaucucccgggacaacagcaagaacacccugcaccuccagaugaacucccugcgccccgaggacacggcccuguacuucugcgcccgggaccuccgcgagagcgagugcgaggagugggaguccuacuacuacgacuucggcaagaaggggcccugcgugaagccccggggcgucgugggcgugcuggacaucugggggcagggcacccuggucaccgugagcucc

SEQ ID NO: 9440 - RNA, 438 nt, Artificial Sequence
  derived and/or modified sequence opt1 from anti-HIV_cap256-119-137881_VR-Chain
caggugcagcuggucgagagcggcgggggccucgugaagcccgggcgcucccugacccugagcugcgccgccucccaguucaccuucagcaacuacggcaugcacugggugcggcaggcgccggggaagggccucgagugggucgccuccaucagcaacgacggcaacaagaaguaccacggggacuccgugugggcccgcuucacgaucagccgggacaacuccaagaacacccuguuccugcagaugagcucccuccgcaccgaggacaccgcccuguacuucugcgugcgggaccgccgggaggacgagugcgaggagugguggagcgacuacuacgacuucggccgcgagcugcccugccggaaguuccgcgggcucggccuggccgggaucuucgacaucuggggccacggcacgauggucaccguguccagc

SEQ ID NO: 9441 - RNA, 432 nt, Artificial Sequence
  derived and/or modified sequence opt1 from anti-HIV_cap256-119-137643_VR-Chain
gaggugcagcuggucgagagcggcggggaccucgugcagcccggcgggucccugcggcugagcugcgccgccuccggcuucagcuucuccagcuacgggaugcacugggugcggcaggcgccggacaagggccucgagugggucaccgugaucuccuacgacggcagcaacaagcacuacgccgacuccgugaaggggcgcuucaccaucagccgggacaacuccaagaacacgcuguaccuggagaugaacacccuccgcgccgaggacaccgcccuguacuacugcgccaaggaccugcgggaguacgagugcgaggaguggaccagcgacuacuacgacuucggccgcccccagcccugcaucgacucccgcggggucgugggcauccucgacaucugggggcagggcacgauggugagcgucuccagc

SEQ ID NO: 9442 - RNA, 438 nt, Artificial Sequence
  derived and/or modified sequence opt1 from anti-HIV_cap256-119-137170_VR-Chain
caggugcagcuggucgagagcggcgggggcguggugcagcccgggcgcucccuccggcugagcugcgccgccuccgaguucaccuucagccgcuacuccaugcacuggguccggcaggcgccgggcaaggggcuggaguggguggccgugaucagcuccgacggcagcaaccaguuccacgccgacuccgucuggggccgcuucaccaucagcaaggacaacuccaagaacacccucuuccugcagaugaacagccugcggaucgaggacacggcccucuacuucugcgugaaggaccagcgcgaggacgagugcgaggaguggugguccgacuacuacgacuucgggcgggagcugcccugccgcaagagccggggccuggggcucgccggcaucuucgacaugugggggcacggcaccauggugaccgucuccagc

SEQ ID NO: 9443 - RNA, 432 nt, Artificial Sequence
  derived and/or modified sequence opt1 from anti-HIV_cap256-119-136616_VR-Chain
caggugcagcuggucgagagcggcgggggcguggugcagcccgggcgcucccuccggcugagcugcgccgccuccggcuucaccuucagccgcaacgcgaucaacuggguccggcaggccccggggcgcggccuggaguggguggccgugaucuccgacgacggcagccucaaguacuacgccgacuccgucaaggggcgguucaccaucagccgcgacaacuccaagaacacgcuguaccugcagaugaacaaccuccggcccgaggacaccgcccuguacuacugcgugcgcgaccggcgcgagagcgagugcgaggagcggugguccgacuacuacgacuucggcaagcagcugcccugcgugaagccccgcggggucgcgggcaucuucgacaucugggggcagggcaccauggugaccgugagcucc

SEQ ID NO: 9444 - RNA, 432 nt, Artificial Sequence
  derived and/or modified sequence opt1 from anti-HIV_cap256-119-136206_VR-Chain
caggugcagcuggucgagagcggcgggggcguggugcagcccgggcgcucccuccggcugagcugcgccgccucccaguucaccuucggccgcuacgggaugcacuggguccggcaggcgccgggcaagggccuggaguggguggccgccaucagcuucgccgggaccaagaaguacuacggcgacuccgcccgcgggcgguucacgaucagccgcgacaacuccaagaacaugcuguuccuccagaugaacagccugcgggcggaggacaccgcccucuacuacugcgcccgcgaccugcgggacuacgagugcgaggagugggaggccuacuacuacgacuucggccgcguggggcccugcaccgacccccggggcgucgugggcauccuggacgugugggggcagggcacccucgucacgguguccagc

SEQ ID NO: 9445 - RNA, 438 nt, Artificial Sequence
  derived and/or modified sequence opt1 from anti-HIV_cap256-119-135565_VR-Chain
caggugcaccuggucgagagcggcgggggcguggugcagcccgggaagucccuccgccugagcugcgccgccucccaguucaccuucgaccgguacggcaugcacuggguccgccaggcgccggggaagggccuggaguggguggccagcaucuccaacgacggcaccgacaaguaccacgccgacaacgugugggggcgguucacgaucagccgcgacaacuccaagaacacccucuaccuggagaugaacagccugcggggcgaggacaccgcccucuacuucugcgucaaggaccagcgcgaggacgagugcgaggaguggugguccgacuacuacgacuucgggcgggagcugcccugccgcaagagccggggccuggggcucgccggcaucuucgacauguggggccacgggaccauggugacgguguccagc

SEQ ID NO: 9446 - RNA, 432 nt, Artificial Sequence
  derived and/or modified sequence opt1 from anti-HIV_cap256-119-135025_VR-Chain
gaggugcagcuggucgagagcggcgggggccucgugcagcccgggggcucccugcgccugagcugcgaggccuccggguucaccuucaacaccuacgagaugaacugggugcggcagccgcccggccgcggccucgagugggucgccgggaucagcuucgcggccacgaagaccuacuacggcggguccgugaagggccgguucaccgugagccgcgacaucuccaagaacacccuguaccugcagauggacgggcuccggggcgaggacacggcccuguacuacugcgccaaggaccugcgcgagcucgagugcgaggagugggccagcgacuacuacgacuucggccggccccagcccugccuggacccgcgcggggucuccggcaucagcaacgugugggggcagggcaccauggugaccgucuccagc

SEQ ID NO: 9447 - RNA, 432 nt, Artificial Sequence
  derived and/or modified sequence opt1 from anti-HIV_cap256-119-133983_VR-Chain
cagaugcagcugguggagagcggcgggggcgucgugcagcccgggcggucccucacccugagcugcgccgccucccaguucaacuucgcgaacuacggcaugcacugggugcggcaggccccggggaagggccuggagugggucgccagcaucuccaacgacggcaccaagaaguaccacgaggagagcgugugggggcgcuucacgaucuccaaggacaacagcaagaacacccucuuccugcagaugaacucccugcggcccgaggacaccgcccucuacuacugcgccaaggaccugcgcgaggacgagugcgaggagcgguggagcgacuacuacgacuucggcaagcagcugcccugccgcaagucccgcgggguggcgggcgucuucgacaacugggggcagggcaccauggugacggugagcucc

SEQ ID NO: 9448 - RNA, 438 nt, Artificial Sequence
  derived and/or modified sequence opt1 from anti-HIV_cap256-119-133917_VR-Chain
cagaugcagcugguggagagcggcgggggcgucgugcagcccgggcgcucccucacccugagcugcgccgccucccaguucaccuucagcaacuacggcaugcacugggugcggcaggcgccggggaagggccuggagugggucgccuccaucagcaacgacggcuccaagaaguaccacggggacagcgugugggcccgcuucacgaucucccgggacaacagcaagaacacccucuuccugcagauguccagccugcgcguggaggacaccgcccucuacuucugcguccgggaccagcgcgaggacgagugcgaggaguggugguccgacuacuacgacuucggccgggagcugcccugccgcaaguuccgggggcugggccucgccgggaucuucgacaucuggggccacggcaccauggugacggugagcucc

SEQ ID NO: 9449 - RNA, 432 nt, Artificial Sequence
  derived and/or modified sequence opt1 from anti-HIV_cap256-119-132663_VR-Chain
caggcccagcugguggagagcggcgggggcgucgugcagcccgggcgcucccuccggaucagcugcgccgugucccaguucaccuucagccgcuacggcaugcacuggguccggcaggcgccggggaagggccuggaguggguggccuccaucagcuucgacggccgcgacaaguaccacagcccccuggugugggggcggcucaccaucucccgcgacaacuccaagaacacgcuguuccuggagaugaacagccuccgggccgaggacaccgccgucuacuacugcgcccgcgaccugcgggaguccgagugcgaggaguggcagagcgacuacuacgcguucuacaagaagcugcccugcgugaagccccgcggcguggccgggucccucgacaucuggggccaggggaccgucgugaccgugagcucc

SEQ ID NO: 9450 - RNA, 438 nt, Artificial Sequence
  derived and/or modified sequence opt1 from anti-HIV_cap256-119-132113_VR-Chain
caggugcagcuggucgagagcggcgggggccucgugaagcccgggggcucccugcgccugagcugcgccgccucccaguucaacuucgcgaacuacgggaugcacugggugcggcaggccccgggcaagggccucgagugggucgccagcaucuccaacgacgggaccaagaaguaccacgaggagagcguguggggccgcuucaccaucuccaaggacaacagcaaguccacgcuguuccugcagaugaacagccuccggaucgaggacaccgcccuguacuucugcgugaaggaccagcgcgaggacgagugcgaggaguggugguccgacuacuacgacuucgggcgggagcugcccugccgcaagagccggggccucgggcuggccggcaucuucgacauguggggccacgggaccauggucaccguguccagc

SEQ ID NO: 9451 - RNA, 432 nt, Artificial Sequence
  derived and/or modified sequence opt1 from anti-HIV_cap256-119-131839_VR-Chain
caggugcagcuggucgagagcggcgggggcguggugcagcccgggcggucccuccggcugagcugcgccgccuccggcuucaccuucagcuccuacgcgaugcacuggguccgccaggccccggggaagggccuggaguggguggccgugaucagcuacgacggcuccaacaaguacuacgccgacagcgucaaggggcgguucaccaucucccgcgacaacagcaagaacacgcucuaccugcagaugaacucccugcgggccgaggacaccgcgguguacuacugcgcccgcgaccagcgguacuacgagugcgaggagugggccagcgacuacuacgacuucggccgcgagcagcccugccaggacccccgcgggguggucggcguguucgacaugugggggcagggcaccauggugaccgucuccagc

SEQ ID NO: 9452 - RNA, 435 nt, Artificial Sequence
  derived and/or modified sequence opt1 from anti-HIV_cap256-119-130626_VR-Chain
gaggugcagcuggucgagagcggcgggggccucauccaccccgggggcugccugcgccuguccugcgccgugagcggguucaccuucuccgacuacccgaugcacugggugcggcagagccccggcaagggccucgagugggucgccgugaucuccuacgacgggaucaacuacuacuacgcggacagcgugaagggccgcuucaccaucucccgggacaacagcaagaacaaccuguuccugcagaugaacucccuccgccuggaggacacggcccuguacuacugcgcccgggaccuccgcgagcuggacugcgaggaguggacccuguacaacuacuacgacuucgggagccggggccccugcgucgacccccgcggggugggcggcuccuucgacgugugggggcagggcaccauggucaccgugagcucc

SEQ ID NO: 9453 - RNA, 438 nt, Artificial Sequence
  derived and/or modified sequence opt1 from anti-HIV_cap256-119-130191_VR-Chain
gaggugcagcuggucgagagcggcgggggccucauccagcccgggcgcucccugcggcugagcugcgccgccuccggcuucaccgugagcuccaacuucaugaccugggugcgccaggcgccggggaagggccucgagugggucgccagcaucuccaacgacggcacgaagaaguaccacgccgagagcgugugggaccgguucuccaucagcaaggacaacuccaagaacacccuguuccugcagaugaacagccuccgcguggaggacaccgcccuguacuucugcgucaaggaccagcgggaggacgagugcgaggaguggugguccgacuacuacgacuucgggcgcgagcugcccugccgcaagagccggggccucgggcuggccggcaucuucgacaugugggggcacggcaccauggugacgguguccagc

SEQ ID NO: 9454 - RNA, 438 nt, Artificial Sequence
  derived and/or modified sequence opt1 from anti-HIV_cap256-119-129798_VR-Chain
caggugcagcuggucgagagcggcgggggcguggugcagcccgggaagucccuccgccugagcugcgccgccuccggcuucaucuucagcuccuacuucaugcacuggguccggcaggcgccggggaagggccuggaguggguggccguggucaccgacgacggcagcaagaaguacuacgccgacuccgugaaggggcgcuucaccaucagccgggacuacuccaagaacacccucuuccugcagaugaaccgccugcggguggaggacacggcccucuacuucugcgucaaggaccagcgcgaggacgagugcgaggagugguggagcgacuacuacgacuucggccgggagcugcccugccgcaaguuccgggggcugggccucgccgggaucuucgacauguggggccacggcaccauggugaccguguccagc

SEQ ID NO: 9455 - RNA, 432 nt, Artificial Sequence
  derived and/or modified sequence opt1 from anti-HIV_cap256-119-128745_VR-Chain
caggugcagcuggucgagagcggcgggggcguggugcagcccgggcgcucccuccggcugagcugcgccgccuccggcuucaccuucagcaacuacgcgaugcacuggguccgccaggccccggggaagggccuggaguggguggccuccaucagcuucgccggcaccaagacgcacuacgggaacuccgugaagggccgguucagcaucucccgcgacaacagcaucaacaccgucuaccuccagaugaacucccugcgggccgaggacaccgcgcuguacuacugcgccaaggaccuccgcgaguacgagugcgaggaguggaccagcgacuacuacgacuucgggcggccccagcccugcaucgacucccgcggcgugguggggauccuggacaucuggagccagggcacgauggucaccguguccagc

SEQ ID NO: 9456 - RNA, 438 nt, Artificial Sequence
  derived and/or modified sequence opt1 from anti-HIV_cap256-119-128593_VR-Chain
caggugcagcuggucgagagcggcgggggcguggugcagcccgggcgcucccuccggcugagcugcgccgccuccggcuucaccuucagcuccuacgcgaugcacuggguccgccaggccccggggaagggccuggaguggguggccagcaucuccuacgacggccgggacuucuaccacgcccgcagcgugugggggcgguucaccaucucccgcgacaacagcaagaacacgcuccaccuccagaugaacucccugcgggucgaggacaccgcccuguacuucugcgugaaggaccagcgcgaggacgagugcgaggagugguggagcgacuacuacgacuucggccgggagcugcccugccgcaagucccgggggcugggccucgcggggaucuucgacaucuggggccacggcaccauggugaccgucagcucc

SEQ ID NO: 9457 - RNA, 438 nt, Artificial Sequence
  derived and/or modified sequence opt1 from anti-HIV_cap256-119-128152_VR-Chain
caggugcagcuggucgagagcggcgggggcguggugcagcccgggcgcucccuccggcugagcugcgccgucuccggcuucaccuucaccagcuacccgaugcacugggugcgccaggcccccgggaagggccuggaguggguggcguccgucagcaacgacggcacgaagaaguaccacggggacuccgugugggaccgguucaccaucagccgcgacaacuccaagaacacccucuuccugcagaugagcucccugcgggccgaggacaccgccguguacuucugcguccgcgacgagcgggaggacgagugcgaggagugguggagcgacuacuacgacuucggccgcgagcuccccugccggaaguuccgcgggcugggccuggccgggaucuucgacaucuggggccacggcacgcucgugaccguguccagc

SEQ ID NO: 9458 - RNA, 438 nt, Artificial Sequence
  derived and/or modified sequence opt1 from anti-HIV_cap256-119-127693_VR-Chain
gaggugcagcugcucgagagcggcgggggccugguccagcccgggggcucccugcgccucagcugcgccgccuccggguucaccuucagcuccuacgcgauggccugggugcggcaggccccgggcaagggccuggaguggguggccagcaucuccaacgacgggagcaagaaguaccacggcgacuccgucugggcccgcuucaucaucagccgggacaacuccaagaacacccuguuccuccagaugagcucccugcgcguggaggacacggcgcuguacuucugcgugcgggaccaccgcgaggacgagugcgaggagugguggagcgacuacuacgacuucgggcgggagcuccccugccgcaaguuccggggccuggggcuggccggcaucuucgacaucuggggccacgggaccauggucaccguguccagc

SEQ ID NO: 9459 - RNA, 432 nt, Artificial Sequence
  derived and/or modified sequence opt1 from anti-HIV_cap256-119-126684_VR-Chain
caggugcagcuggucgagagcggcgggggcgccgugcggcccgggcggucccuccgccugagcugcgccaccuccggcuucaccuucagcaacuacgcgaugcacugggugcggcaggccccggggaagggccuggagugggucacgggcaucuccuucgccgggaccaagaccuacuacggcgacagcgugcgcgggcgguucaccgugucccgcgacaucagcaagaacacccucuuccugcagaugaacucccugcggcccgacgacacggccauguacuacugcgcccgcgaccagcgguacuacgagugcgaggagugggcgagcgacuacuacgacuucggccgcgagcagcccugccucgacccccgcggggucgugggcaucuucgaccuguggggccaggggaccauggugaccgucuccagc

SEQ ID NO: 9460 - RNA, 438 nt, Artificial Sequence
  derived and/or modified sequence opt1 from anti-HIV_cap256-119-126056_VR-Chain
gaggugcagcuggucgagagcggcgggggccucgugcagcccgggggcucccugcgccugagcugcgccgacuccggguucaccuucagcuccuacuggaugagcugggugcggcaggccccgggcaagggccucgagugggucgcguccaucagcaacgacgggaccaagaaguaccacgccgaguccgugugggaccgcuucagcaucuccaaggacaacagcaagaacacgcuguuccugcagaugaacucccuccggguggaggacaccgcccuguacuucugcgucaaggaccagcgcgaggacgagugcgaggagugguggagcgacuacuacgacuucggccgggagcugcccugccgcaagucccgggggcucggccuggccgggaucuucgacauguggggccacggcaccauggugaccgugagcucc

SEQ ID NO: 9461 - RNA, 432 nt, Artificial Sequence
  derived and/or modified sequence opt1 from anti-HIV_cap256-119-125765_VR-Chain
caggugcagcugguccagagcggcgggggcguggugcagcccgggcgcucccuccggcugagcugcgccgccuccggcuucaccuucagcuccuacgucaugcacugggugcgccaggcgccggggaagggccuggagggcguggccgucaucagcuucgacgggaacaacgaguacuacgccgacuccgugaagggccgguucaccaucagccgcgacaacuccaagaacacgguguaccuccagaugaacagccugcgggucgaggacaccgcccuguacuacugcgccaaggacaugcgcgaguacgagugcgaggaguggaccuccgacuacuacgacuucgggcggccccagcccugcaucgacagccgcggcgugguggggauccucgacaucuggggccagggcaucauggucaccguguccagc

SEQ ID NO: 9462 - RNA, 438 nt, Artificial Sequence
  derived and/or modified sequence opt1 from anti-HIV_cap256-119-125106_VR-Chain
caggugcagcuggucgagagcggcgggggcguggugcagcccgggcgcucccuccggcugagcugcgccgccuccggcuucaucuuccgcagcuacgggaugcacuggguccggcaggcgccgggcaagggccuggaguggguggccuccaucagcaacgacgggaccaagcgcuaccacgccgaguccgugugggaccgguucagcaucuccaaggacaacagcaagaacacccucuuccugcagaugaacucccugcgcgucgaggacacggcccucuacuucugcgugaaggaccagcgggaggacgagugcgaggagugguggagcgacuacuacgacuucggccgcgagcugcccugccggaagucccgcgggcugggccucgccgggaucuucgacauguggggccacggcaccauggugaccgucagcucc

SEQ ID NO: 9463 - RNA, 435 nt, Artificial Sequence
  derived and/or modified sequence opt1 from anti-HIV_cap256-119-124026_VR-Chain
caggugcagcuggucgagagcggcgggggcguggugcaguccgggcgcagccuccggcugaccugcuccggcagcgccuuccgcuucuccagcuacaccguccacugggugcggcaggcccccgggaagggccuggaguggcucgcgcugaucuccuacgacggccagaagaagcacuucgccgacagcgugaaggggcgcuucacgaucucccgggacaacagcaagaacaaccuguuccuccagaugaacucccugcgccuggaggacaccgcccucuacuacugcgcccgggaccugcgcgagcuggacugcgaggaguggacccucuacaacuacuacgacuucggcagccgggggccgugcgucgacccccgcggcgucgggggcuccuucgacguguggggccaggggaccauggugacggugagcucc

SEQ ID NO: 9464 - RNA, 432 nt, Artificial Sequence
  derived and/or modified sequence opt1 from anti-HIV_cap256-119-121783_VR-Chain
cugggccgccucguggccagcgggggcggggucgugcccccgggcgggucccugacccugagcugcgugaccucccaguucacguucagcggcugcggccuccacuggguccggcaggcccccgggaagggccuggaguggguggcguccaucagcuucgccgggaccaagaagcacuacggcuccagcgugcgcgggcgguucuccaucagccgcgacaacuccaagaacacccuguaccuccagaugaacagccugcggaccgaggacacggcccuguacuucugcgccaaggaccuccgcgaguacgagugcgaggaguggaccuccgacuacuacgacuucggccggccccagcccugcaucgacagccgcggcgucguggggauccuggacaucuggggccaggggaccauggugaccgucuccagc

SEQ ID NO: 9465 - RNA, 432 nt, Artificial Sequence
  derived and/or modified sequence opt1 from anti-HIV_cap256-119-121208_VR-Chain
cugggccgccucguggccagcgggggcggggucgugcccccgggcaagucccugacccugagcugcguggccucccaguucaccuucagcgggugcggccuccacuggguccggcaggcgcccggcaaggggcuggaguggguggccuccaucagcuucgccggcacgaagaagcacuacgggaacuucgugcgcggccgguucaccaucucccgcgacaacagcaagaacacccuguaccuccagaugaacucccugcgggccgaggacaccgcccuguacuacugcgcgaaggaccuccgcgaguacgagugcgaggaguggacgagcgacuacuacgacuucgggcggccccagcccugcaucgacucccgcggcgucgugggcauccuggacaucugggggcagggcaccauggugaccgucagcucc

SEQ ID NO: 9466 - RNA, 432 nt, Artificial Sequence
  derived and/or modified sequence opt1 from anti-HIV_cap256-119-120945_VR-Chain
caggugcagcuggucgagagcggcgggggcguggugcagcccgggggcucccuccgccugagcugcgucgccuccggguucaccuucagcaacuacggcaugcacugggugcggcaggccccgggcaaggggcuggcguggguggccuucauccgcuacgacggcuccaacaaguacuacgucgacagcgugugggggcgguucaccaucucccgcgacaacagcaagaacacgcuccaccuccagaugaacucccugcggcccgaggacaccgcccuguacuucugcgcccgcgaccugcgggagagcgagugcgaggagugggaguccuacuacuacgacuucggcaacaaggggcccugcgugaagccccgcggcgucgugggcgugcuggacaucugggggcagggcacccucgucaccgugagcucc

SEQ ID NO: 9467 - RNA, 432 nt, Artificial Sequence
  derived and/or modified sequence opt1 from anti-HIV_cap256-119-118229_VR-Chain
caggugcaggucguggagagcggcgggggcgugguccagcccgggcgcucccugcggcucagcugcgccgccuccggcuucaccuucagcaacuacgcgauccacugggugcgccaggccccggggaagggccuggaguggguggcccugaucuccuacgacggcuacaacaaguacuacgccgacagcguccgggggcgcuucaccaucucccgggacaacagcaacaacacgguguaccuccagaugaacucccugaagcccgaggacaccgccguguacuacugcgcgcgcgaccugcgggagagcgagugcgaggagugggaguccuacuacuacgacuucggcaagaaggggcccugcgucaagccccgcggcgugguggggguccucgacaucuggggccagggcacccuggugaccgugagcucc

SEQ ID NO: 9468 - RNA, 432 nt, Artificial Sequence
  derived and/or modified sequence opt1 from anti-HIV_cap256-119-118025_VR-Chain
gaggugcagcuggucgagagcggcgggggcguggugcagcccgggaagucccuccggcugagcugcaccgccucccaguucaccuucagcaacuucggcaugcacuggguccggcaggccccggggaagggccuggaguggguggcguccaucagcuucgugggcaucaagacgcacuacgccaacuccguccgcgggcgguucaccaucagccgcgaccaguccaagaacacccucuaccugcagaugaacagcgugcggaucgaggacaccgcccgcuacuucugcgcccgggacaugcgcgaguacgagugcgagcugugggccuccgacuacuacgacuucggcaagccccagcccugcgaggacccccgcgggguggucggcacguucgacaugugggggcucggcacccuggugaccgugagcucc

SEQ ID NO: 9469 - RNA, 432 nt, Artificial Sequence
  derived and/or modified sequence opt1 from anti-HIV_cap256-119-117418_VR-Chain
caggugcagcuggucgagagcggcgggggcguggugcagcccgggcgcucccuccggcugagcugcgccgccuccggcuucaacuuccgcaacuacgacaucaacuggguccgccaggugccggggaagggccuggaguggguggcggccaucagcuucgacggcgccgacaaguaccacgccgacaacgucugggggcggcucuccaucagccgggacaacuccaagagcacccuguaccugcagaugaacucccuccgccccgaggacaccgccguguacuucugcgcgaaggaccugcgggaggacgagugcgaggagcgcuggagcgacuacuacgacuucggcaagcagcugcccugccggaagucccgcgggguggccggcaucuucgacaacugggggcagggcacgauggucaccgugagcgcc

SEQ ID NO: 9470 - RNA, 432 nt, Artificial Sequence
  derived and/or modified sequence opt1 from anti-HIV_cap256-119-117250_VR-Chain
caggugcgccuggucgagagcggcgggggcguggugcagcccgggggcucccuccggcugagcugcgccgccucccaguucaccuucagcgcguacgggaugcacuggguccgccaggccccgggcaagggccuggaguggguggccuccaucagcuucgacgggaccgacaaguuccacgccgacaagguguggggccggcucgucaucucccgcgacaacagcaagaacacgcuguaccugcagaugaacucccuccggcccgaggacaccgccguguacuacugcgcgaaggaccugcgcgaggacgagugcgaggagcgguggagcgacuacuacgacuucgggaagcagcugcccugccgcaagucccggggcguggccggggucuucgacaacuggggccagggcaccauggugaccgugagcucc

SEQ ID NO: 9471 - RNA, 432 nt, Artificial Sequence
  derived and/or modified sequence opt1 from anti-HIV_cap256-119-117230_VR-Chain
caggugcagcuggucgagagcggcgggggcggggugcagcccggccgcucccuccggcugagcugcgccgccuccggguucacccugagcuccuacggcaugcacugggugcgccaggcgccgggcaaggggcucgagugggucgccagcaucuccuucgacggccgggacuacuaccacagcccccacgugugggggcgccugaccaucucccgggacaacagcaagaacacgcuguaccuccagaugaacucccugcgcgccgaggacaccgcccuguacuacugcgcccgggaccuccgcgagagcgagugcgaggagugggaguccgacuacuacgacuucggcaagaaggggcccugcgugaagccccggggcgucgcgggcagccuggacaugugggggcagggcaccauggugaucguguccagc

SEQ ID NO: 9472 - RNA, 432 nt, Artificial Sequence
  derived and/or modified sequence opt1 from anti-HIV_cap256-119-116999_VR-Chain
caggugcagcuggucgagagcggcgggggcguggugcagcccgggaccucccuccgcaucagcugcgccgccucccaguucaccuucagccgguacggcaugcacuggguccgccaggcgccggggaagggccuggaguggguggccuccaucagcuacgacggccgggacuacuaccacgccgggcgcguguggggccgguucacgaucucccgcgacaacagcaagaacacccuguaccuccagaugaacucccugcggcccgaggacaccgcccuguacuucugcguccgcgacagccgggaguccgagugcgaggagugggagagcgacuacuacgacuucgggaagaagcuccccugcgugaagccccgcggcguggucggggugcuggaccuguggggccagggcacccucgugacggucuccagc

SEQ ID NO: 9473 - RNA, 432 nt, Artificial Sequence
  derived and/or modified sequence opt1 from anti-HIV_cap256-119-116558_VR-Chain
caggugcagcuggucgagagcggcgggggcguggugcagcccgggcgcucccuccggcugagcugcgccgccuccggcuucaccuucaaccgcuacagccugcacuggguccggcaggcgccggggaagggccucgaguggguggccuucaccuccuacgacggcagcaacaaguacuaccccgacuccgugaaggggcgcuucacgaucagccgggacuccagcaagaacacccuguaccuggagaugaacucccuccgccccgaggacaccgcccuguacuacugcgccaaggacaugcggggcuacgagugcgaggaguggaccagcgacuacuacgacuucgggcgcccccagccgugcaucgacucccggggcgucguggggacguucgacguguggggccagggcaccauggucaccgugagcucc

SEQ ID NO: 9474 - RNA, 432 nt, Artificial Sequence
  derived and/or modified sequence opt1 from anti-HIV_cap256-119-116484_VR-Chain
gacgugcagcugcucgagagcggcggggaccugguccagcccggcgggucccugcggcucagcugcgccgccuccggcuucaccuucaccaaguacgagaugacgugggugcggcaggcgccggggaagggccuggaguggguggccagcaucuccuacgacggcagcgacaaguaccacaccuccagccugugggggcgcuucaucgucucccgggacaacagcaagaacacccucuaccugcagaugaacucccugcgccccgaggacaccgcccucuacuacugcgugcgggaccgccgggagagcgagugcgaggagcgcugguccgacuacuacgacuucggcaagcagcugcccugcgugaagccccgcggggucgccggcaucuucgacaucugggggcagggcacgauggugaccgugagcucc

SEQ ID NO: 9475 - RNA, 438 nt, Artificial Sequence
  derived and/or modified sequence opt1 from anti-HIV_cap256-119-114844_VR-Chain
gaggugcagcuggucgagagcggcggggaccucgugcagcccggccgcucccugcggcugagcugcgccgccuccggguucaccuucagcuccuacuggaugagcugggugcgccaggcgccgggcaaggggcucgagugggucgccuccaucagcaacgacggcaccaagaaguaccacgaggaguccguguggggccgguucacgaucagcaaggacaacuccaagagcacccuguuccugcagaugaacucccuccgcguggaggacaccgcccuguacuucugcgucaaggaccagcgggaggacgagugcgaggagugguggagcgacuacuacgacuucgggcgcgagcugcccugccggaagucccgcggccucgggcuggccggcaucuucgacaugugggggcacggcaccauggugacggugagcucc

SEQ ID NO: 9476 - RNA, 438 nt, Artificial Sequence
  derived and/or modified sequence opt1 from anti-HIV_cap256-119-114141_VR-Chain
ggcgggcgcagcggcgggggcggggugggcaccacgccccggcgcggcccgcugcggcucuccugcgccgccagcggguucacccuggacgacuacgcgaugcacuggguccgccaggcccccggcaaggggcuggaguggguggccuccaucagcaacgacggcaccaagaaguaccacgccgaguccgugugggaccgguucagcaucuccaaggacaacagcaagaacacccucuuccugcagaugaacucccugcgcgucgaggacaccgcccucuacuucugcgugaaggaccagcgggaggacgagugcgaggagugguggagcgacuacuacguguucugggagcgcgcgcccugccggacgguccccgggcgcggcccgggcugguacuucgacaugguggggcggcgcaccauggugaccgucuccagc

SEQ ID NO: 9477 - RNA, 432 nt, Artificial Sequence
  derived and/or modified sequence opt1 from anti-HIV_cap256-119-111917_VR-Chain
gaggugcaccuggucgagagcggcgggggccucgugcagcccgggggcucccugcgccugagcugcgccgccuccggguucaccuucagcuccuacggcaugcacugggugcggcaggcgccgggcaaggggcucgagugggucgccaccaucagcuucgacggcgccgacaaguaccacgccgacgacgugugggggcgcuucuccaucagccgggacaacuccaagaacacgcuguaccugcagaugaacaaccuccgccccgaggacaccgcccuguacuacugcgcgaaggaccugcgggaggacgagugcgaggagcgcuggagcgacuacuacgacuucggcaagcagcuccccugccggaagucccgcgggguggccggcgucuucgacaacuggggccaggggaccauggugaccgugagcucc

SEQ ID NO: 9478 - RNA, 432 nt, Artificial Sequence
  derived and/or modified sequence opt1 from anti-HIV_cap256-119-111862_VR-Chain
caggugcagcuggucgagagcggcgggggcguggugcagcccgggggcucccuccgccugagcugcgccgccuccggguucaccuacagcgacuacggcaugcacuggguccggcaggcgccgggcaaggggcuggaguggguggccuccaucagcuucgccggcaccaagcagcacuacgggaacuccgugaagggccgcuucacgaucagccgggacaacuccaagaacaccgucuaccuccagaugaacagccugcgcguggaggacaccgcccuguacuacugcgccaaggacaugcgggaguacgagugcgaggaguggaccuccgacuacuacgacuucgggcgcccccagcccugcaucgacagccggggcguggucggcauccucgacaucugggggcagggcaucauggugacgguguccagc

SEQ ID NO: 9479 - RNA, 432 nt, Artificial Sequence
  derived and/or modified sequence opt1 from anti-HIV_cap256-119-110064_VR-Chain
cugggccgccucguggccagcgggggcggggucgugcccccgggccggucccugcgccugagcugcguggccucccaguucaccuucagcgggugcggccuccacuggguccggcaggcgcccggcaaggggcuggaguggguggccuccaucagcuucgccggcaccaagcagcacuacgggaacuccgugaagggccgcuucacgaucagccgggacaacuccaagaacaccgucuaccugcagaugaacagccuccgcguggaggacaccgcccuguacuacugcgccaaggacaugcgggaguacgagugcgaggaguggaccuccgacuacuacgacuucgggcgcccccagcccugcaucgacagccggggcguggucggcauccuggacaucugggggcagggcacgauggugaccguguccuuc

SEQ ID NO: 9480 - RNA, 432 nt, Artificial Sequence
  derived and/or modified sequence opt1 from anti-HIV_cap256-119-109192_VR-Chain
caggugcagcuggucgagagcggcgggggcguggugcagcccgggcgcucccuccggcugagcugcgccgccuccggcuucaccuucagcaacuacgcgaugcacuggguccgccaggccccggggaagggccuggaguggguggccgugaucgccuacgacggcgacaacaaguacuacgccgacuccgucaaggggcgguucaccaucagccgcgacaacuccaagaacacgcucuaccugcagaugaacagccugcgggcggaggacaccgcccucuacuacugcgccaaggaccugcgcgaggacgagugcgaggaguggugguccgacuacuacgaccugggcaagcagcuccccugccggaagucccgcgggguggccggcgugcuggacaagugggggcugggcaccauggucaccgugagcagc

SEQ ID NO: 9481 - RNA, 435 nt, Artificial Sequence
  derived and/or modified sequence opt1 from anti-HIV_cap256-119-108793_VR-Chain
caguuccagcugguggagagcggcgggggcgucgugcagcccgggcgcucccuccggcugagcugcgccgccuccggcuucaccuucagcuccuacccgaugcacugggugcgccaggcgcccgggaagggccuggagugggucgcccucaucagcuacgacggcaccgacaaguacuacgccgacuccgugaaggggcgguucacgaucagccgcgacaacuccaagaacacccuguaccugcagaugaacagccuccggguggaggacaccgccgucuaccacugcgccaaggaccugggcggguccaagagcgacgagugggcgaccgacuacuacuacgacugguccaaggccuaccccgugcacgacccccgcgccguggucggcguguucgacaucugggggcagggcacgcuggugaccgucagcucc

SEQ ID NO: 9482 - RNA, 432 nt, Artificial Sequence
  derived and/or modified sequence opt1 from anti-HIV_cap256-119-108127_VR-Chain
caggugcagcuggucgagagcggcgggggcguggugcagcccgggcgcucccuccggaucagcugcgccgccucccaguucaccuucaaccgcuacggcaugcacuggguccggcaggcgccggggaagggccuggaguggguggccagcaucuccuacgacggcagcgacaaguaccacgccgggcugguguggggccgcuucaucaucucccgggacaacagcaagaacacccucuaccugcagaugaacucccugcgcgccgaggacacggcccucuacuacugcguccgggaccgccgggagagcgagugcgaggagcgcugguccgacuacuacgacuucgggaagcagcugcccugcgugaagccccggggcguggcggggaucuucgacaucuggggccagggcaccauggucaccgugagcucc

SEQ ID NO: 9483 - RNA, 438 nt, Artificial Sequence
  derived and/or modified sequence opt1 from anti-HIV_cap256-119-107758_VR-Chain
gaggugcagcuggucgagagcggcgggggccucgugaagcccgggggcucccugcgccugagcugcgccgccuccggguucaccuucagcaacgcguggauguccugggugcggcaggccccgggcaagggccucgagugggucgccagcaucuccaacgacgggaccaagaaguaccacgaggagagcguguggggccgcuucacgaucuccaaggacaacagcaagaacacccuguuccugcagaugaacucccuccggaucgaggacaccgcccuguacuucugcgugaaggaccagcgcgaggacgagugcgaggagugguggagcgacuacuacgacuucgggcgggagcugcccugccgcaagucccggggccucgggcuggccggcaucuucgacauguggggccacgggaccauggucacggugagcucc

SEQ ID NO: 9484 - RNA, 432 nt, Artificial Sequence
  derived and/or modified sequence opt1 from anti-HIV_cap256-119-107209_VR-Chain
gaggugcagcuggucgagagcggcgggggccucgugcagcccgggcggucccugcggcugagcugcaccgccuccggcuucaccuucggggacuacggcaugcacugggugcgccaggccccgggcaaggggcucgagugggucgcggccaucagcuucgacggcgccgacaaguaccacgccgacaacgugugggggcggcuguccaucagccgcgacaacuccaagagcacgcuguaccuccagaugaacucccugcggcccgaggacaccgccguguacuucugcgcgaaggaccugcgcgaggacgagugcgaggagcgguggagcgacuacuacgacuucggcaagcagcuccccugccgcaagucccgcggggucgccggcaucuucgacaacuggggccaggggaccauggugaccgugagcgcc

SEQ ID NO: 9485 - RNA, 432 nt, Artificial Sequence
  derived and/or modified sequence opt1 from anti-HIV_cap256-119-107184_VR-Chain
caggcccagcugguggagagcggcgggggcgucgugcagcccgggcgcucccucggccugagcugcgccgcguccaaguucagccuguccagcuacgggaugcacugggugcggcaggccccgggccgcggccucgagugggucgccgggaucuccuucgccggcaccaagaaguacuacgccgacagcgugcgggggcgcuucuccgugagcaccgacaucuccaagaacacgcuguaccugcagaugaacagccuccggcccgcggacaccgcccuguacuucugcgcccgcgaccugcgguacuacgagugcgaggagugggccuccgacuacuacgacuucggcaaggagcagcccugccucgacccccgcggggucgugggcaucuucgaccuguggggccaggggaccauggugaccgucagcucc

SEQ ID NO: 9486 - RNA, 438 nt, Artificial Sequence
  derived and/or modified sequence opt1 from anti-HIV_cap256-119-106827_VR-Chain
gccgugcagcuggucgagagcggcgggggccucgugcagcccgggggcucccugcgccugagcugcuccgugagccaguucaccuucgggcgguacggcauguacuggguccgccaggccccgggcaaggggcucgaguggguggcggugaucuccuacgacggcgggaaccgguacuacgccgacagcgucaagaaccgcuucuccaucagccgggacaacuccaagaacacccuguuccugcagaugagcucccuccgcgccgaggacacggcccuguacuucugcgugcgggaccaccgcgaggacgagugcgaggagugguggagcgacuacuacgacuucggccgggagcugcccugccgcaaguuccgggggcucggccuggccggcaucuucgacaucugggggcacggcaccauggugaccgucuccagc

SEQ ID NO: 9487 - RNA, 432 nt, Artificial Sequence
  derived and/or modified sequence opt1 from anti-HIV_cap256-119-106511_VR-Chain
caggugcagcuggucgagagcggcgggggcguggugcagcccgggcggucccuccggcugagcugcgucgccucccaguucagcuucgaccgcuacggcaugcacugggugcggcaggccccggggaagggccuggaguggguggcguccaucagcuucgacggcaccgacaaguaccacgccgacaaggucugggggcgcuucaccaucucccgggacaacagcaagaacacgcucuaccugcagaugaacucccugcgccccgaggacaccgcccucuacuacugcgccaaggacaugcgggaggacgagugcgaggccugguggagcgacuacuacgaccugggcaagcagcugcccugccgcgagucccgcgggguggcgggcaucuucgacgagugggggcagggcaccauggugaccgucagcucc

SEQ ID NO: 9488 - RNA, 432 nt, Artificial Sequence
  derived and/or modified sequence opt1 from anti-HIV_cap256-119-106327_VR-Chain
caggugcagcuggucgagagcggcgggggcguggugcagcccgggcgcucccuccggcugagcugcgccgccuccggcuucaccuucagcuccuacgcgaugcacuggguccgccaggccccggggaagggccuggaguggguggccgccaucagcggcgggggcgggaacaccuacguggccgacuccgucaagggccgguucacgaucagccgcgacaacuccaagaacaccguguaccuccagaugaacagccugcggcuggaggacaccgcgcucuacuacugcgccaaggaccugcgcgaguacgagugcgaggaguggaccuccgacuacuacgacuucgggcggccccagcccugcaucgacagccgcggcguggucggcauccuggacaucugggggcagggcacgauggugaccguguccagc

SEQ ID NO: 9489 - RNA, 438 nt, Artificial Sequence
  derived and/or modified sequence opt1 from anti-HIV_cap256-119-105486_VR-Chain
caggugcagcuggucgagagcggcgggggcguggugcagcccgggggcucccuccgccugagcugcgccgccuccggguucaccgucagcggcuacggcaugcacugggugcggcaggcgccggccaaggggcuggacuggguggccuucaucucccacgacggcagcaacaaguacuacgccgacuccguccgcgggcgguucaucaucagccgcgacaacuccaacaacacccucuacgugcagaugagcucccugcgggccgaggacacggcgcuguacuucugcgugcgcgaccaccgggaggacgagugcgaggagugguggagcgacuacuacgacuucggccgcgagcuccccugccggaaguuccgcgggcugggccuggccggcaucuucgacaucugggggcacggcaccauggucaccguguccagc

SEQ ID NO: 9490 - RNA, 432 nt, Artificial Sequence
  derived and/or modified sequence opt1 from anti-HIV_cap256-119-105197_VR-Chain
caggugcagcuggucgagagcggcgggggcguggugcagcccgggcggucccuccggcugagcugcgccgucucccaguucaccuucggccgcuacgggaugcacugggugcggcaggccccgggcaagggccuggaguggguggggagcaucuccuacgacggcagcgacaaguaccacaccaacucccucugggggcgcuucaucgucagccgggacaacuccaagaacacgcuguaccugcagaugaacaaccuccgccccgaggacaccgcgcuguacuacugcgugcgggaccgccgggagagcgagugcgaggagcgcugguccgacuacuacgacuucggcaagcagcugcccugcgugaagccccgcggggucgugggcgugcucgacaucuggggccaggggacccuggucaccgugagcucc

SEQ ID NO: 9491 - RNA, 432 nt, Artificial Sequence
  derived and/or modified sequence opt1 from anti-HIV_cap256-119-104946_VR-Chain
caggagcagcugguggagagcggcgggggcgucgugcagcccgggcgcucccuccggcugagcugcguggccucccgcuucaccuucagcgccuucggcaugcacuggguccggcaggcgccggggaagggccuggaguggguggccuccaucagcuucgccggcaucaagaaguacuacggggacuccgugaagggccgcuucaccaucagccgggacaacuccaagaacacgcucuaccugcagauggacgggcugcgcggcgaggacaccgcccucuacuacugcgccaaggaccugcgggagcuggagugcgaggagugggcgagcgacuacuacgacuucgggcgcccccagcccugcaucgacucccggggcgucgugggcauccucgacaucugggggcagggcaucauggugaccgucagcucc

SEQ ID NO: 9492 - RNA, 432 nt, Artificial Sequence
  derived and/or modified sequence opt1 from anti-HIV_cap256-119-103667_VR-Chain
caggugcaccuggucgagagcggcgggggcguggugcagcccgggaagucccuccgccugagcugcgccgccucccaguucaccuucaaccgguucggcaugcacuggguccgccaggcgccggggaagggccuggaguggguggccggcaucagcuacgacggguccgacaaguaccacgccgacaagguguggggccgguucaccaucagccgcgacaacuccaagaacacgcucuaccugcagaugaacagccugcgggccgaggacaccgcccucuacuacugcgcgaaggaccugcgcgaggacgagugcgaggagugggccuccgacuacuacgacuucgggaaggagcagcccugccuggacccccggggcgucguggggaucuucgacaucuggggccagggcaccauggugaccgucagcucc

SEQ ID NO: 9493 - RNA, 438 nt, Artificial Sequence
  derived and/or modified sequence opt1 from anti-HIV_cap256-119-103385_VR-Chain
gaggugcagcuggucgagagcggcgggggccucgugcagaccgggggcucccugcgccugagcugcgccgccuccggguucaccuucagccgguacgacaugaacugggugcgccaggcgcccggcaagggccucgagugggucgccuccaucagcaacgacggguccaagaaguaccacggcgacagcgugugggcccgguucacgaucucccgcgacaacagcaagaacacccuguuccugcagauguccagccuccggguggaggacaccgcccuguacuucugcguccgcgaccagcgggaggacgagugcgaggaguggugguccgacuacuacgacuucgggcgcgagcugccgugccggaaguuccgcggccucgggcuggccggcaucuucgacaucuggggccacgggaccauggugacggugagcucc

SEQ ID NO: 9494 - RNA, 438 nt, Artificial Sequence
  derived and/or modified sequence opt1 from anti-HIV_cap256-119-103267_VR-Chain
gaggugcccagcgucgaguccggcgggggccuggugcagaccgggggcagccucacccuguccugcgccgccagccaguucacguucuccaacuacgggaugcacugggugcgccaggcgccgggcaagggccuggagugggucgccagcaucuccaacgacgggagcaagaaguaccacggcgacuccgugugggcccgguucaucaucagccgcgacaacuccaagaacacccucuuccugcagaugagcucccugcgggccgaggacaccgcccucuacuucugcgugcgcgaccaccgggaggacgagugcgaggagugguggagcgacuacuacgacuucgggcgcgagcugcccugccggaaguuccgcggccuggggcucgcgggcaucuucgacaucuggggccacgggaccauggucacgguguccagc

SEQ ID NO: 9495 - RNA, 432 nt, Artificial Sequence
  derived and/or modified sequence opt1 from anti-HIV_cap256-119-103011_VR-Chain
caggugcagcuggucgagagcggcgggggcguggugcagcccgggggcucccuccgccugagcugcgccaccuccggguucaccuucggcacguucggcaugcacuggguccggcaggccccggggaagggccuggacuggguggcggccaucagcuucgccgggaccaagaagaacuacgccgacuccgugcgcggccgguucaccaucagccgcgacuccagcaagaacacccucuaccugcagaugaacucccugcggcccgaggacacggcccucuacuacugcgucaaggacaugcgcggguacgagugcgaggaguggaccagcgacuacuacgacuucggccggccccagcccugcaucgacucccgcggcgugguggggaccuucgacgucuggggccaggggaccauggugacggugagcucc

SEQ ID NO: 9496 - RNA, 438 nt, Artificial Sequence
  derived and/or modified sequence opt1 from anti-HIV_cap256-119-102072_VR-Chain
gaggugcagcuggucgagagcggcgggggccucgugcagcccgggggcucccugcgcgugagcugcgccgucuccggguucaccuucagcaacuacgagaugaacugggugcggcaggccccgggcaagggccuggaguggguggcguccaucagcaacgacgggaccaagaaguaccacgccgaguccgucugggaccgcuucagcaucuccaaggacaacagcaagaacacccucuuccugcagaugaacucccugcggguggaggacacggcccucuacuucugcgugaaggaccagcgcgaggacgagugcgaggagugguggagcgacuacuacgacuucggccgggagcugcccugccgcaagucccgggggcugggccucgccgggaucuucgacaucuggggccacggcaccauggucaccgugagcucc

SEQ ID NO: 9497 - RNA, 438 nt, Artificial Sequence
  derived and/or modified sequence opt1 from anti-HIV_cap256-119-101945_VR-Chain
gaggugcagcuggucgagagcggcgggggccucgugcagcccgggggcucccugcgccugagcugcgccgccuccggguucaccuucagcuccuacgugaugcacuggguccggcaggcgccgggcaagggccucgaguggguggccagcaucuccaacgacgggaccaagaaguaccacgaggagagcguguggggccgcuucacgaucuccaaggacaacagcaagaacacccuguuccugcagaugaacucccuccggaucgaggacaccgcccuguacuucugcgucaaggaccagcgcgaggacgagugcgaggagugguggagcgacuacuacgacuucgggcgggagcugcccugccgcaagucccggggccucgggcuggccggcaucuucgacauguggggccacgggaccauggugacggugagcucc

SEQ ID NO: 9498 - RNA, 432 nt, Artificial Sequence
  derived and/or modified sequence opt1 from anti-HIV_cap256-119-101319_VR-Chain
caggugcagcuggucgagagcggcgggggcguggugcagcccgggaagucccuccgccugagcugcgucggcuccggguucaccuucgacgacuacggcaugcacugggugcggcaggccccgggcaaggggcuggaguggguggccagcaucuccuacgacggccgcgacuucuaccacgcgcggagcgucugggggcgcuucaccaucucccgggacaacagcaagaacacgcuccaccuccagaugaacucccugcgccccgaggacaccgcccuguacuucugcgcccgggaccugcgcgagagcgagugcgaggagugggaguccuacuacuacgacuucggcaagaaggggcccugcgugaagccccggggcguggucggcgugcuggacaucugggggcagggcacccucgugaccgucagcucc

SEQ ID NO: 9499 - RNA, 432 nt, Artificial Sequence
  derived and/or modified sequence opt1 from anti-HIV_cap256-119-100871_VR-Chain
caggugcagcuggucgagagcggcgggggcguggugcagcccggggagucccuccggaucagcugcgccgccucccaguucaccuucagccgguacggcaugcacuggguccgccaggcgccggggaagggccuggaguggguggccuccaucagcuucgacggccgggacaaguaccacuccagccuggugugggggcgccucaccaucucccgggacaacagcaaguccacgcuguuccugcagaugaacagccuccgcgccgaggacaccgcccuguacuacugcgcccgggaccugcgcgaguccgagugcgaggagugggagagcgacuacuacgacuucggcaagccccagcccugcgaggacccccgcggggucgugggcaccuucgacaugugggggcucggcacccuggugacggucuccagc

SEQ ID NO: 9500 - RNA, 432 nt, Artificial Sequence
  derived and/or modified sequence opt1 from anti-HIV_cap256-119-100838_VR-Chain
gaggugcagcuggucgagagcggcgggggcguggugcagcccgggggcucccuccgccugagcugcgccgccuccggguucaccuucagcuccuacggcaugcacuggguccggcaggcgccgggcaaggggcuggaguggguggccuucauccgcuacgacggcagcaacaaguacuacgccgacuccgugaaggggcgguucaccaucagccgcgacaacuccaaccacacgcucuacaugcagcuggacagccugcgggccgaggacaccgcccucuacuacugcgcgaaggaccugcgcgaguacgagugcgaggaguggaccuccgacuacuacgacuucggccggccccagcccugcaucgacagccgcggggucgugggcauccuggacaucuggucccagggcaccauggugacggucagcucc

SEQ ID NO: 9501 - RNA, 438 nt, Artificial Sequence
  derived and/or modified sequence opt1 from anti-HIV_cap256-119-100025_VR-Chain
caggugcagcuggucgagagcggcgggggcguggugcagcccgggcgcucccuccggcugagcugcgccgccuccgucuucaccuucagcuacuacggcaugcacugggugcgccaggcgccggggaagggccuggaguggguggccuucaucucccacgacggcagcaacaaguacuacgccgacuccguccgggggcgcuucaucaucagccgggacaacuccaacaacacccucuacgugcagaugaacagccugcgcgccgaggacacggcccuguacuucugcgugaaggaccagcgggaggacgagugcgaggaguggugguccgacuacuacgacuucggccgcgagcuccccugccggaaguuccgcgggcugggccuggcggggaccuucgacaucuggggccacggcaccaugcucaucgucagcucc

SEQ ID NO: 9502 - RNA, 432 nt, Artificial Sequence
  derived and/or modified sequence opt1 from anti-HIV_cap256-119-100000_VR-Chain
cagaugcagcugguggagagcggcgggggcgucgugcagcccgggcggucccucacccugagcugcgccgccucccaguucaccuucagcaacuacggcaugcacugggugcggcaggcgccggggaagggccuggagugggucgccuccaucagcaacgacggcaacaagaaguaccacggggacuccgugugggcccgcuucacgaucagccgggacaacuccaagaacacccucuuccugcagaugagcucccugcgcaccgaggacaccgcccucuacuucugcgugcgggaccgccgggagagcgagugcgaggagcgcugguccgacuacuacgacuucggcaagcagcugcccugcgucaagccccgcgggguggccggcaucuucgacaucugggggcagggcacgauggugaccgucagcucc

SEQ ID NO: 9503 - RNA, 432 nt, Artificial Sequence
  derived and/or modified sequence opt1 from anti-HIV_cap256-119-098890_VR-Chain
caggugcagcuggucgagagcggcgggggcguggugcagcccggggagucccuccgcaucagcugcgucgccucccaguucaccuucggccgguacgggaugcacugggugcgccaggccccgggcaagggccuggaguggguggcgagcaucuccuucgacgggcgggacaaguaccacagcccccuggucuggggccgccucaccaucucccgggacaacagcaagaacacgcuguuccugcagaugaacucccuccgcaccgaggacaccgcccuguacuacugcgcccgggaccugcgcgagagcgagugcgaggagugggaguccgacuacuacgccuucuggcggaagcuccccugcgugaagccccgcgggguggccggcacccuggacaucugggggcagggcacgauggucagcguguccagc

SEQ ID NO: 9504 - RNA, 435 nt, Artificial Sequence
  derived and/or modified sequence opt1 from anti-HIV_cap256-119-098715_VR-Chain
caggugcagcuggucgagagcggcgggggcguggugcagcccgggcgcucccuccggcugagcugcgccgccuccggcuucagcuucaacaaccacgggaugcacuggguccgccaggcgccgggcaagggccuggaguggguggccgggaucuccuucgccggcaucaagaaguacuacgggaccagcgugaagggccgguucaccaucucccgcgacaacagcaagaacaaccucuuccugcagaugaacucccugcgggucgaggacacggcccucuacuacugcgcccgcgaccugcgggagauggagugcgaggaguggacccuguacaacuacuacgacuucgggagccgcggccccugcguggacccccggggcguggucggguccuucgacguguggggccaggggaccauggugaccgucagcucc

SEQ ID NO: 9505 - RNA, 438 nt, Artificial Sequence
  derived and/or modified sequence opt1 from anti-HIV_cap256-119-098632_VR-Chain
cagaugcagcugguggagagcggcgggggcgucgugcagcccgggcgcucccucacccugagcugcgccgccucccaguucaacuucgcgaacuacgacaugcacugggugcggcaggccccgggcaaggggcuggagugggucgccuucauccgcuacgacggcaacaacaaguacuacgccgacagcgugaagggccgguucaccaucucccgcgacaacagcaaguccacccucuuccugcagaugaacagccugcggaucgaggacacggcccucuacuucugcgugaaggaccagcgcgaggacgagugcgaggaguggugguccgacuacuacgacuucgggcgggagcugcccugccgcaagagccggggccuggggcucgcgggcaucuucgacaugugggggcacggcaccauggucaccguguccagc

SEQ ID NO: 9506 - RNA, 432 nt, Artificial Sequence
  derived and/or modified sequence opt1 from anti-HIV_cap256-119-097199_VR-Chain
caggugcagcuggucgagagcggcgggggcguggugcagcccgggcgcucccuccggcugagcugcgccgccuccggcuucgcguucagcuccuacgccuuccacuggguccgccaggccccggggaagggccuggaguggguggccuacauccccuuccacggcaaccagcaguacuacggggacagcgugaagggccgguucaccaucucccgcgacaacagccgggacacccucuuccuggagaugaacucccugcgccccgaggacacggcccucuacuucugcgcgcgggaccagcgcuacuacgagugcgaggagugggccagcgacuacuacgacuucgggcgggagcagcccugccuggacccgcgcggcgucguggggaucuucgaccuguggggccagggcaccauggugaccgucuccagc

SEQ ID NO: 9507 - RNA, 432 nt, Artificial Sequence
  derived and/or modified sequence opt1 from anti-HIV_cap256-119-096189_VR-Chain
caggugcagcuggucgagagcggcgggggcguggugcagcccgggcgcucccuccggcugagcugcgccgccuccggcuucaaguucgggagcuucggcaugcacuggguccgccaggcgccgggcaaggggcuggaguggguggccgugaucuccuacgacggcagcgacaaguacuacggguccagcguccggggccgcuucuccaucagccgggacaacuccaagaacacccucuaccugcagaugaacagccugcgcaccgaggacacggcccucuacuucugcgccaaggaccugcgggaguacgagugcgaggaguggaccuccgacuacuacgacuucgggcgcccccagcccugcaucgacagccggggcguggugggcauccuggacaucugggggcagggcaccauggucaccguguccagc

SEQ ID NO: 9508 - RNA, 432 nt, Artificial Sequence
  derived and/or modified sequence opt1 from anti-HIV_cap256-119-094581_VR-Chain
caggugcaccuggucgagagcggcgggggcguggugcagcccgggcgcucccuccggcugagcugcgccgccuccggcuucaacuucagcaacuacgcgauccacuggguccgccagaccccggggaagggccuggagugggugacccucaucuccaacgacggcagcaacaaguacuacgccgacucccugaaggggcgguucacgaucagccgcgacaacuccaagaacacccuguaccuccagaugaacagccugcgggccgaggacaccgcccuguacuacugcgccaaggaccuccgcgaggacgagugcgaggaguggugguccgacuacuacgacuucggcaagcagcugcccugccggaagucccgcgggguggcgggcaucuucgacggguggggccagggcaccauggucacggugagcagc

SEQ ID NO: 9509 - RNA, 432 nt, Artificial Sequence
  derived and/or modified sequence opt1 from anti-HIV_cap256-119-094200_VR-Chain
gaggugcagcuggucgagagcggcgggggccucgugcagcccgggggcucccugcggcugagcugcgccgccuccggguucaucuucagcuccuacgcgcuccacugggugcggcaggccccgggcaagggccuggagugggucgccagcaucuccuucgccgggaccaagaaccacuacggcaacagcgugaaggggcgcuucaccaucucccgggacaacagcaagaacacgguguaccugcagaugaacucccuccgcgccgaggacaccgcgcuguacuacugcgccaaggaccugcgggaguacgagugcgaggaguggaccagcgacuacuacgacuucggccgcccccagcccugcaucgacucccgcggggucgugggcauccucgacaucuggagccagggcaccauggugacggucuccagc

SEQ ID NO: 9510 - RNA, 432 nt, Artificial Sequence
  derived and/or modified sequence opt1 from anti-HIV_cap256-119-094158_VR-Chain
cagaugcagcugguggagagcggcgggggcgucgugcagcccggguccagccucacccuguccugcgccgccagccaguucaccuucuccaacuacggcaugcacugggugcgccaggcgccggggaagggccuggagugggucgccagcaucuccaacgacggcacgaagaaguaccacggggacagcgugugggaccgguucaccaucucccgcgacaacagcaagaacacccucuuccugcagaugaacucccugcgggccgaggacaccgcccucuacuucugcgugaaggaccagcgcgaggacgagugcgaggagugguggagcgacuacuacgacuucggcaagcagcugcccugccggaagucccgcggggucgccggcaucuucgacagcugggggcagggcacgauggugaccguguccagc

SEQ ID NO: 9511 - RNA, 432 nt, Artificial Sequence
  derived and/or modified sequence opt1 from anti-HIV_cap256-119-092814_VR-Chain
caggugcagcuggucgaguucggcgggggcguggugcagcccgggggcagccuccggcuguccugcgccgccagcggguucuacuucaccgacuacggcaugcacuggguccggcaggcgccgggcgaggggcugcaguggguggccuucaucuccuacgacggcaacaccaagacgaccgccgacagcgugcgcgggcgguucacccucucccgcgacaacagcaagaacacccuguaccugcagaugaacuccguccggguggaggacacggcccgcuacuucugcgcccgggacaugcgcgaguacgagugcgagcucugggcgagcgacuacuacgacuucggcaagccccagcccugcgaggacccccgcgggguggucggcaccuucgacauguggggccuggggacccuggugaccguguccagc

SEQ ID NO: 9512 - RNA, 432 nt, Artificial Sequence
  derived and/or modified sequence opt1 from anti-HIV_cap256-119-092808_VR-Chain
caggugcagcuggucgagagcggcgggggcguggugcagcccgggcgcucccuccggcugagcugcgccgccucccaguucagcuucggcaacuacgggaugcacuggguccgccaggcgccgggcaagggccuggaguggguggccgccaucuccuucgccgggaccaagaccaacuacgccgacagcgugaagggccgguucacgaucucccgcgacaacagcaagaacaccgucuaccuccagaugaacucccugcgggcggaggacaccgcccuguacuucugcgccaaggacauccgcgaguacgagugcgaguacuggaccagcgacuacuacgacuucgggcggccccagcccugcaucgacucccgcggcgugguggggacguucgacgucuggggccagggcaccauggugaccgugagcucc

SEQ ID NO: 9513 - RNA, 432 nt, Artificial Sequence
  derived and/or modified sequence opt1 from anti-HIV_cap256-119-092573_VR-Chain
caggagcagcugguggagagcggcgggggcgucgugcagcccgggaccucccuccgccugagcugcuccgccagcggcuucaccuucuccaacuucgccaugaacugggugcggcaggcgccggggaagggccuggagugggucagcuucaucuccagcgacggcaagaacaagaacuacguggacuccgugaaggggcgcuucacgaucagccgggacaacuacaagaacacccucuaccugcagaugaacucccugcgcaccgaggacaccgccgucuacuacugcgccaaggaccucggcgggacgaaggacgacgagugggccaccgacuacuacgacuggagcaccgccuaccccgugcaggacccccgggcgguggccggcggguucgaccuguggggccugggcaccauggucacgguguccagc

SEQ ID NO: 9514 - RNA, 432 nt, Artificial Sequence
  derived and/or modified sequence opt1 from anti-HIV_cap256-119-090815_VR-Chain
caggugcagcuggucgagagcggcgggggcgugguggagcccgggcggucccuccggcugagcugcgccgccucccaguucagcuucuccagcuacggcaugcacuggguccgccaggcgccggggaagggccuggaguggguggccgccaucuccuucgacggcgccgacaaguaccacgccgacaacgugugggggcggcucagcaucucccgcgacaacagcaaguccacccuguaccugcagaugaacagccuccggcccgaggacaccgcggucuacuucugcgccaaggaccugcgcgaggacgagugcgaggagcggugguccgacuacuacgacuucggcaagcagcugcccugccgcaagagccgcgggguggccggcaucuucgacaacugggggcagggcacgauggugaccgucuccgcc

SEQ ID NO: 9515 - RNA, 438 nt, Artificial Sequence
  derived and/or modified sequence opt1 from anti-HIV_cap256-119-090368_VR-Chain
caggugcagcuggucgagagcggcgggggcguggugcagcccgggcgcucccuccggcugagcugcgccgccuccggcuucgcguucagccacuacgggaucuucuggguccgccaggccccgggcaagggccuggaguggguggccuccaucagcaacgacgggaccaagaaguaccacgccgaguccgugugggaccgguucagcaucuccaaggacaacagcaagaacacccucuuccugcagaugaacucccugcgcgucgaggacacggcccucuacuucugcgugaaggaccagcgggaggacgagugcgaggagugguggagcgacuacuacgacuucggccgcgagcugcccugccggaagucccgcgggcugggccucgcggggaucuucgacauguggggccacggcaccauggugaccgucagcucc

SEQ ID NO: 9516 - RNA, 432 nt, Artificial Sequence
  derived and/or modified sequence opt1 from anti-HIV_cap256-119-089710_VR-Chain
caggugcagcuggucgagagcggcgggggcguggugcagcccgggcgcucccuccggcugagcugcaccgccuccggcuucggguucagcaacuacgccaugcacuggguccgccuggcgccgggcaagggccucgaguggguggccuccaucagcuacgacgggcgggacuaccaccacgccggcgccgugugggggcgcuucaucaucucccgggacaacagcaagaacucccugcaccuccagaugaacagccugcgccccgaggacaccgcccuguacuucugcgcgcgggaccugcgcgaguccgagugcgaggagugggagagcgacuacuacaacuucuggaagaagcuccccugcgucaagccccggggcgugguggggauccuggacaucuggggccagggcacggucgugaccguguccagc

SEQ ID NO: 9517 - RNA, 432 nt, Artificial Sequence
  derived and/or modified sequence opt1 from anti-HIV_cap256-119-088555_VR-Chain
caggugcagcuggucgagagcggcgggggcguggugcaggccgggcgcucccuccggcugagcugcgccgcgucccaguucaccuucagccgcuacggcaugcacuggguccggcaggcccccgggaagggccuggaguggguggccggcaucuccuacgacgggcgcgacaaguaccacgcccacuucguguggggccgguucaucaucagccgcgacaacuccaagaacacccucuaccugcagaugaacagccugcgggccgaggacacggcgcucuacuacugcguccgcgaccugcgggaguccgagugcgagcugugggagagcgacuacuacgacuucgggaagcgccucccgugcgugaagccccggggcguggccgggaccuucgaccuguggggccagggcaccauggucaccguguccagc

SEQ ID NO: 9518 - RNA, 432 nt, Artificial Sequence
  derived and/or modified sequence opt1 from anti-HIV_cap256-119-087962_VR-Chain
gagaugcagcugguggagagcggcgggggccucgucaagcccgggcggucccugcggcugagcugcgccgccuccggcuucaccuucagcuccuacgcgauccacugggugcgccaggccccggggaagggccucgaguggguggccgucaucagcuacgacggcuccaacaaguacuacgccgacagcgugaaggggcgguucaccaucucccgcgacaacagcaagaacacgguguaccugcagaugaacucccugcgggucgaggacaccgcccucuacuacugcgcgaaggaccugcgcgaguacgagugcgaggaguggaccagcgacuacuacgacuucggcaagccccagcccugcaucgacucccgcgggguggugggcauccuggacaucugggggcagggcaucauggucaccgugagcucc

SEQ ID NO: 9519 - RNA, 432 nt, Artificial Sequence
  derived and/or modified sequence opt1 from anti-HIV_cap256-119-086903_VR-Chain
caggugcaccuggucgagagcggcgggggcguggugcagcccgggaagucccuccgccugagcugcgccgccucccaguucaccuucgaccgguacggcaugcacuggguccgccaggcgccggggaagggccuggaguggguggccagcaucuccaacgacggcaccgacaaguaccacgccgacaacgugugggggcgguucacgaucagccgcgacaacuccaagaacacccucuaccuggagaugaacagccugcggggcgaggacaccgcccucuacuacugcgccaaggacaugcgcgaggacgagugcgaggaguggugguccgacuacuacgacuucgggcggccccagcccugcaucgacagccgcggcgucguggggaccuuccacguguggggccagggcacgauggucaccguguccagc

SEQ ID NO: 9520 - RNA, 432 nt, Artificial Sequence
  derived and/or modified sequence opt1 from anti-HIV_cap256-119-086804_VR-Chain
gaggugcagcuggucgagagcggcgggggcguggugcagcccgggcgcucccuccggcuguucugcgccggcagcggguucaccuucuccagcuacggccugcacuggguccgccaggccccgggcaaggggcucgaguggguguccuucaucagcuacgacggcuccaccacgaaguacgcggacagccugaaggggcgguucaccgugucccgcgacaacagcaagaacaccgucuaccuggagaugaacucccuccgggccgaggacaccgcccuguacuacugcgccaaggaccugcgcgaguacgagugcgaggaguggacgagcgacuacuacgacuucggccggccccagcccugcaucgacucccgcgggguggugggcauccucgacaucuggggccaggggaccauggucaccgugagcucc

SEQ ID NO: 9521 - RNA, 432 nt, Artificial Sequence
  derived and/or modified sequence opt1 from anti-HIV_cap256-119-085910_VR-Chain
gaggugcagcugcucgagagcggcgggggccugguccagcccgggggcucccugcgccucagcugcgccgccuccggguucaccuucagcuccuacggcaugcacugggugcggcaggcggccggcaaggggcuggaguggguggccagcaucuccuacgacggccgcgacuaccaccacgccggggccgucuggggccgguucaucaucagccgcgacaacuccaagaacagccugcaccuccagaugaacucccugcggccggaggacaccgcgcuguacuucugcgcccgcgaccuccgggagagcgagugcgaggagugggaguccgacuacuacaacuucuggaagaagcugcccugcgugaagccccgcgggguggucggcauccuggacaucuggggccaggggacgguggugaccgucagcucc

SEQ ID NO: 9522 - RNA, 432 nt, Artificial Sequence
  derived and/or modified sequence opt1 from anti-HIV_cap256-119-085772_VR-Chain
gaggugcggcuggucgagagcggcgggggccucauccagcccgggggcucccugcggcugagcugcgccgccuccgggcucaccgugagcuccaaccacaugagcugggugcgccaggcgccgggcaagggccuggagugggucgccgugaucuccuacgacgggagcaacaccuucuacggcgacuccgugaaggggcgguucacggucagccgcgacaucuccaagaacacccuguaccuccagaugaacagccugcggcccgaggacaccgccauguacuacugcgcccgcgaccagcgguacuacgagugcgaggagugggccuccgacuacuacgacuucggccgcgagcagcccugccaggacccccgcgggguggugggcgucuucgacauguggggccaggggaccauggugacggugagcucc

SEQ ID NO: 9523 - RNA, 432 nt, Artificial Sequence
  derived and/or modified sequence opt1 from anti-HIV_cap256-119-084603_VR-Chain
caggugcagcuggucgagagcggcgggggcguggugcaguccgggcgcagccuccggcuguccugcgccgccagcggcuuccccuucuccgacuucgcgaugcacuggguccgccaggccccggggaagggccuggaguggguggccagcaucuccuucgugggcaucaagacccacuacgccaacagcguccgggggcgcuucaccaucucccgggaccagagcaagaacacgcucuaccugcagaugaacuccgugcgcguggaggacaccggccgguacuacugcgcccgcgacaugcgggaguacgagugcgagcugugggcgagcgacuacuacgacuucgggaagccccagcccugcgaggacccccgcggcgucguggggaccuucgacauguggggccucggcacccuggugacggucuccagc

SEQ ID NO: 9524 - RNA, 432 nt, Artificial Sequence
  derived and/or modified sequence opt1 from anti-HIV_cap256-119-084276_VR-Chain
caggugcagcuggucgagagcggcgggggcguggugcagcccgggcgcucccuccggcugagcugcgccgccucccgcuucaccuucagcuccuacgcgaugcacuggguccggcaggccccgggcaaggggcuggaguggguggccgugaucugguacgacggcagcaacaaguacuacgccgacuccguccgcggccgguucagcguguccaccgacaucagcaagaacacgcucuaccugcagaugaacucccugcgccccgccgacaccgcgcucuacuucugcgcccgggaccugcgcuacuacgagugcgaggagugggccagcgacuacuacgacuucgggaaggagcagcccugccuggacccccggggcguggucgggaucuucgaccucuggggccaggggaccauggugaccguguccagc

SEQ ID NO: 9525 - RNA, 432 nt, Artificial Sequence
  derived and/or modified sequence opt1 from anti-HIV_cap256-119-082288_VR-Chain
cagguguaccuggucgagagcggcgggggcguggugcagcccgggcggucccuccggcugagcuccgccgccagccacuucucccugagcuccuacggcaugcacuggguccgccaggcgccggggaagggccucgaguggguggccggcaucagcuucgccgggaccaagaccuacuacggcgacuccgugaaggggcgguucacggucagcaccgacaucuccaagaacacccuguaccuccaggugaacagccugcgccccgaggacaccgccauguacuacugcgcccgggaccagcgcuacuacgagugcgaggagugggcguccgacuacuacgacuucggcaaggagcagcccugccuggacccccgcgggguggucggcaucuucgacaucuggggccaggggacgauggugaccgugagcucc

SEQ ID NO: 9526 - RNA, 432 nt, Artificial Sequence
  derived and/or modified sequence opt1 from anti-HIV_cap256-119-080383_VR-Chain
caggugcagcuggucgagagcggcgggggcguggugcagcccgggcgcucccuccggaucagcugcgccgccucccaguucaccuucagccgcuacggcaugcacuggguccggcaggcgccggggaagggccuggaguggguggccuccaucagcuacgacggcaccgacaaguaccacgcccgccuggugugggggcgguucacgaucucccgcgacaacagcaagaacacccucuaccugcagaugaacucccugcgggccgaggacaccgcccucuacuacugcguccgcgacgagcgggagagcgagugcgagcugugggaguccgacuacuacgacuucggcaagaagcugcccugcgugaagccccgcggggugaccggcagccucgacaugugggggcagggcacgcaggucaccguguccagc

SEQ ID NO: 9527 - RNA, 438 nt, Artificial Sequence
  derived and/or modified sequence opt1 from anti-HIV_cap256-119-079333_VR-Chain
gaggugcagcuggucgagagcggcgggcgccucgugcagcccggcuccccgcugcggcugagcugcgccgccucccaguucaacuucgcgagcuacgggaugcacugggugcgccaggcccccggcaaggggcucgagugggucgccuccaucagcaacgacggcaccaagaaguaccacgccgaguccgugugggaccgguucagcaucuccaaggacaacagcaagaacacccuguuccugcagaugaacucccuccgcguggaggacacggcccuguacuucugcgucaaggaccagcgggaggacgagugcgaggagugguggagcgacuacuacgacuucggccgcgagcugcccugccggaagucccgcgggcucggccuggcggggaucuucgacauguggggccacgggaccauggugaccgugagcucc

SEQ ID NO: 9528 - RNA, 441 nt, Artificial Sequence
  derived and/or modified sequence opt1 from anti-HIV_cap256-119-078618_VR-Chain
cagaugcagcugguggagagcggcgggggcgucgugcagcccgggcgcucccucacccugagcugcgccgccucccaguucaacuucgcgagcuacggcaugcacugggugcggcaggccccggggaagggccuggagugggucgccuccaucagcaacgacggcaccaagaaguaccacgccgaguccgugugggaccgcuucagcaucuccaaggacaacagcaagaacacccucuuccugcagaugaacucccugcggguggaggacacgacccucuacuucugcgucaaggaccagcgcgaggacgagugcgaggagugguggagcgacuacuacgacuucgggcgggagcugcccugccgcaagucccggggccuggggcucgccggcaacuucugcaucugcggggcggacggcaccauggugacggugagcucc

SEQ ID NO: 9529 - RNA, 432 nt, Artificial Sequence
  derived and/or modified sequence opt1 from anti-HIV_cap256-119-077466_VR-Chain
caggugcagcuggucgagagcggcgggggcguggugcagcccggguccccgcuccgcaucagcugcgccgucucccaguucaccuucagccgguacggcaugcacugggugcgccaggcccccgggaagggccuggaguggguggcguccaucagcuucgacggccgggacaaguaccacuccagccuggucugggggcgccucaccaucucccgggacaacagcaaguccacgcuguuccugcagaugaacagccuccgcgccgaggacaccgcccuguacuacugcgcccgggaccugcgcgaguccgagugcgaggagugggagagcgacuacuacgccuucuaccggaagcuccccugcgugaagccccgcggcguggcggggacccuggacaucuggggccaggggaccauggucacgguguccagc

SEQ ID NO: 9530 - RNA, 423 nt, Artificial Sequence
  derived and/or modified sequence opt1 from anti-HIV_cap256-119-076284_VR-Chain
caggugcagcuggucgagagcggcgggggcguggugcagcccgggcgcucccugcggcugagcugcgccgccuccaacaccuacgcgaugcacuggguccgccaggccccgggcaaggggcuggaguggauggcccucaucagcuacgagggcuccgacaaguacuacguggacagcgugaagggccgguucaccaucucccgcgacaacagcaaguccacgcuguaccugcagaugaacagccucuccgccgaggacaccgccgucuacuucugcgcgaaggaccucgggggcaacaaggacgacgaguggaccaccgacuacuacuacgacuggagcaaggcccggcccgugcaggacccccgcguggucgccgggacguucgacaucuggggccaggggaccauggugaccguguccagc

SEQ ID NO: 9531 - RNA, 432 nt, Artificial Sequence
  derived and/or modified sequence opt1 from anti-HIV_cap256-119-074680_VR-Chain
gaggugcagcuggucgagagcggcgggggccucgugcagcccgggcgcucccugcggcugagcugcgccggcuccggguucaccuucguggacuacgccaugcacuggguccgccaggugccgggcaagggccucgaguggguggggagcaucuccuacgacggcagcgacaaguaccacaccaacuccgucugggggcgguucaucgugagccgcgacaacuccaagaacacgcuguaccugcagaugaacagccuccggcccgaggacaccgcgcuguacuacugcgugcgcgaccggcgcgaguccgagugcgaggagcgguggagcgacuacuacgacuucggcaagcagcugcccugcgucaagccccgcgggguggccggcaucuucgacaucuggggccaggggaccauggugaccgucuccagc

SEQ ID NO: 9532 - RNA, 432 nt, Artificial Sequence
  derived and/or modified sequence opt1 from anti-HIV_cap256-119-074081_VR-Chain
gaggugcagcuggucgagagcggcgggggccucgugcagcccgggggcucccugcgccugagcugcguggucuccggggugaccgugagcuccaacuacaugagcuggguccggcaggccccgggcaagggccucgaguggguggccuccaucagcuacgacggguccgacaaguaccacgcggaccgcguguggggccgguucaccaucagccgcgacaacuccaagaacacgcuguaccugcagaugaacagccuccgggccgaggacaccgcccuguacuacugcguccgcgacgcccgggaguccgagugcgagcugugggagagcgacuacuacaacuucgggcgcaagcuccccugcgugaagccccggggcguggccgggacccuggacaucuggggccagggcaccauggucacgguguccagc

SEQ ID NO: 9533 - RNA, 432 nt, Artificial Sequence
  derived and/or modified sequence opt1 from anti-HIV_cap256-119-071704_VR-Chain
cagaugcagcugguggagagcggcgggggcgucgugcagcccgggggcucccuccgccugagcugcgccgugucccaguucaccuucaccagcuacgggaugcacuggguccggcaggccccgggcaagggccuggaguggguggcgacgaucuccagcgacggguccaagaaguaccacggcgacagcgugugggggcgccucaccaucucccgggacaacagcaagaacacccuguuccugcagaugaacaaccuccgcgccgaggacaccgcccuguacuucugcgucaaggaccagcgggaggacgagugcgaggaguggugguccgacuacuacgacuucggcaagaagcugcccugccgcaagagccccgggcucgccggcaucuucgacguguggggccacgggacgauggugaccgucuccccc

SEQ ID NO: 9534 - RNA, 432 nt, Artificial Sequence
  derived and/or modified sequence opt1 from anti-HIV_cap256-119-071266_VR-Chain
caggugcagcuggucgagagcggcgggggcguggugcagcccggggagucccuccggcugagcugcgccgccuccggcuucaccuucagcuccuucgggaugcacuggguccggcaggcgccgggcaagggccuggaguggguggggagcaucuccuacgacggcagcgacaaguaccacaccaacuccgugugggggcgcuucaucgucagccgggacaacuccaagaacacgcucuaccugcagaugaacagccugcgccccgaggacaccgcccucuacuacugcgugcgggaccgccgggaguccgagugcgaggagcgcuggagcgacuacuacgacuucggcaagcagcugcccugcgugaagccccgcggggucgccggcaucuucgacaucuggggccaggggaccauggugaccguguccagc

SEQ ID NO: 9535 - RNA, 432 nt, Artificial Sequence
  derived and/or modified sequence opt1 from anti-HIV_cap256-119-069667_VR-Chain
gaggugcagcuggucgagagcggcgggggccucgugcagcccgggcgcucccugcggcugagcugcgccgccuccggcuucagcuucaacaccuacgggaugcacugggugcgccaggcgccgggcaagggccucgagugggucgccuucauccgguacgacggguccaacaaguacuacgccgacagcgugaagggccgcuucaccaucucccgggacaacagcaagaacacgcuguaccugcagauggacgggcuccgcggcgaggacaccgcccuguacuacugcgccaaggaccugcgggagcucgagugcgaggagugggcguccgacuacuacgacuucgggcgcccccagcccugccuggacccccggggcgugagcggcaucuccaacgucugggggcagggcaccauggugaccgugagcucc

SEQ ID NO: 9536 - RNA, 432 nt, Artificial Sequence
  derived and/or modified sequence opt1 from anti-HIV_cap256-119-069591_VR-Chain
caggugcagcuggucgagagcggcgggggcguggugcagcccgggcgcucccuccggcugagcugcgccgccuccggcuucaccuucagcuccuacgcgaugcacuggguccgccaggccccggggaagggccuggaguggguggccggcaucagcuacgacggguccgacaaguaccacgccgacaagguguggggccgguucaccaucagccgcgacaacuccaagaacacgcucuaccugcagaugaacagccugcgggccgaggacaccgcgcucuacuacugcgccaaggaccugcgcgaggacgagugcgaggaguggugguccgacuacuacgacuucgggaagcggcugcccugccgcaagagccggggcgucgccgggguguucgacaaguggggccagggcaccauggugaccgucuccagc

SEQ ID NO: 9537 - RNA, 432 nt, Artificial Sequence
  derived and/or modified sequence opt1 from anti-HIV_cap256-119-068691_VR-Chain
cagggccaccugguggccagcgggggcggggucgugcccccgggccgcucccucacccugagcugccuggccucccaguucaccuucagcggguacggcuuccacugggugcggcaggcgcccggcaaggggcucgagugggucgccuccaucagcuucgccggcacgaagaagcacuacgggaacuccgugaagggccgcuucaccaucagccgggacaacuccaagaacacccuguaccuggagaugaacagccuccgccccgaggacaccgcccuguacuacugcgccaaggaccggcgcgaguacgagugcgaggaguggacguccgacuacuacgacuucgggcggccccagccgugcaucgacagccgcggcguggucggcauccuggacaucugggggcggggcaccauggugaccguguccagc

SEQ ID NO: 9538 - RNA, 432 nt, Artificial Sequence
  derived and/or modified sequence opt1 from anti-HIV_cap256-119-068488_VR-Chain
cagaugcagcugguggagagcggcgggggcgucgugcagcccgggaugucccucacccugagcugcgccgccucccaguucaccuucagcaacuacggcaugcacugggugcgccaggcgccggggaagggccuggagugggucgccuccaucagcaacgacggcuccaagaaguaccacggggacagcgugaagggccgguucacgaucucccgcgacaacagcaagaacacccucuaccugcagauggacgggcugcggggcgaggacaccgcccucuacuacugcgccaaggaccugcgcgagcuggagugcgaggagugggccuccgacuacuacgacuucgggcggccccagcccugccucgacccccgcggcgugagcggcaucuccaacgucugggggcagggcaccauggugacggugagcucc

SEQ ID NO: 9539 - RNA, 432 nt, Artificial Sequence
  derived and/or modified sequence opt1 from anti-HIV_cap256-119-067536_VR-Chain
caggugcagcuggucgagagcggcgggggcguggugcagcccgggcggucccuccggaucagcugcgccuccagccaguucaccuucucccgcuacggcaugcacuggguccggcaggccccggggaagggccuggaguggguggcgagcaucuccuacgacggccgcgacuaccaccacgccggggccguguggggccgguucaucaucagccgcgacaacuccaagaacagccugcaccuccagaugaacucccugcggcccgaggacaccgcccuguacuucugcgcccgcgaccuccgggagagcgagugcgaggagugggaguccgacuacuacgcguucuaccgcaagcugcccugcgucaagccccgcgggguggccggcacgcuggacaucugggggcagggcaccauggugaccgucagcucc

SEQ ID NO: 9540 - RNA, 432 nt, Artificial Sequence
  derived and/or modified sequence opt1 from anti-HIV_cap256-119-065852_VR-Chain
caggugcaccuggucgagagcggcgggggcgccgugcccuccgggcggagccuccggcuguccugcguggccagcggcuucaccuucggggucuacgacauccacugggugcgccaggcgccgggcaagggccuggaguggguggccuccaucagcuacgacgggcgggacaaguaccacuccagccucgucuggggccgccugaccaucucccgggacaacagcaaguccacgcuguuccuccagaugaacagccugcgcgccgaggacaccgcccuguacuacugcgcccgggaccuccgcgaguccgagugcgaggaguggcagagcgacuacuacgcguucuacaagaagcugcccugcgugaagccccgcgggguggccggcacccuggacaucugggggcagggcaccauggucacgguguccagc

SEQ ID NO: 9541 - RNA, 432 nt, Artificial Sequence
  derived and/or modified sequence opt1 from anti-HIV_cap256-119-065457_VR-Chain
cugggccgccucguggccagcgggggcggggucgugcccccgggccggagcccccgccuguccugcguggccucccaguucaccuucagcgggugcggccugcacuggguccggcaggcgcccggcaaggggcucgaguggguggccgccaucuccuucgacggcaccgacaaguaccacagcgacgacgugugggggcgcuucacgaucucccgggacaacagcaagaacacccuguaccugcagaugaacucccuccgccccgaggacaccgcccuguacuacugcgccaaggaccugcaggaggacgagugcgaggagugguggagcgacuacuacgacuucggcaagcagcucccgugccggaagucccgcggggucgcgggcaucuucgacgacuggggccaggggaccauggugacggugagcucc

SEQ ID NO: 9542 - RNA, 432 nt, Artificial Sequence
  derived and/or modified sequence opt1 from anti-HIV_cap256-119-064501_VR-Chain
caggugcagcuggucgagagcggcgggggcguggugcagcccgggcgcucccuccggcugagcugcgccgccuccggcuucaccuucagcuccuacgcgaugcacuggguccgccaggccccggggaagggccuggaguggguggccggcaucagcuacgacgggcgggacaaguaccacgcccacuccguguggggccgccucagcaucucccgggacaacagcaagaacacccuguaccugcagaugaacucccuccgcacggaggacaccgcccuguaccacugcguccgggaccugcgcgagagcgagugcgagcucugggaguccgacuacuacgacuucgggaagaagcugcccugcgugaagccccggggcguggcggggaccuucgaccuguggggccagggcaccauggucacggugagcucc

SEQ ID NO: 9543 - RNA, 432 nt, Artificial Sequence
  derived and/or modified sequence opt1 from anti-HIV_cap256-119-063568_VR-Chain
caggugcagcccgucgagagcggcgggggcgugguguggccggggcggucccugcggcucagcugcaccaccuccggcuucacguucagcaacuacgccauccacuggguccgccaggcccccgggaagggccugcaguggguggcggugaucuccuacgacggcagcaacaaguucuacgccgacuccgucaaggggcgguucaccaucagccgcgacaacuccaagaacacccuguaccuccagaugaacagccugcggcccgaggacaccgcccuguacuacugcgccaaggaccuccgcgaggacgagugcgaggagcggugguccgacuacuacgacuucggcaagcagcugcccugccgcaagagccgcgggguggccggcguguucgacaacugggggcagggcacgauggucaccguguccagc

SEQ ID NO: 9544 - RNA, 435 nt, Artificial Sequence
  derived and/or modified sequence opt1 from anti-HIV_cap256-119-063103_VR-Chain
caggugcagcuggucgagagcggcgggggccucgugcagcccgggaagucccugcgccugagcugcgccgccuccggcuucaccuucagcaccuacgggaugcacugggugcggcaggcgccgggcaagggccucgagugggucgcccugaucuccuacgacgggagcuacacguacuacgccgacuccgugaagggccgcuucaccaucagccgggacaacuccaagagcacccuggaccuccagcugaacacccugcgccccgaggacacggcccucuacuacugcgcccgggaccugcgcgagauggagugcgaggaguggaagcuguacaacuacuacgacuuccggacccgcgggcccugcguggacccccggggcgucgugggguccuucgacguguggggccagggcaccgucgugaccgugagcucc

SEQ ID NO: 9545 - RNA, 432 nt, Artificial Sequence
  derived and/or modified sequence opt1 from anti-HIV_cap256-119-061027_VR-Chain
caggugcagcuggucgagagcggcgggggcguggugcagcccgggcggucccuccggcugagcugcuccgccagcggcuucacccuguccagcuacgggauccacuggguccgccaggccccgggcaagggccucgaguggguggcggugauguccaacgacgggagcaaccaguucuacggcgacuccgucaaggggcgguucaccaucagccgcgacaucuccaagaacacgcuguaccugcagaugaacagccuccggcccgaggacaccgccauguacuacugcgcccgcgaccagcgguacuacgagugcgaggagugggccuccgacuacuacgacuucggccgcgagcagcccugccaggacccccgcgggguggugggcgucuucgacauguggggccaggggaccauggugaccgugagcucc

SEQ ID NO: 9546 - RNA, 432 nt, Artificial Sequence
  derived and/or modified sequence opt1 from anti-HIV_cap256-119-058232_VR-Chain
caggugcagcuggucgagagcggcgggggcguggugcagcccgggaagucccuccgccugagcugcaaggccucccaguucaccuucaaccgguacggcaugcacuggguccgccaggccccggggaagggccuggaguggguggcggccaucagcuucgacggcaccgacaaguaccacgccgacaaggugugggggcgguucacgaucucccgcgacgacagcaaguccacccucuaccugcagaugaacagccugcgggccgaggacaccgcccucuacuacugcgcgaaggaccugcgcgaggacgagugcgaggaguggugguccgacuacuacgacuucggcaagcagcugcccugccggaagucccgcggggucgccggcaucuucgacggguggggccagggcaccauggugacggugagcagc

SEQ ID NO: 9547 - RNA, 432 nt, Artificial Sequence
  derived and/or modified sequence opt1 from anti-HIV_cap256-119-057341_VR-Chain
caggugcagcuggucgagagcggcgggggcguggugcagcccgggcggucccuccggcugagcugcgccgccucccacuucagccuguccagcuacggcaugcacuggguccgccaggcgccggggaagggccucgaguggguggccggcgaguccuucgccgccaccaacaaguacuacgccgacagcgugaaggggcgguucaucgucucccgcgacaucagcaagaacacccuguaccuggaggugaacucccuccgggcggaggacacggcccuguacuacugcgcccgcgaccagcgguacuacgagugcgaggagugggccagcgacuacuacgacuucggccgcgagcagcccugccaggacccccgcgggguggcgggcaucuucgacaucugggggcagggcaccauggucaccguguccagc

SEQ ID NO: 9548 - RNA, 438 nt, Artificial Sequence
  derived and/or modified sequence opt1 from anti-HIV_cap256-119-056895_VR-Chain
cagaugcagcugguggagagcggcgggggcgucgugcagcccgggcgcucccuccggcugagcugcgccgccucccaguucaccuucggcagcuacgggaugcacugggugcgccagaucccgggcaagggccuggagugggucgcgaccaucuccuacgacgggacgaagaaguaccacgccgacagcgugugggaccgguucaucaucucccgcgacaacagcaagaacacccucuuccugcagaugaacucccugcggcccgaggacaccgcccucuacuucugcgugaaggaccagcgccaggacgagugcgaggagugguggagcgacuacuacgacuucggccgggagcugcccugccgcaagucccgggggcugggccucgccgggaucuucgacauguggggccacggcaccauggucacggugagcucc

SEQ ID NO: 9549 - RNA, 432 nt, Artificial Sequence
  derived and/or modified sequence opt1 from anti-HIV_cap256-119-056402_VR-Chain
caggugaagcuggucgagagcggcgggggcguggugcagcccgggaagucccuccggcugagcugcaccgccucccaguucaccuucagcaacuucggcaugcacuggguccggcaggccccggggaagggccuggaguggguggcguccaucagcuucgugggcaucaagaagcacuacgccaacuccguccgcgggcgguucacgaucagccgcgaccaguccaagaacacccucuaccugcagaugaacagcgugcggguggaggacaccgcccgcuacuucugcgcccgggacaugcgcgaguacgagugcgagcugugggccuccgacuacuacgacuucggcaagccccagcccugcgaggacccccgcggggucgugggcaccuucgacaugugggggcucggcacgcuggugaccgucagcucc

SEQ ID NO: 9550 - RNA, 432 nt, Artificial Sequence
  derived and/or modified sequence opt1 from anti-HIV_cap256-119-056034_VR-Chain
caggugcagcuggucgagagcggcgggggcguggugcagcccgggcggucccuccggcugagcugcgccgccuccggcuucaccuucagcuccuacgcgaugcacuggguccgccaggccccggggaagggccuggaguggguggccgccaucagcuucgccggcaccaagacgcacuacgcggacuccgugaaggggcgguucaccaucagccgcgacaacuccaagaacgcccucuaccugcagaugaacaaccugcgggccgaggacaccgcccucuacuacugcgcgaaggaccugcgcgaggacgagugcgaggagcgguggagcgacuacuacgacuucggcaagcagcugcccugccgcaagucccgcggggucgccggcguguucgacaacugggggcagggcaccauggugacggucagcucc

SEQ ID NO: 9551 - RNA, 432 nt, Artificial Sequence
  derived and/or modified sequence opt1 from anti-HIV_cap256-119-055042_VR-Chain
caggugcagcuggucgagagcggcgggggcguggcccagcccgggcgcucccuccggcugagcugcgccgcguccggcuucaccuuccgcagcuacgggaugcacugggugcggcaggccccgggcaagggccuggagugggucgccgugaucucccucgacgggagcaacaaguacuacgccgacuccgugaagggccgcuucagcaucucccgggacaacagcaagaacacccuguaccugcagaugaacucccuccgccccgaggacacggccgucuacuacugcgcgaaggaccugcgggaggacgagugcgaggagcgcuggagcgacuacuacgacuucgggaagcagcugcccugccggaagucccgcggcguggccgggguguucgacaacuggggccagggcaccauggucaccgugagcucc

SEQ ID NO: 9552 - RNA, 438 nt, Artificial Sequence
  derived and/or modified sequence opt1 from anti-HIV_cap256-119-054776_VR-Chain
caggugcagcugauggagagcggcgggggcgucgugcagcccgggcgcucccuccggcugagcugcaccgccuccggcuucaccuucagcuccuacagcaugcacugggugcgccaggccccggggaagggccuggagugggucgcgaucaucuccuacgacgagagcaacaaguacuacgccgacuccgugcagggccgguucacgaucagccgcgacaacuccaagaacacccucuuccugcagaugagcucccugcgggccgaggacaccgcccucuacuucugcgugcgcgaccaccgggaggacgagugcgaggagugguggagcgacuacuacgacuucgggcgcgagcugcccugccggaaguuccgcggccuggggcucgccggcaucuucgacaucugggggcacggcaccauggucacgguguccagc

SEQ ID NO: 9553 - RNA, 432 nt, Artificial Sequence
  derived and/or modified sequence opt1 from anti-HIV_cap256-119-054539_VR-Chain
cagaugcagcugguggagagcggcgggggcgucgugcagcccgggggcucccuccgccugagcugcgccgccucccaguucaccuucgggagcuacgcgaugcacugggugcggcagccgcccggcgagcgccccgagugggucgccaccaucuccuucgacggcacgaagaaguaccacgccgacagcgugugggggcgguucaccaucucccgcgacaacagcaagaacacccuguuccuccagaugaacucccugcggcccgaggacaccgcccuguacuucugcgugaaggaccagcgcgaggacgccugcgaggagugguggagcgacuacuacgacuucggcaagaacugccucgcggaguccccgggggccuggcuggaguucuucuacgucuggggccacgggacgauggugaccgugagcucc

SEQ ID NO: 9554 - RNA, 432 nt, Artificial Sequence
  derived and/or modified sequence opt1 from anti-HIV_cap256-119-054112_VR-Chain
caggugcagcuggucgagagcggcgggggcguggugcaggccgggcggucccuccggcugagcugcgccgcguccggcuucaccuucagcaccuacgccaugcacuggguccgccaggcccccgggaagggccuggaguggguggccgugaucuccuacgacggcagcaacaaguacuacgccgacuccguccgggggcgcuucacgaucagccgggacaacuccaagaacacccucuaccugcagaugaacagccugcgcgcggaggacaccgcccucuacuacugcgccaaggacaugcgggaguacgagugcgaggaguggaccuccgacuacuacgacuucggccgcccgcagcccugcaucgacagccgcgggguggugggcacguuccacgucugggggcagggcaccauggugaccguguccagc

SEQ ID NO: 9555 - RNA, 432 nt, Artificial Sequence
  derived and/or modified sequence opt1 from anti-HIV_cap256-119-053339_VR-Chain
caggugcaccuggucgagagcggcgggggcguggugcagcccgggcggucccuccggcugagcugcgccgccucccacuucagccuguccagcuacggcaugcacuggguccgccaggcgccggggaagggccucgagugggugaccggcaucuccuucgccgggaccaagacguacuacggcgacagcgugcgggggcgcuucaccgucucccgggacaucagcaagaacacccugcugcuccagaugaacucccugcgccccgacgacaccgccaucuacuacugcgcccgggaccagcgcuacuacgagugcgaggagugggccagcgacuacuacgacuucggcaaggagcagcccugccuggacccccgcgggguggugggcaucuucgaccucuggggccaggggacgauggucaccguguccagc

SEQ ID NO: 9556 - RNA, 432 nt, Artificial Sequence
  derived and/or modified sequence opt1 from anti-HIV_cap256-119-052404_VR-Chain
cagaugcagcugguggagagcggcgggggcgucgugcagcccgggcgcucccucacccugagcugcaucgccucccaguucaacuucgccagcuacggcaugcacugggugcggcaggcgccggggaagggccuggagugggucgccuccaucagccacgacggcaccaagaaguaccacgccgaguccgugugggggcgcuucacgaucagcaaggacaacuccaagaacacccucuuccugcagaugaacagccugcggguggaggacaccgcccucuacuucugcgucaaggaccagcgcgaggacgagugcgaggaguggugguccgacuacuacgacuucggcaagcagcugcccugccggaagucccgcgggguggccggcguguucgacaacugggggcagggcaccauggucacggugagcagc

SEQ ID NO: 9557 - RNA, 432 nt, Artificial Sequence
  derived and/or modified sequence opt1 from anti-HIV_cap256-119-051123_VR-Chain
caggugcagcuggucgagagcggcgggggcguggugcagcccgggggcucccuccgccugagcugcgucgggucccaguucauccuguaccgguacggcaugcacugggugcgccaggccccgggcaaggggcucgaguggguggccgcggucagcuucgacggcaccgacaaguaccacgccgacgacgugugggggcgguucaccaucucccgcgacaacagcaagaacauccuguaccugcagaugaacucccuccgggccgaggacacggcccuguacuacugcgccaaggaccugcgcgaggacgagugcgaggagugguggagcgacuacuacgaccucggcaagcagcugcccugccggaagucccgcgggguggcgggcgucuucgacaaguggggccuggggaccauggugaccgugagcucc

SEQ ID NO: 9558 - RNA, 438 nt, Artificial Sequence
  derived and/or modified sequence opt1 from anti-HIV_cap256-119-051077_VR-Chain
gaggugcagcuggucgagagcggcgggggcguggugcaguccgggcgcagccuccggcuguccugcgccgccagccacuucaccuucucccgcuacggcaugcacuggguccggcaggcgcccgggaagggccuggaguggguggccagcaucuccuacgacggccgcgacuucuaccacgcccggagcgugugggggcgcuucaccaucucccgggacaacagcaagaacacccucuuccugcagaugaacucccugcgcaucgaggacacggcccucuacuucugcgucaaggaccagcgggaggacgagugcgaggagugguggagcgacuacuacgacuucggccgcgagcugccgugccggaagucccgcgggcugggccucgccgggaucuucgacauguggggccacggcaccauggugaccgugagcucc

SEQ ID NO: 9559 - RNA, 432 nt, Artificial Sequence
  derived and/or modified sequence opt1 from anti-HIV_cap256-119-050442_VR-Chain
caggcccagaugguggagagcggcgggggcgucgugcagcccgggcggucccugcggcucagcugcgccgcguccggcuucagcuucuccuacuucgccaugcacugggugcgccaggccccggggaagggccuggagugggucgccggcaucagcuucgccgcgaccaagaccuacuacgggggcuccgugaaggggcgguucacggugagccgcgacaucuccaagaacacccuguaccuccagaugaacagccugcggcccgaggacaccgccauguacuacugcgcccgcgaccagcgguacuacgagugcgaggagugggccuccgacuacuacgacuucggccgcgagcagcccugccaggacccccgcggggucgugggcguguucgacauguggggccaggggaccauggucacggugagcucc

SEQ ID NO: 9560 - RNA, 432 nt, Artificial Sequence
  derived and/or modified sequence opt1 from anti-HIV_cap256-119-049433_VR-Chain
caggugcagcuggucgagagcggcgggggcguggugcagcccgggcgcucccuccgggucagcugccgcgccuccggcuucgccuucagcuccuacgcgaugcacugggugcggcaggccccggugaaggggcuggagugggucgcccugaccagcuccgacggcgccgacaaguaccacgccgacgacguguggggccgcuucaccaucagccgggacaacuccaagaacacgcucuaccugcagaugaacagccugcgccccgaggacaccgcgcucuacuacugcgccaaggaccugcgggaggacgagugcgaggagcgcugguccgacuacuacgacuucgggaagcagcugcccugccgcaagagccggggcguggccggggucuucgacaacuggggccaggggaccauggugaccguguccagc

SEQ ID NO: 9561 - RNA, 432 nt, Artificial Sequence
  derived and/or modified sequence opt1 from anti-HIV_cap256-119-047532_VR-Chain
cugggccgccucguggccagcgggggcggggucgugcccccgggccggucccugacccugagcugcguggccucccaguucaccuucagcgggugcggccuccacuggguccgccaggcgcccggcaaggggcuggaguggguggccuccaucagcuucgccggcacgaagaagcacuacaccaacuccgugcgggggcgcuucaccaucagccgggacaacuccaagaacaccgucuaccugcagaugaacagccuccgcgccgaggacacggcccuguacuacugcgcgaaggacaugggcgaguacgagugcgaggaguggaccuccgacuacuacgacuucgggcggccccagcccugcaucgacagccgcggcguggugggcauccuggacaucugggggcagggcaccauggucaccguguccagc

SEQ ID NO: 9562 - RNA, 432 nt, Artificial Sequence
  derived and/or modified sequence opt1 from anti-HIV_cap256-119-047489_VR-Chain
caggugcaccuggucgagagcggcgggggcguggugcagcccgggaagucccuccgccugagcugcgccgccucccaguucaccuucaaccgguucggcaugcacuggguccgccaggcgccggggaagggccuggaguggguggccggcaucagcuacgacggguccgacaaguaccacgccgacaagguguggggccgguucaccaucagccgcgacaacuccaagaacacgcucuaccugcagaugaacagccugcgggccgaggacaccgcccucuacuacugcgcgaaggaccugcgcgaggacgagugcgaggaguggugguccgacuacuacgacuucgggaagcggcugcccugccgcaagagccggggcgucgccgggguguucgacaaguggggccagggcaccauggugaccgucuccagc

SEQ ID NO: 9563 - RNA, 438 nt, Artificial Sequence
  derived and/or modified sequence opt1 from anti-HIV_cap256-119-046020_VR-Chain
gaggugcagcugcuccagagcggcgggggccugguccagcccgggggcucccugcgccucagcugcgccgccuccggguucagcuucuccagcuacgcgauguccuggauccggcaggccccgggcaagggccuggaguggguggccagcaucucccacgacgggaccaagaaguaccacgccgagagcguguggggccgcuucaccaucuccaaggacaacagcaagaacacgcuguuccuccagaugaacucccugcgggucgaggacaccgcccuguacuucugcgugaaggaccagcgcgaggacgagugcgaggagugguggagcgacuacuacgacuucgggcgggagcuccccugccgcaagucccggggccuggggcuggcgggcaucuucgacauguggggccacgggaccauggugaccgucagcucc

SEQ ID NO: 9564 - RNA, 432 nt, Artificial Sequence
  derived and/or modified sequence opt1 from anti-HIV_cap256-119-044746_VR-Chain
caggugcagcuggucgagagcggcgggggcguggugcagcccgggcgcucccuccggcugagcugcgccgccuccggcuucaccuucagcuccuacgcgaugcacuggguccgccaggccccggggaagggccuggaguggguggccgugaucagcuacgacggcuccaacaaguacuacgccgacagcgucaaggggcgguucaccaucucccgcgacaacagcaagaacacgguguaccucgagaugaacucccugcgggccgaggacaccgcgcuguacuacugcgccaaggaccuccgcgaguacgagugcgaggaguggaccagcgacuacuacgacuucggccggccccagcccugcaucgacucccgcgggguggucggcauccuggacaucugggggcagggcaccauggugacggugagcucc

SEQ ID NO: 9565 - RNA, 432 nt, Artificial Sequence
  derived and/or modified sequence opt1 from anti-HIV_cap256-119-044740_VR-Chain
cagaugcaccugguggagagcggcgggggcgucgugcagcccgggaugucccuccgccugagcugcgccgccucccaguucaacuucggcagcuucgggaugcacugggugcggcaggcgccgggcaagggccuggagugggucgccaccaucuccuacgacgggaccaagaaguaccacagcgacuccguguggggccgccucagcaucucccgggacaacagcaagaacacgcuguuccugcagaugaacucccuccgcaccgaggacaccgcccuguacuucugcgugcgggaccagcgcgaggacgacugcgaggagugguggagcgacuacuacgacuucgggaagaagcugcccugccggaagucccgcggccucgccgggaucuucgacaucuggggccacggcaccauggucacggugagcucc

SEQ ID NO: 9566 - RNA, 432 nt, Artificial Sequence
  derived and/or modified sequence opt1 from anti-HIV_cap256-119-043790_VR-Chain
cugcuccagcugguggagagcggcgggggcgucgugcagcccgggaacucccugcggcucagcugcgccgccgcgggcuucaccuucuccgacuacagccugcacugggugcggcaggccccggggaagggccuggagugggucgccaugaucuccgacgacggcaaccucgacuucuacgccgccagcgugaaggggcgcuucaccaucucccgggacaacagcaucaacacgguguaccugcagaugaacucccugcgcgcggaggacaccgcccucuacuacugcgccaaggaccugcgggaguacgagugcgaggaguggaccagcgacuacuacgacuucggccgcccccagcccugcaucgacucccgcggggucgugggcauccuggacaucuggagccaggggaccauggugacggucuccagc

SEQ ID NO: 9567 - RNA, 432 nt, Artificial Sequence
  derived and/or modified sequence opt1 from anti-HIV_cap256-119-042880_VR-Chain
gaggugcgccuggucgagagcggcgggggccucgugcagcccgggggcucccugcggcugagcugcgccgccuccggguucacccucagcgacuacuacauguccuggauccgccaggcgccgggcaagggccuggaguggguggccgccaucagcuucgccgggaccaagaagcacuacggcaacuccgucaaggggcgguucacgaucagccgcgacaacuccaagaacacccuguaccucgagaugaacagccugcggguggaggacaccgcccuguacuacugcgcgaaggaccuccgcgaguacgagugcgaggaguggaccuccgacuacuacgacuucggccggccccagcccugcaucgacagccgcgggguggucggcauccuggacaucuggggccaggggacgauggugaccguguccagc

SEQ ID NO: 9568 - RNA, 432 nt, Artificial Sequence
  derived and/or modified sequence opt1 from anti-HIV_cap256-119-042606_VR-Chain
cagaugcagcugguggagagcggcgggggcgucgugcagcccgggcgcucccuccggcugagcugcgccgccucccaguucaccuucggcagcuacgggaugcacugggugcgccagaucccgggcaagggccuggagugggucaccgggaucuccuucgcggccacgaagaccuacuacggcgacagcgugcgggggcgcuucaccgugucccgggacaucagcaagaacacccucuaccugcagaugaacucccugcgccccgaggacacggccauguacuacugcgcccgggaccagcgcuacuacgagugcgaggagugggccagcgacuacuacgacuucggccgggagcagcccugccaggacccccgcggggucgugggcauccucgaccuguggggccaggggaccauggugaccgucuccagc

SEQ ID NO: 9569 - RNA, 432 nt, Artificial Sequence
  derived and/or modified sequence opt1 from anti-HIV_cap256-119-042444_VR-Chain
caggugcagcuggucgagagcggcggggacguggugcaccccggcgggucccuccgccugagcugcgccgccuccggcuucaccuucagcuccuacgggauccacuggguccggcaggcgccgggcaagggccuggaguggguggccgccaucagcuacgacggguccgacaaguaccacaccaacagcguguggggccgcuucacggucucccgggacaacagcaagaacaccguguaccuccagaugaacucccugcgcgccgaggacaccgcccuguacuucugcgugcgggaccgccgggagagcgagugcgagcucugggaguccgacuacuacgacuucgggaagcgccugcccugcgucaagccccggggcguggcggggguguucgacaucuggggccagggcaccauggucacggugagcucc

SEQ ID NO: 9570 - RNA, 432 nt, Artificial Sequence
  derived and/or modified sequence opt1 from anti-HIV_cap256-119-040328_VR-Chain
caggugcagcuggucgagagcggcgggggcguggugcagcccgggggcucccuccggcugagcugcgccgccuccggguucaccuucagcuccuacagcaugaacuggguccggcaggcgccgggcaagggccuggaguggguggccuccaucagcuucgccgggaccaagcagcacuacggcaacuccgugaaggggcgcuucacgaucagccgggacaacuccaagaacaccgucuaccuccagaugaacagccugcgccuggaggacaccgcccucuacuacugcgccaaggaccugcgggaguacgagugcgaggaguggaccuccgacuacuacgacuucggccgcccccagcccugcaucgacagccgcgggguggugggcauccuggacaucuggggccaggggacgauggucaccguguccagc

SEQ ID NO: 9571 - RNA, 432 nt, Artificial Sequence
  derived and/or modified sequence opt1 from anti-HIV_cap256-119-040164_VR-Chain
cagaugcaccugguggagagcggcgggggcgucgugcagcccgggaugucccuccgccugagcugcgccgccucccaguucaacuucggcagcuucgggaugcacugggugcggcaggcgccgggcaagggccuggagugggucgccaccaucuccuacgacgggaccaagaaguaccacagcgacuccguguggggccgcuucagcaucucccgggacaacagcaagaacacgcucuaccugcagaugaacucccugcgcaccgaggacaccgcccucuacuucugcgccaaggaccugcgggaguacgagugcgaggaguggaccagcgacuacuacgacuucgggcgcccccagcccugcaucgacucccggggcguggucgggauccuggacaucuggggccagggcacgauggugaccgugagcucc

SEQ ID NO: 9572 - RNA, 432 nt, Artificial Sequence
  derived and/or modified sequence opt1 from anti-HIV_cap256-119-039130_VR-Chain
gaggagcagcugguggagagcggcgggggccucguccagcccgggcgcucccugcggcugagcugcaccggcuccggguuccgcuucggcgacuacgccaugaacugggugcggcaggccccgggcaaggggcucgagugggugaccuucaucagcuacgacggcuccaacaagcacuacgcggacagcgucaaggggcgcuucacggugucccgggacaacagcaagaacacccugcaccuccagaugaacucccugcgccccgaggacaccgcccuguacuucugcgcccgggaccugcgcgagagcgagugcgaggagugggaguccuacuacuacgacuucggcaagaaggggcccugcgugaagccccggggcgucgugggcgugcucgacaucugggggcagggcacccuggucacggugagcucc

SEQ ID NO: 9573 - RNA, 432 nt, Artificial Sequence
  derived and/or modified sequence opt1 from anti-HIV_cap256-119-038138_VR-Chain
caggugcagcuggucgagagcggcgggggcguggugcagaccgggcgcucccuccggcugagcugcaccggcucccaguucacguucgggcgcuacggcauguacuggguccggcaggcccccggcaaggggcuggaguggguggccagcaucuccuacgacggccgcgacuucuaccacgcgcggagcgugugggggcgcuucaccaucucccgggacaacagcaagaacacccuccaccuccagaugaacucccugcgcccggaggacaccgcccuguacuucugcgcccgggaccugcgcgagagcgagugcgaggagugggaguccuacuacuacgacuucggcaagaaggggcccugcgucaagccccggggcguggugggcguccuggacaucugggggcagggcacgcucgugaccgugagcucc

SEQ ID NO: 9574 - RNA, 432 nt, Artificial Sequence
  derived and/or modified sequence opt1 from anti-HIV_cap256-119-037868_VR-Chain
caggugcagcuggucgagagcggcgggggcguggugcagcccgggcggucccuccggcugagcugcgccgccucccaguucaccuucagcaaguacggcaugcacuggguccgccaggcgccggggaagggccugcaguggguggccggcaucuccuacgacgggagcgacaaguaccacgcccacuucguguggggccgguucuccaucagccgcgacaacuccaagaacgcccucuaccugcagaugaacagccugcggaccgaggacacggcccucuacuucugcguccgcgaccugcgggaguccgagugcgaggaguggaaguccgacuacuacgacuucgggcgcaagggccccugccugaagccccgcgggguggcgggcagcuucgacaucuggggccaggggaccguggucaccgugagcucc

SEQ ID NO: 9575 - RNA, 432 nt, Artificial Sequence
  derived and/or modified sequence opt1 from anti-HIV_cap256-119-037102_VR-Chain
caggugaagcuggucgagagcggcgggggcguggugcagcccgggaagucccuccggcugagcugcaccgccucccaguucaccuucagcaacuucggcaugcacuggguccggcaggccccggggaagggccuggaguggguggcguccaucagcuucgugggcaucaagaagcacuacgccaacuucguccgcgggcgguucacgaucucccgcgaccagagcaagaacacccucuaccugcagaugaacuccgugcggguggaggacaccgcccgcuacuacugcgcccgggacaugcgcgaguacgagugcgagcugugggccagcgacuacuacgacuucggcaagccccagcccugcgaggacccccgcggggucgugggcaccuucgacaugugggggcucggcacgcuggugaccgucuccagc

SEQ ID NO: 9576 - RNA, 438 nt, Artificial Sequence
  derived and/or modified sequence opt1 from anti-HIV_cap256-119-036683_VR-Chain
ggcgugcagcuggucgagagcgggggcgccguggugcgccccgggggcucccucacccugagcugcgccgcgucccaguucauccugagcuccuacgggaugcacuggguccggcaggccccgggcaagggccucgaguggguggccagcaucuccaacgacgggaccaagaaguaccacgccgagagcgugugggaccgcuucuccaucagcaaggacaacuccaagaacacgcuguuccugcagaugaacagccuccgggucgaggacaccgcccuguacuucugcgugaaggaccagcgcgaggacgagugcgaggaguggugguccgacuacuacgacuucggccgggagcugcccugccgcaagagccgggggcucggccuggcggggaucuucgacauguggggccacggcaccauggugaccgucuccagc

SEQ ID NO: 9577 - RNA, 432 nt, Artificial Sequence
  derived and/or modified sequence opt1 from anti-HIV_cap256-119-036495_VR-Chain
caggugcagcuggucgagagcggcgggggcguggugcagcccgggcgcucccuccggcugagcugcgccgccuccggcuucagcuucuccagcuacgggaugcacuggguccgccaggcgccgggcaagggccuggaguggguggccuccaucagcuucguggggaucaagacccacuacgccaacuccguccggggccgcuucaccaucagccgggaccaguccaagaacacgcucuaccugcagaugaacagcgugcgcaucgaggacaccgcccgguacuucugcgcccgcgacaugcgggaguacgagugcgagcugugggcguccgacuacuacgacuucgggaagccccagcccugcgaggacccccgcggcguggucgggaccuucgacauguggggccucggcacccuggugacggugagcucc

SEQ ID NO: 9578 - RNA, 438 nt, Artificial Sequence
  derived and/or modified sequence opt1 from anti-HIV_cap256-119-035375_VR-Chain
gaggugcagcuggucgagagcggcgggggccucgugcagcccgggcgcucccugcggcugagcugcgccgccuccggcuucacccucgaggacuacgggaugcacugggugcgccaggcgccgggcaagggccuggagugggucgccagcaucuccaacgacgggaccaagaaguaccacgccgagagcgugugggaccgguucuccaucagcaaggacaacuccaagaacacgcuguuccuccagaugaacagccugcgcguggaggacaccgcccuguacuucugcgucaaggaccagcgggaggacgagugcgaggaguggugguccgacuacuacgacuucggccgcgagcuccccugccgcaagagccgggggcugggccuggccgggaucuucgacauguggggccacggcaccauggugaccguguccagc

SEQ ID NO: 9579 - RNA, 438 nt, Artificial Sequence
  derived and/or modified sequence opt1 from anti-HIV_cap256-119-035165_VR-Chain
caggugcaccuggucgagagcggcgggggcguggggcagcccgcccgcucccuccggcugagcugcgccgcguccggcuucauccugagcuccuacgggcuccacugggugcgccaggccccgggcaagggccuggagugggucgcccugaucagcuacgacgggaacaacgaguacuacgccgaguccguguggggccgguucaccaucagcaaggacaacuccaagaacacccucuuccugcagaugaacagccugcgcguggaggacacggcccucuacuucugcgucaaggaccagcgggaggacgagugcgaggaguggugguccgacuacuacgacuucgggcgcgagcugcccugccgcaagagccggggccuggggcucgcgggcaucuucgacauguggggccacgggaccauggugaccguguccagc

SEQ ID NO: 9580 - RNA, 432 nt, Artificial Sequence
  derived and/or modified sequence opt1 from anti-HIV_cap256-119-035109_VR-Chain
caggugcagcuggucgagagcggcgggggcguggugcagcccgggcggucccuccggcugagcugcgccaccgccggcuucaccuucuccagcuacgcgaugcacuggguccgccaggccccggggaagggccuggaguggguggccuccaucagcuacgacggcuccgacaaguaccacgccgaccucgugugggggcgguucacgaucagccgcgacaacuccaagaacacccuguaccugcagaugaacagccuccgggccgaggacaccgcgcuguacuacugcguccgcgacgcccgggaguccgagugcgagcugugggagagcgacuacuacaacuucggccgcaagcuccccugcgugaagccccgcgggguggccggcacccuggacaucugggggcagggcacgauggucaccguguccagc

SEQ ID NO: 9581 - RNA, 339 nt, Artificial Sequence
  derived and/or modified sequence opt1 from anti-HIV_cap256-119-033789_VR-Chain
cagguguaccuggucgagagcggcgggggcguggugcagcccgggcgcucccuccggcugagcugcgccgccucccacuucagccuguccagcuacggcaugcacuggguccgccaggcgccggacaucuccaagaacacccucuaccuccaggugaacagccugcggcccgaggacaccgccauguacuacugcgcccgcgaccagcgguacuacgagugcgaggagugggccuccgacuacuacgacuucgggaaggagcagcccugccuggacccccgcggcguggucggcaucuucgacaucugggggcagggcacgauggugaccgugagcucc

SEQ ID NO: 9582 - RNA, 432 nt, Artificial Sequence
  derived and/or modified sequence opt1 from anti-HIV_cap256-119-033641_VR-Chain
caggugcagcuggucgagagcggcgggggcguggugcagaccgggcggucccuccggcugagcugcaccggcucccaguucacguucgggcgcuacggcauguacuggguccggcaggcccccggcaaggggcuggaguggguggccgcgaucagcuacgacggcuccgacaaguaccacaccaacagcgugugggggcgcuucaccgucucccgggacaacagcaagaacaccguguaccuccagaugaacucccugcgcgccgaggacacggcccuguacuucugcgugcgggaccgccgggagagcgagugcgagcucugggaguccgacuacuacgacuucggcaagcgccugccgugcgucaagccccgcgggguggccggcguguucgacaucuggggccaggggaccauggucaccgugagcucc

SEQ ID NO: 9583 - RNA, 432 nt, Artificial Sequence
  derived and/or modified sequence opt1 from anti-HIV_cap256-119-032113_VR-Chain
caggugcagcuggucgagagcggcgggggcguggugcagcccgggcgcccgcuccggcuguccugcgucggcagcggguucuccuucaucaccagcgccaugcacugggugcgccaggcccccgacaagggccuggaguggguggcgaucaucuccgacggcgggaacaaccggcacuacgccgacagcgucaagggccgcuucaccaucucccgggacaacagcaagaacacgguguuccucgaggugaacaaccugcgccccgaggacaccgccauguacuacugcgcccgggaccagcgcuacuacgagugcgaggagugggccuccgacuacuacgacuucgggcgggagcagcccugccaggacccgcgcggcgucguggggguguucgacauguggggccagggcaccauggucaccgugagcucc

SEQ ID NO: 9584 - RNA, 432 nt, Artificial Sequence
  derived and/or modified sequence opt1 from anti-HIV_cap256-119-031739_VR-Chain
caggugcagcuggucgagagcggcgggggcguggugcagcccgggcgcucccuccggaucagcugcgccgccucccaguucaccuucaaccgcuacggcaugcacuggguccggcaggcgccggggaagggccuggaguggguggccagcaucuccuacgacggcagcgacaaguaccacgccgggcugguguggggccgcuucaucaucucccgggacaacagcaagaacacccucuaccugcagaugaacucccugcgcgccgaggacacggcccucuacuacugcguccgggacgagcgcgagagcgagugcgagcugugggaguccgacuacuacgacuucgggaagaagcugcccugcgugaagccccggggcguggcggggacccucgacaucuggggccagggcacccgcgucaccgugagcucc

SEQ ID NO: 9585 - RNA, 432 nt, Artificial Sequence
  derived and/or modified sequence opt1 from anti-HIV_cap256-119-030932_VR-Chain
gaggugcagcugcucgagagcggcgggggcgucgugcagcccgggcgcucccugcggcugagcugcgccgccuccggcuucgcguucagccacuacgggaucuucugggugcgccaggccccgggcaagggccucgagugggucaccgugaucuccggggacggcagcacccagugguacgccgacuccgugcaggggcgguucacgaucagccgcgacuccagcaagaacacccuguaccugcagauggacggccuccgcggggaggacaccgcccuguacuacugcgccaaggaccugcgggagcucgagugcgaggagugggcguccgacuacuacgacuucggccggccccagcccugccuggacccccgcggcgucagcgggaucuccaacguguggggccaggggaccauggugacggucagcucc

SEQ ID NO: 9586 - RNA, 438 nt, Artificial Sequence
  derived and/or modified sequence opt1 from anti-HIV_cap256-119-030740_VR-Chain
caggugcagcuggucgaguucggcgggggcguggugcagaccgggcgcagccuccggcuguccugcgccgccagcggcuucaccuucuccgacuacgggaugcacuggguccgccaggcgcccggcaagggccuggaguggguggccagcaucuccaacgacgggagcaagaaguaccacggcgacuccgugugggcccgguucaucaucagccgcgacaacuccaagaacacccucuuccugcagaugagcucccugcgggccgaggacacggcccucuacuucugcguccgcgaccaccgggaggacgagugcgaggagugguggagcgacuacuacgacuucgggcgcgagcugccgugccggaaguuccgcggccuggggcucgcgggcaucuucgacaucuggggccacgggaccauggugaccguguccagc

SEQ ID NO: 9587 - RNA, 438 nt, Artificial Sequence
  derived and/or modified sequence opt1 from anti-HIV_cap256-119-030197_VR-Chain
caggugcaccuggucgagagcggcgggggcguggugcagcccgggaagucccuccgccugagcugcgccgccucccaguucaccuucugccgguacggcaugcacuggguccgccaggcgccggggaagggccuggaguggguggccagcaucuccaacgacggcaccgacaaguaccacgccgacaacgugugggggcgguucacgaucagccgcgacaacuccaagaacacccucuaccuggagaugaacagccugcggggcgaggacaccgcccucuacuacugcgccaaggacaugcgcgaggacgagugcgaggaguggugguccgacuacuacgacuucgggaaggagcugcccugccggaaguggaagacccgcggcgucgcggggauccuggacaacuggggccagggcacgauggugaccgugagcucc

SEQ ID NO: 9588 - RNA, 438 nt, Artificial Sequence
  derived and/or modified sequence opt1 from anti-HIV_cap256-119-027047_VR-Chain
cagaugcagcugguggagagcggcgggggcgucgugcagcccgggcgcucccucacccugagcugcgccgccucccaguucaccuuccggaacuacggcaugcacugggugcgccaggcgccggggaagggccuggagugggucgccagcaucuccaaggacggcacgaagaaguaccacggggacagcguguggggccgguucaucaucucccgcgacaacagcaagaacacccucuuccugcagauguccagccugcgggccgaggacaccgcccucuacuucugcgugcgcgaccagcgggaggccgagugcgaggaguggugguccgacuacuacgacuucgggcgcgagcugcccugccggaaguuccgcggccuggggcucgcgggcaucuucgacaucuggggccacgggaccauggucacggugagcucc

SEQ ID NO: 9589 - RNA, 432 nt, Artificial Sequence
  derived and/or modified sequence opt1 from anti-HIV_cap256-119-026950_VR-Chain
caggugcagcuggucgagagcggcgggggcguggugcagcccgggaagucccuccggaucagcugcgccgccucccgguucaccuucggccgcuucgggaugcacuggguccggcaggcgccgggcaagggccuggaguggguggccagcaucuccuacgacgggagcgacaaguaccacgccggccuggugugggggcgcuucaucaucucccgggacaacagcaagaacacccucuaccugcagaugaacucccugcgcgccgaggacacggcccucuacuacugcguccgggacgagcgcgagagcgagugcgagcugugggaguccgacuacuacaacuucggcaagaacuaccccugcgugaagccccgcgggguggcgggcacccuggacaucuggggccaggggaccaccgucaucgugagcucc

SEQ ID NO: 9590 - RNA, 438 nt, Artificial Sequence
  derived and/or modified sequence opt1 from anti-HIV_cap256-119-026279_VR-Chain
cagaugcagcugguggagagcggcgggggcgucgugcagcccgggaccucccucacccugagcugcgccgccucccaguucagcuucacguccuacggcaugcacugggugcgccaggcgccggggaagggccuggagugggucgccagcaucuccaacgacggcaccaagaaguaccacgccgagagcgugugggggcgguucaccaucuccaaggacaacagcaagaacacccucuuccugcagaugaacucccugcgcguggaggacacggcccucuacuucugcgucaaggaccagcgggaggacgagugcgaggagugguggagcgacuacuacgacuucggccgcgagcugcccugccggaagucccgcgggcugggccucgccgggaucuucgacaucuggggccacggcaccguggugaucgucagcucc

SEQ ID NO: 9591 - RNA, 432 nt, Artificial Sequence
  derived and/or modified sequence opt1 from anti-HIV_cap256-119-025355_VR-Chain
gaggugcagcuggucgagagcggcgggggccucgugcagcccgggcgcucccugcggcugagcugcgccgccuccggcuucagcuucuccgacuacgcgaugcacugggugcgccaggccccggggcagggccucgagugggucgccuucaucagcuacgacggcaccaagaaguaccacuccgacagcgugugggggcggcugaccaucucccgcgacaacagccggaacacgcuguuccuccagaugaacucccugcgcaccgaggacaccgcccuguacuucugcgugcgggaccagcgcgaggacgacugcgaggagugguggagcgacuacuacgacuucggcaagaagcuccccugccggaagucccgcgggcuggccggcaucuucgacaucugggggcacggcaccauggucacggugagcucc

SEQ ID NO: 9592 - RNA, 432 nt, Artificial Sequence
  derived and/or modified sequence opt1 from anti-HIV_cap256-119-025301_VR-Chain
caggugcaccuggucgccagcggcgggggcguggugcccccggggcgcucccuccggcugagcugcgucgccucccaguucaccuucagcggcuucgggcuguacugggugcgccaggcgcccggcaagggccucgaguggguggccgccaucuccuucgccgggaccaagaagcacuacgccaacagcgucaagggccgguucacgaucucccgcgacaacagcaagaacacccuguaccugcagaugaacucccuccggcccgacgacaccgcgcuguacuacugcgccaaggaccugcgcgaguacgagugcgaggaguggaccagcgacuacuacgacuucgggcggccccagccgugcaucgacucccgcggcgugguggggauccucgacaucuggagccagggcacgauggucaccguguccagc

SEQ ID NO: 9593 - RNA, 438 nt, Artificial Sequence
  derived and/or modified sequence opt1 from anti-HIV_cap256-119-025010_VR-Chain
caggugcagcuggucgagagcggcgggggcguggugcagcccgggcgcucccuccggcugagcugcccggccuccggcuucagcuucuccaccuacgggaugcacuggguccgccaggcccccggcaagggccuggaguggguggcgagcaucuccaacgacgggaacaagaaguaccacggcgagagcgugugggaccgguucaccaucucccgcgacaacagcaagaacacccucuuccugcagaugaaccggcugcgcgucgaggacacggcccucuacuucugcgugaaggaccagcgggaggacgagugcgaggaguggugguccgacuacuacgacuucgggcgcgagcugcccugccggaaguuccgcggccuggggcucgccggcaucuucgacguguggggccacgggaccauggucaccgugagcucc

SEQ ID NO: 9594 - RNA, 432 nt, Artificial Sequence
  derived and/or modified sequence opt1 from anti-HIV_cap256-119-024631_VR-Chain
caggugcagcugauggagagcggcgggggcgucgugcagcccgggggcucccuccgccugagcugcgccgccuccggguucaccuucagcuccuacggcaugcacugggugcggcaggcgccgggcaaggggcuggagugggucgccggcaucagcuacgacggguccgacaaguaccacgcccacuucguguggggccgcuucaucaucagccgggacaacuccaagaacgcccucuaccugcagaugaacagccugcgccccgaggacaccgcccucuacuucugcgugcgggaccugcgcgaguccgagugcgaggaguggcagagcuacuacuacgacuucgggcggaagggccccugccugaagccccgcggcgucgcgggguccuucgacaucuggggccaggggacgguggugaccgucagcucc

SEQ ID NO: 9595 - RNA, 432 nt, Artificial Sequence
  derived and/or modified sequence opt1 from anti-HIV_cap256-119-024467_VR-Chain
gaggugcagcuggucgagagcggcgggggccucgugcagcccgggggcucccugaacgugagcugcgccgccuccggguucaccuuccgcaccuacgcgaugcacuggguccggcaggccccgggcaagggccuggaguggguggccgccaucagcuacgacggggacaacaaguacuccgccgacagcgugaagggccgcuucacgaucucccgggaccagagcaagaacacccucuaccugcagaugaacuccguccgcguggaggacaccgcgcgguacuacugcgcccgcgacaugcgggaguacgagugcgagcugugggccagcgacuacuacgacuucgggaagccccagcccugcgaggacccccgcggcguggucgggaccuucgacauguggggccucggcacgcuggugaccguguccagc

SEQ ID NO: 9596 - RNA, 432 nt, Artificial Sequence
  derived and/or modified sequence opt1 from anti-HIV_cap256-119-023805_VR-Chain
caggugcagcuggucgagagcggcgggggcguggugcagcccgggaagucccuccgccugagcugcgccgccucccaguucggcuucgggagcuacggcaugcacuggguccggcaggcgccgggcaaggggcuggaguggguggccaccaucuccuucgacggcgccgacaaguaccacgccgacgacgugugggggcgcuucagcaucucccgggacaacagcaagaacacccucuaccugcagaugaacaaccugcgccccgaggacacggcccucuacuacugcgcgaaggaccugcgggaggacgagugcgaggagcgcugguccgacuacuacgacuucggcaagcagcugcccugccggaagucccgcggggucgccggcguguucgacaacuggggccaggggaccauggugaccgucagcagc

SEQ ID NO: 9597 - RNA, 432 nt, Artificial Sequence
  derived and/or modified sequence opt1 from anti-HIV_cap256-119-021736_VR-Chain
caggugcagcuggucgagagcggcgggggcguggugcagcccgggcgguccguccggcucagcugcguggccucccaguucagcuucgaccgcuacggcaugcacugggugcggcaggccccggggaagggccuggagugggucgcguccaucagcuacgacggcaccgacaaguaccacgccgacaaggugugggggcgcuucaccaucucccgggacaacagcaagaagacgcuguaccuccagaugaacucccugcgccccgaggacgccgcccuguacuacugcgccaaggaccuccgggaggacgagugcgaggagugguggagcgacuacuacgacuucggcaagcagcugcccugccgcaagucccgcgggguggcgggcaucuucgacagcugggggcagggcaccauggucaccguguccagc

SEQ ID NO: 9598 - RNA, 438 nt, Artificial Sequence
  derived and/or modified sequence opt1 from anti-HIV_cap256-119-021203_VR-Chain
cagaugcagcugguggagagcggcgggggcgucgugcagcccgggcgcucccucacccugagcugcgccgccucccaguucaccuucagcaacuacggcaugcacugggugcggcaggcgccggggaagggccuggagugggucgccuccgugagcaacgacggcacgaagaaguaccacggggacuccgugugggaccgcuucaccaucagccgggacaacuccaagaacacccucuuccugcagaugagcucccugcgcgccgaggacaccgccgucuacuucugcgugcgggacgagcgcgaggacgagugcgaggagugguggagcgacuacuacgacuucggccgggagcuccccugccgcaaguuccgggggcugggccuggccgggaucuucgacaucuggggccacggcacgcucgugaccgucuccagc

SEQ ID NO: 9599 - RNA, 432 nt, Artificial Sequence
  derived and/or modified sequence opt1 from anti-HIV_cap256-119-020569_VR-Chain
caggugcagcuggucgagagcggcgggggcguggugcagcccggggagucccuccgcaucagcugcgccgccucccaguucaccuucagccgguacggcaugcacuggguccgccaggcgccggggaagggccuggaguggguggccuccaucagcuucgacggccgggacaaguaccacuccagccuggugugggggcgccucaccaucucccgggacaacagcaaguccacgcuguuccugcagaugaacagccuccgccccgaggacaccgcccuguacuacugcgcccgggacguccgcgaguccgagugcgaggaguggcagagcgacuacuacgccuucuaccggaagcugcccugcgugaagccccgcggcguggcggggacccucgacaucuggggccaggggaccauggucacgguguccagc

SEQ ID NO: 9600 - RNA, 432 nt, Artificial Sequence
  derived and/or modified sequence opt1 from anti-HIV_cap256-119-019432_VR-Chain
caggugcagcugguccagagcggcgggggcguggugcagcccgggcgcucccuccggaucagcugcgccgccccguacuucaccuucggccgcuacggguuccacuggguccggcaggcgcccggcaagggccuggaguggguggccuccaucagcuucgacgggcgcgacuacuaccacagcccccacguguggggccggcugaccaucucccgcgacaacuccaagaacacgcucuaccugcagaugaacagccugcgggccgaggacaccgcccucuacuacugcgcccgcgaccugcgggaguccgagugcgaggagugggagagcgacuacuacgacuucgggaagaagggccccugcgucaagccgcgcgggguggcgggcucccuggacauguggggccaggggaccauggugaccgucagcucc

SEQ ID NO: 9601 - RNA, 432 nt, Artificial Sequence
  derived and/or modified sequence opt1 from anti-HIV_cap256-119-018827_VR-Chain
caggcccagcugguggagagcggcgggggcgucgugcagcccgggcgcucccuccggcugagcugcgccgcgucccacuucagcuucaaccgcuacggcaugcacugggugcggcaggccccggggaagggccuggagugggucgccggcaucuccuacgacgggcgcgacuucuaccacgccgacaucguguggggccggcucaccaucagccgcgacaacuccaagaacaccguguaccugcagaugaacagccugcgggccgacgacacggggcucuacuacugcgcgcgcgacguccgggaguccgagugcgaggagugggagagcuacuacuacgacuucggccgcaaggggcccugccugaagccccggggcguggccggcaccuucgacaugugggggcagggcaccaucguguccgucagcgcc

SEQ ID NO: 9602 - RNA, 432 nt, Artificial Sequence
  derived and/or modified sequence opt1 from anti-HIV_cap256-119-018483_VR-Chain
cuggugcagcucgucgagagcggcgggggcguggugcagcccgggaagucccugcgccugagcugcgucgccucccaguucaccuucaaccgguacggcaugcacugggugcgccaggccccggggaagggccucgaguggguggcgggcaucagcuacgacgggcgggacaaguaccacgcccacuucgucuggggccgcaucaccaucucccgggacaacagcaagaacacgcuguaccugcagaugaacucccuccgcgccgaggacaccgcccuguaccacugcgugcgggaccugcgcgagagcgagugcgagcucugggaguccgacuacuacgacuucgggaagaagcugcccugcgugaagccccggggcgucgccgggaucuucgaccuguggggccagggcaccauggugaccgugagcucc

SEQ ID NO: 9603 - RNA, 432 nt, Artificial Sequence
  derived and/or modified sequence opt1 from anti-HIV_cap256-119-018118_VR-Chain
caggugcaccuggucgccagcggcgggggcguggugcccccggggcggucccucacccugagcugcgucgccucccaguucaccuucagcggcugcgggcugcacugggugcggcaggcgcccggcaagggccucgaguggguggccuccaucagcuucgccgggacgaagaagcacuacggcaacuccgucaaggggcgcuucaccaucagccgggacaacuccaagaacacccuguaccugcagaugaacagccuccgccccgaggacaccgcccuguacuacugcgccaaggaccugcgggaguacgagugcgaggaguggacguccgacuacuacgacuucggccgcgaccagcccugcaucgacagccgcgggguggugggcauccucgacaucuggggccaggggaccauggucaccguguccagc

SEQ ID NO: 9604 - RNA, 432 nt, Artificial Sequence
  derived and/or modified sequence opt1 from anti-HIV_cap256-119-017782_VR-Chain
caggugcagcuggucgagagcggcgggggcguggugcagcccgggaagucccuccgccugagcugcgccgccuccggcuucccguucagcaacuacgcgaugcacuggguccggcagacccccgggcgcggccuggaguggguggccggcaucuccuucgccgccaccaagaaguacuaccggcccagcgugcgcgggcgguucacggucuccaccgacaucagcaagaacacccucuaccuggagaugaacucccugcgccccgaggacaccgcccucuacuucugcgcgcgggaccagcgcuacuacgagugcgaggagugggccagcgacuacuacgacuucggccgggagcagccgugccuggacccccgcgggguggugggcaucuucgaccugugggggcagggcacgauggucaccguguccagc

SEQ ID NO: 9605 - RNA, 432 nt, Artificial Sequence
  derived and/or modified sequence opt1 from anti-HIV_cap256-119-017669_VR-Chain
caggugcagcuggucgagagcggcgggggcguggugcagcccggguccagccuccgccuguccugcgccgccagccacuucgcguucaaccgguacggcaugcacuggguccgccaggccccggggaagggccuggaguggguggccggcaucuccuucgacggggccgacaaguuccacgccgacaagguguggggccgguucaccaucagccgcgacaacuccaagaacacccucagccugcagaugaacucccugcggcccgaggacacggcgcucuacuacugcgccaaggaccugcgcgaggacgagugcgaggagugguggagcgacuacuacgacuucgggcggcgccugcccugccggaagucccgcggcgucagcgggaucuucgacaacuggggccagggcaccauggugaccguguccagc

SEQ ID NO: 9606 - RNA, 432 nt, Artificial Sequence
  derived and/or modified sequence opt1 from anti-HIV_cap256-119-016976_VR-Chain
caggugcagcuggucgagagcggcgggggcguggugcagcccgggcggucccuccggcugagcugcgccgccucccaguucagcuucggcgacuucgggaugcacuggguccgccaggcgccgggcaagggccuggaguggguggccgccaucuccuucgccgggaccaagaagaacuacgccgacagcgugcggggccgcuucaccaucucccgggacagcuccaagaacacgcucuaccugcagaugaacagccugcgccccgaggacaccgcgcucuacuacugcgucaaggacaugcggggguacgagugcgaggaguggaccuccgacuacuacgacuucggccgcccccagcccugcaucgacagccgcgggguggugggcaccuucgacgucuggggccaggggacgauggugaccguguccagc

SEQ ID NO: 9607 - RNA, 432 nt, Artificial Sequence
  derived and/or modified sequence opt1 from anti-HIV_cap256-119-015432_VR-Chain
gaggugcagcugcucgagagcggcgggggccugguccagcccgggggcucccugcggcucagcugcgccgccuccggguucaccuucagcggcuacucccugaacugggugcggcaggcgccgggcaaggggcuggaguggguggccagcaucuccuacgacggcagcgacaaguaccacgccgaccgcgucugggggcgguucaccaucucccgcgacaacagcaagaacacgcucuaccugcagaugaacucccugcgggccgaggacaccgcccucuacuacugcgugcgcgacgcgcgggagagcgagugcgagcugugggaguccgacuacuacaacuucggccgcaagcugcccugcgugaagccccgcggggucgccggcacccucgacaucuggggccaggggaccauggugacggugagcucc

SEQ ID NO: 9608 - RNA, 432 nt, Artificial Sequence
  derived and/or modified sequence opt1 from anti-HIV_cap256-119-015281_VR-Chain
cugggccgccucguggccagcgggggcggggucgugcccccgggccggucccugcgccugagcugcguggccucccaguucaccuucagcgggugcggccuccacuggguccggcaggcgcccggcaaggggcuggaguggguggccuccaucagcuucgccggcaccaagaagcacuacgggaacuccgugaagggccgcuucacgaucagccgggacaacuccaagaacaccgucuaccuggagaugaacagccuccgcgccgaggacaccgcccuguacuacugcgcgaaggaccugcgggaguacgagugcgaggaguggaccuccgacuacuacgacuucgggcgcccccagcccugcaucgacagccggggcguggugggcauccucgacaucugggggcagggcacgauggucaccguguccagc

SEQ ID NO: 9609 - RNA, 432 nt, Artificial Sequence
  derived and/or modified sequence opt1 from anti-HIV_cap256-119-014957_VR-Chain
caggugcaggucguggagagcggcgggggcgugguccagcccgggaccucccugcgccucagcugcaccguguccggcuucagcuucuccaacuacgaccugcacugggugcggcagacgccggccaaggggcuggagugggucgccguggugagcuacgacggcucccgcgaguacuacaccgacagcgucaagggccgguucaucaucucccgcgaccagagcaagaacacccucuaccugcagaugaacuccgugcggcuggaggacaccgcgcgcuacuacugcgcccgggacaugcgcgaguacgagugcgagcucugggccagcgacuacuacgacuucgggaagccccagcccugcgaggacccccggggcguggucgggacguucgacauguggggccuggggacccuggugaccguguccagc

SEQ ID NO: 9610 - RNA, 432 nt, Artificial Sequence
  derived and/or modified sequence opt1 from anti-HIV_cap256-119-014777_VR-Chain
caggugcaccuggucgagagcggcgggggcguggugcagcccgggcggucccuccggcugagcugcgccgccucccacuucagccuguccagcuacggcaugcacuggguccgccaggcgccggggaagggccucgaguggguggccggcaucuccuucgccgccaccaagaccuacuacgggggcagcgugaaggggcgguucacggucucccgcgacaucagcaagaacacccuguaccugcagaugaacucccuccggcccgaggacaccgccauguacuacugcgcgcgcgaccagcgguacuacgagugcgaggagugggccagcgacuacuacgacuucggccgcgagcagcccugccaggacccccgcgggguggugggcgucuucgacauguggggccaggggaccauggugacgguguccagc

SEQ ID NO: 9611 - RNA, 432 nt, Artificial Sequence
  derived and/or modified sequence opt1 from anti-HIV_cap256-119-014313_VR-Chain
caggugcagcuggucgagagcggcgggggcguggugcagcccgggcgcucccuccggaucagcugcgccgccucccaguucaccuucagccgcuacggcaugcacuggguccggcaggcgccggggaagggccuggaguggguggccuccaucagcuacgacggccgcgacuaccaccacgccggggccguguggggccgguucaucaucucccgcgacaacagcaagaacucccugcaccuccagaugaacagccugcggcccgaggacaccgcccuguacuucugcgcgcgcgaccuccgggaguccgagugcgaggagugggagagcgacuacuacaacuucuggaagaagcugcccugcgucaagccccgcgggguggugggcauccuggacaucugggggcagggcacggucgugaccguguccagc

SEQ ID NO: 9612 - RNA, 438 nt, Artificial Sequence
  derived and/or modified sequence opt1 from anti-HIV_cap256-119-014219_VR-Chain
cagaugcagcugguggagagcggcgggggcgucgugcagcccggguccagccucacccuguccugcgccgccagccaguucaccuucuccaacuacggcaugcacugggugcgccaggcgccggggaagggccuggagugggucgccagcaucuccaacgacggcacgaagaaguaccacggggacagcgugugggaccgguucaccaucucccgcgacaacagcaagaacacccucuuccugcagaugaacucccugcgggccgaggacaccgcccucuacuucugcgugaaggaccagcgcgaggacgagugcgaggagugguggagcgacuacuacgacuucggccgggagcugcccugccgcaaguuccgggggcugggccucgccgggacguucgacaucuggggccacggcaccaugcugaucgucuccagc

SEQ ID NO: 9613 - RNA, 432 nt, Artificial Sequence
  derived and/or modified sequence opt1 from anti-HIV_cap256-119-013631_VR-Chain
caggugcagcuggucgagagcggcgggggcguggugcagcccgggcgcucccuccggcugagcugcgccgccucccaguucaccuucggcagcuacgggaugcacuggguccgccagaucccgggcaagggccuggaguggguggcgaccaucuccuacgacgggacgaagaaguaccacgccgacagcgugugggaccgguucaucaucucccgcgacaacagcaagaacacccucuuccugcagaugaacucccugcggcccgaggacaccgcccucuacuucugcgucaaggaccagcgccaggacgagugcgaggagugguggagcgacuacuacgacuucggccggcgccugcccugccggaagucccgcgggcuggccggcaucuucgacgugugggggcacggcaccauggugacggucagcucc

SEQ ID NO: 9614 - RNA, 432 nt, Artificial Sequence
  derived and/or modified sequence opt1 from anti-HIV_cap256-119-012924_VR-Chain
caggugacccuggucgagagcggcgggggcuucgugcagcccgggggcucccuccgccugagcugcgccaccuccggguucacguucagcuccuacgccaugcacugggugcggcaggcgccgggcaagggccuggagugggucgccgccaucagcuucgacggggccgacaaguaccacgccgacaacguguggggccgccucuccaucagccgggacaacuccaagagcacccuguaccugcagaugaacucccuccgccccgaggacaccgcgguguacuucugcgccaaggaccugcgggaggacgagugcgaggagcgcuggagcgacuacuacgacuucgggaagcagcugcccugccggaagucccgcggcgucgccgggaucuucgacaacuggggccagggcaccauggugacggugagcgcc

SEQ ID NO: 9615 - RNA, 432 nt, Artificial Sequence
  derived and/or modified sequence opt1 from anti-HIV_cap256-119-011793_VR-Chain
caggugcagcuggucgagagcggcgggggcguggugcagcccgggggcucccuccgccugagcugcgucgccucccaguucaccuucagccgguacgggaugcacugggugcgccaggccccgggcaagggccuggaguggguggcguccaucagcuacgacgggcgggacaaguaccacgccgacuucgucuggggccgccucaccaucucccgggacgacagcaagaagacgcuguaccugcagauggacucccuccgcguggacgacaccgcccuguacuacugcgugcgggacaugcgcgagagcgagugcgagcugugggaguccgacuacuacgacuucgggaagcggcuccccugcgucaagccccgcggcguggccgggaucuucgacaucuggggccagggcaccauggugaccgucagcucc

SEQ ID NO: 9616 - RNA, 432 nt, Artificial Sequence
  derived and/or modified sequence opt1 from anti-HIV_cap256-119-011413_VR-Chain
caggugcagcuggucgagagcggcggggacguggugcagcccggccgcucccuccggcugagcugcgccgccuccggguucaccuucagcaccuacggcaugcacuggguccgccaggcgccggggaagggccuggaguggguggccgccaucuccuucgccggcacgaagaagaacuacgccgacagcgugcgggggcgcuucaccaucucccgggacagcuccaagaacacccucuaccuggagaugaacagccugcgccccgaggacaccgcgcucuacuacugcgccaaggacaugcggggcuacgagugcgaggaguggacguccgacuacuacgacuucgggcgcccccagcccugcaucgacagccggggcgucguggggaccuucgacguguggggccagggcaccauggucaccguguccagc

SEQ ID NO: 9617 - RNA, 432 nt, Artificial Sequence
  derived and/or modified sequence opt1 from anti-HIV_cap256-119-011323_VR-Chain
caggugaagcuggucgagagcggcgggggcguggugcccccggggaagucccuccgccugagcugcaccgccucccaguucaccuucagcaacuucggcaugcacuggguccggcaggcccccgggaagggccuggaguggguggcguccaucagcuucgugggcaucaagacgcacuacgccaacuccguccgcgggcgguucaccaucagccgcgaccaguccaagaacacccucuaccugcagaugaacagcgugcggguggaggacaccggccgcuacuacugcgcccgggacaugcgcgaguacgagugcgagcugugggccuccgacuacuacgacuucgggaagccccagcccugcgaggacccgcggggcgucguggggacguucgacauguggggccucggcacccuggugaccgucagcucc

SEQ ID NO: 9618 - RNA, 432 nt, Artificial Sequence
  derived and/or modified sequence opt1 from anti-HIV_cap256-119-011233_VR-Chain
caggugcaccuggucgagagcggcgggggcguggugcagcccgggcgcuccguccggcucagcugcgccgccucccacuucagccuguccagcuacggcaugcacugggugcgccaggcgccggggaagggccuggagugggugaccggcaucuccuucgccgggaccaagacguacuacggcgacagcguccgggggcgcuucaccgugucccgggacaucagcaagaacacccucuuccugcagaugaacucccugcgccccgacgacaccgccauguacuacugcgcccgggaccagcgcuacuacgagugcgaggagugggccagcgacuacuacgacuucggccgggagcagcccugccucgacccccgcgggguggucggcaucuucgaccuguggggccaggggacgauggugaccguguccagc

SEQ ID NO: 9619 - RNA, 432 nt, Artificial Sequence
  derived and/or modified sequence opt1 from anti-HIV_cap256-119-009038_VR-Chain
caggagcagcugguggagagcggcgggggcgucgugcagcccgggcgcucccuccggcugagcugcguggccucccgcuucaccuucagcgccuucggcaugcacuggguccggcaggcgccggggaagggccuggaguggguggccuccaucagcuucgccggcaucaagaaguacuacggggacuccgugaagggccgcuucaccaucagccgggacaacuccaagaacacgcucuaccugcagauggacgggcugcgcggcgaggacaccgcccucuacuacugcgccaaggaccugcgggagcuggagugcgaggagugggcgagcgacuacuacgacuucgggcgcccccagcccugccucgacccccggggcgucuccggcaucagcaacgugugggggcagggcaccauggugaccgucuccagc

SEQ ID NO: 9620 - RNA, 432 nt, Artificial Sequence
  derived and/or modified sequence opt1 from anti-HIV_cap256-119-008756_VR-Chain
caggugcagcuggucgagagcggcgggggcguggugcagcccgggaagucccuccgccugagcugcgucgugucccaguucaccuucggccgguacgggaugcacugggugcgccaggccccgggcaagggccuggagugggucgccagcaucuccuacgacgggagcgacaaguaccacaccuccagccucuggggccgguucaucgugucccgcgacaacagcaagaacacgcuguaccugcagaugaacucccuccggcccgaggacaccgcgcuguacuacugcgugcgcgaccggcgcgagagcgagugcgaggagcggugguccgacuacuacgacuucgggaagcagcugcccugcgucaagccccgcggcguggccgggaucuucgacaucuggggccagggcaccauggugaccgucagcucc

SEQ ID NO: 9621 - RNA, 438 nt, Artificial Sequence
  derived and/or modified sequence opt1 from anti-HIV_cap256-119-008055_VR-Chain
cagaugcagcugguggagagcggcgggggcgucgugcagcccgggcgcucccucacccugagcugcgccgccucccaguucagcuucgcgaacuacggcaugcacugggugcggcaggccccggggaagggccuggagugggucgccuccaucagcaacgacggcaccaagaaguaccacgaggaguccgugugggggcgcuucacgaucagcaaggacaacuccaagaacacccucuuccugcagaugaacagccugcggaucgaggacaccgcccucuacuucugcgugaaggaccagcgcgaggacgagugcgaggaguggugguccgacuacuacgacuucggccgggagcugcccugccgcaagagccgggggcugggccucgccgggaucuucgacauguggggccacggcaccauggucacgguguccagc

SEQ ID NO: 9622 - RNA, 435 nt, Artificial Sequence
  derived and/or modified sequence opt1 from anti-HIV_cap256-119-006949_VR-Chain
caggugcaccuggucgagagcggcgggggcguggugcagcccgggcgcucccuccggcugagcugcgccgccuccggcuucagcgucuccaacaacuacaugaacugggugcgccaggcgccgggggagggccuggaguggguggcccucaucagcuucgacggccggcagaaggaccuggccgacuccgucaaggggcgcuucgccaucagccgggacaacuccaagaacacccuguaccuccagaugaacagccugcgccuggaggacaccgcccucuacuacugcgcgcgggaccugcgcgagcuggacugcgaggaguggacgcucuacaacuacuacgacuucggcucccgggggcccugcguggacccccgcggcgucgggggcagcuucgacguguggggccaggggaccauggugaccguguccagc

SEQ ID NO: 9623 - RNA, 432 nt, Artificial Sequence
  derived and/or modified sequence opt1 from anti-HIV_cap256-119-006685_VR-Chain
caggugcagcuggucgagagcggcgggggcguggugcagcccgggcgcucccuccgggucagcugcgccgccucccacuucaccuucagccgcuacggcaugcacugggugcggcaggcgccggggaagggccuggaguggguggccuccaucagcuacgacggccgcgacuucuaccacgcccgguccgucugggggcgcuucaccaucagccgggacaacuccaagaacacgcugcaccuccagaugaacagccugcgccccgaggacaccgcccuguacuucugcgcccgggaccuccgcgaguccgagugcgaggagugggagagcuacuacuacgacuucggcaagaaggggcccugcgugaagccccggggcguggucggggugcuggacaucuggggccagggcacccuggugaccgucuccagc

SEQ ID NO: 9624 - RNA, 432 nt, Artificial Sequence
  derived and/or modified sequence opt1 from anti-HIV_cap256-119-006015_VR-Chain
caggugcagcuggucgagagcggcgggggcguggugcagcccgggaagucccuccgccugagcugcgccgccucccgguucaccuucaaccgcuacggcaugcacuggguccggcaggcgccggggaagggccuggaguggguggccgccaucagcuucgacggcaccgacaaguaccacuccgacgacgugugggggcgcuucacgaucagccgggacaacuccaagaacacccucuaccugcagaugaacagccugcgccccgaggacaccgcccucuacuacugcgccaaggaccugcaggaggacgagugcgaggaguggugguccgacuacuacgacuucggcaagcagcugcccugccggaagucccgcggggucgcgggcaucuucgacgacugggggcagggcaccauggugacggugagcagc

SEQ ID NO: 9625 - RNA, 432 nt, Artificial Sequence
  derived and/or modified sequence opt1 from anti-HIV_cap256-119-005841_VR-Chain
caggugcagcuggucgagagcggcgggggcguggugcagcccgggcgcucccuccggcugagcugcgccgccucccaguucagcuucggcaacuucgggaugcacuggguccgccaggcgccgggcaagggccuggaguggguggccgccaucuccuucgccgggaccaaggagaacuacgccaacagcgugcggggccgcuucaccaucucccgggacaacagcaagaacacgcucuaccugcagaugaacucccugcgcgcggaggacaccgcccucuacuacugcaccaaggacaugcgggaguacgagugcgaggaguggaccagcgacuacuacgacuucgggcgcccccagcccugcaucgacucccggggcgucguggggacguucgacguguggggccagggcaccauggucaccgugagcucc

SEQ ID NO: 9626 - RNA, 432 nt, Artificial Sequence
  derived and/or modified sequence opt1 from anti-HIV_cap256-119-005824_VR-Chain
caggugcagcuggucgagagcggcgggggcguggugcagcccgggggcucccuccgccugagcugcgccgccuccggguucaccuuccggcgcuacgcgaugcacuggguccggcaggccccgggcaagggccuggaguggguggccagcaucuccuacgacgggagcgacaaguaccacaccuccagccucuggggccgcuucaucgugucccgggacaacagcaagaacacgcuguaccugcagaugaacucccuccgccccgaggacaccgcccuguacuacugcguccgggaccgccgggagagcgagugcgaggagcgcugguccgacuacuacgacuucgggaagcagcugcccugcgugaagccccggggcguggccgggaucuucgacaucuggggccagggcaccauggucaccgugagcucc

SEQ ID NO: 9627 - RNA, 432 nt, Artificial Sequence
  derived and/or modified sequence opt1 from anti-HIV_cap256-119-005494_VR-Chain
caggugcgccuggucgagagcggcgggggcguggugcagcccgggcggucccuccgcaucagcugcgccgccucccaguucauguucaacaaguacggcaugcacuggguccggcaggcgccggggaagggccuggaguggguggccagcaucuccuacgacggcagcgacaaguaccacgccgaccuggugugggggcgcuucaccaucucccgggacaacagcaagaacacccucuaccugcagaugaacucccugcgcgccgaggacacggcccucuacuacugcguccgggacgcgcgcgagagcgagugcgagcugugggaguccgacuacuacaacuucggccggaagcugcccugcgugaagccccgcgggguggccggcacccucgacaucugggggcagggcaccauggucaccgugagcucc

SEQ ID NO: 9628 - RNA, 432 nt, Artificial Sequence
  derived and/or modified sequence opt1 from anti-HIV_cap256-119-004949_VR-Chain
caggugcagcuggucgagagcggcgggggcguggugcagcccgggcggucccuccggcugagcugcgccgccuccaaguucagccuguccagcuacggcaugcacuggguccgccaggcgccggggcggggccucgaguggguggccggcaucuccuucgccgccaccaagaaguacuaccgccccagcgugcgggggcgcuucaccgucuccacggacaucagcaagaacacccuguaccuggagaugaacucccuccggcccgaggacaccgcccuguacuucugcgcgcgcgaccagcgguacuacgagugcgaggagugggccagcgacuacuacgacuucggccgcgagcagcccugccuggacccgcgcgggguggugggcaucuucgaccucugggggcagggcaccauggucacgguguccagc

SEQ ID NO: 9629 - RNA, 432 nt, Artificial Sequence
  derived and/or modified sequence opt1 from anti-HIV_cap256-119-004422_VR-Chain
cacgugcagcuggucgagagcggcgggggcguggugcagcccgggcgcucccuccggcugagcugcgccgccuccggccugagcuucuccagcuacgcgaugcacuggguccgccaggccccggggaagggccucgaguggguggccguggucuccuacgacggcaccaccaaguucuacgccgacagcgugaaggggcgguucacgaucucccgcgacaacagcaagaacacccuguaccugcagaugaacucccuccggggcgaggacaccgcccuguacuacugcgcgaaggaccugcgcgaguacgagugcgaggaguggaccagcgacuacuacgacuucgggcggccccagcccugcaucgacucccgcggcguggucgggauccucgacaucuggagccagggcacgauggugaccguguccagc

SEQ ID NO: 9630 - RNA, 432 nt, Artificial Sequence
  derived and/or modified sequence opt1 from anti-HIV_cap256-119-003932_VR-Chain
caggugcagcugcucgagagcggcgggggcgucgugcagcccgggggcucccugcgccugagcugcaaggccucccacuucagcuucgaccgguacgggaugcacugggugcgccaggccccgggcaagggccucgagugggucgcggccaucuccuucgacggggccgacaaguaccacgccgacaacguguggggccggcugagcaucucccgcgacaacagcaaguccacccuguaccuccagaugaacagccugcggcccgaggacaccgccguguacuucugcgcgaaggaccugcgcgaggacgagugcgaggagcggugguccgacuacuacgacuucgggaagcagcuccccugccgcaagagccggggcgucgccgggaucuucgacaacuggggccagggcacgauggugaccguguccgcc

SEQ ID NO: 9631 - RNA, 438 nt, Artificial Sequence
  derived and/or modified sequence opt1 from anti-HIV_cap256-119-003577_VR-Chain
caggugcagcuggucgagagcggcgggggcggggugcagcccggccgcucccuccggcugagcugcgccgccuccggguucaccuuccgcagcuacgcgaugcacugggugcggcaggccccgggcaagggccuggagugggucgccgugaucuccaacgacgggaccaagaaguaccacgccgagagcgugugggaccgcuucuccaucagcaaggacaacuccaagaacacccucuuccugcagaugaacagccugcgggucgaggacacggcccucuacuucugcgugaaggaccagcgcgaggacgagugcgaggaguggugguccgacuacuacgacuucggccgggagcugcccugccgcaagagccgggggcugggccucgcggggaucuucgacauguggggccacggcaccauggugaccgucuccagc

SEQ ID NO: 9632 - RNA, 432 nt, Artificial Sequence
  derived and/or modified sequence opt1 from anti-HIV_cap256-119-002155_VR-Chain
cugggccgccucguggccagcgggggcggggucgugcccccgggccggucccugcgccugagcugcguggccucccaguucaccuucagcgggugcggccuccacuggguccgccaggugcccggcaaggggcuggaguggguggcguccaucagcuucgccggcaccaagacgcacuacgggaacuccgucaagggccgguucagcaucucccgggacaacagcaucaacaccguguaccugcagaugaacucccuccgcgccgaggacaccgcccuguacuacugcgccaaggaccugcgggaguacgagugcgaggaguggaccagcgacuacuacgacuucgggcgcccccagcccugcaucgacucccggggcguggucggcauccucgacaucuggagccaggggacgauggugaccguguccagc

SEQ ID NO: 9633 - RNA, 432 nt, Artificial Sequence
  derived and/or modified sequence opt1 from anti-HIV_cap256-119-002017_VR-Chain
caggugcagcuggucgagagcggcgggggcguggugcagcccgggcgcucccuccggcugagcugcgccgccuccggcuucaccuucagcuacuacgggauccacuggguccgccaggcgccgggcaagggccuggaguggguggccuccaucagcuacgacgagcgggacuucuaccacgcccgcuccgugugggggcgguucgccaucagccgcgacaacuccaagaacacccuccaccuccagaugaacagccugcggcccgaggacacggcccuguacuucugcgcgcgcgaccugcgggaguccgagugcgaggagugggagagcuacuacuacgacuucggcaagaaggggcccugcgucaagccccgcggcgugguggggguccuggacaucuggggccagggcacccucgugaccguguccagc

SEQ ID NO: 9634 - RNA, 432 nt, Artificial Sequence
  derived and/or modified sequence opt1 from anti-HIV_cap256-119-001312_VR-Chain
caggugcagcugauggagagcggcgggggcgucgugcagcccgggcgcucccuccggcuggccugcgccgcgagcggcuucaccuucuccagcuacgccauccacugggugcgccaggccccggggaagggccuggagugggucgccgccaucuccuucgcgggcaccaagaagaacuacgccgacagcgugcgggggcgcuucacgaucucccgggacagcuccaagaacacccucuaccuggagaugaacagccugcgccccgaggacaccgcccucuacuacugcgccaaggacaugcggggcuacgagugcgaggaguggaccuccgacuacuacgacuucgggcgcccccagcccugcaucgacagccggggcguggucgggacguucgacguguggggccagggcaccauggugaccgucuccagc

SEQ ID NO: 9635 - RNA, 438 nt, Artificial Sequence
  derived and/or modified sequence opt1 from anti-HIV_cap256-119-001017_VR-Chain
cagaugcagcugguggagagcggcgggggcgucgugcagcccgggcgcucccucacccugagcugcgccgccucccaguucagcuucaccaacuacggcaugcacugggugcggcaggcgccggggaagggccuggagugggucgccuccaucagcaacgacggcaacaagaaguaccacggggaguccgugugggaccgcuucacgaucagccgggacaacuccaagaacacccucuuccugcagaugaaccgccugcggguggaggacaccgcccucuacuucugcgucaaggaccagcgcgaggacgagugcgaggagugguggagcgacuacuacgacuucggccgggagcugcccugccgcaaguuccgggggcugggccucgccgggaucuucgacguguggggccacggcaccauggugacggucuccagc

SEQ ID NO: 9636 - RNA, 432 nt, Artificial Sequence
  derived and/or modified sequence opt1 from anti-HIV_cap256-119-000594_VR-Chain
caggugcagcuggucgagagcggcgggggccucgugcagcccgggaccucccugcgccugagcugcgccgccuccgcguucaccuucaagaacuacggcaugcacugggugcggcaggccccggggaagggccucgacugggucgccagcaucuccuacgacggccgcgacaaguaccacagcucccuggugugggggcggcugacgaucagccgcgacaacuccaagagcacccucuuccugcagaugaacucccugcgggccgaggacaccgcccucuacuacugcgcgcgcgaccugcgggagagcgagugcgaggaguggcaguccgacuacuacgccuucuacaagaagcugcccugcgugaagccccgcggcgucgccgggacccucgacaucuggggccaggggacgauggugaccgugagcucc

SEQ ID NO: 9637 - RNA, 432 nt, Artificial Sequence
  derived and/or modified sequence opt1 from anti-HIV_cap256-059-241099_VR-Chain
caggugcagcuggucgagagcggcgggggcguggugcagcccgggcggucccuccggcugagcugcgccgccuccggcuucaccuucagcuccuacgggaugcacuggguccgccaggcgccgggcaagggccuggaguggguggccgugaucagcuacgacggguccaacaaguacuacgucgacagcgugcagggccgguucaccaucucccgcgacaacagcaagaacacgauguuccuccagaugaacucccugcggaccgaggacaccgccguguacuacugcgcccgcgaccugggggagagcgaggucgaggagugggccaccgacuacuacgacuucuccaucgcguaccccguggagggcccccgcgggguggucggcaucuucgacaucuggggccaggggacgauggugaccgugagcucc

SEQ ID NO: 9638 - RNA, 432 nt, Artificial Sequence
  derived and/or modified sequence opt1 from anti-HIV_cap256-059-207529_VR-Chain
caggugcagcuggucgagagcggcgggggcguggugcagcccgggcgcucccuccggcugagcugcgccgccuccggcuucaccuucagcuccuacgggaugcacuggguccgccaggcgccgggcaagggccuggaguggguggccgggaucagcuucgccggcaucaacaaguacuacgggaacuccgugaagggccgguucaccaucagccgcgacaacucccggaacacgcucuaccugcagaugaacagccugcgcgccgaggacaccgcccucuacuacugcgcgcgggaccugcgcgagauggagugcgaggagugggccuccgacuacuacgacuucgggcggggcggccccugccaggacccccgcggggucgugggcaccuucgacaucugggggcagggcaccauggugacggucagcucc

SEQ ID NO: 9639 - RNA, 435 nt, Artificial Sequence
  derived and/or modified sequence opt1 from anti-HIV_cap256-059-205541_VR-Chain
cagaugcagcugguggagagcggcgggggcgucgugcagcccgggggcucccuccgccugagcugcgccgccuccggguucagcuucuccuacuacgcgauggacugggugcggcaggccccgggcaagggccuggagugggucgccuucaucagcuccgacgggagcgacaagaacuacgccgacuccgugaagggccgcuucaccaucagccgggacaacuccaagaacacccucuaccugcagaugaacagccugcgcgccgaggacacggcgguguacuacugcgccaaggacgucgggggccacaagaacgacgagugggccaccaacuacuacuacgacaucuccaucgccuaccccauccaggacccccgggcgguggccggggccuucgacguguggggccagggcaccauggucaccgugagcucc

SEQ ID NO: 9640 - RNA, 432 nt, Artificial Sequence
  derived and/or modified sequence opt1 from anti-HIV_cap256-059-188439_VR-Chain
caggugcagcuggucgagagcggcgggggcguggugcagcccgggcgcucccuccggcugagcugcgccgccucccaguucaccuucagcaacuacggcaugcacuggguccgccaggcgccggggaagggccuggaguggguggccgccaucuccuucgccggcaucaacaaguacuacaccgacagcgugaaggggcgguucacgaucucccgcgacaacagcaagaacacccucuaccugcagaugaacucccugcgggccgaggacaccgcgcucuacuacugcgccaaggaccugcgcggcuucgagugcgaggagugggccagcgacuacuacgacuucgggcgggaccugcccugccaggacccccgcggcgucguggggaccuucgacguguggggccagggcacgaaggucaccguguccagc

SEQ ID NO: 9641 - RNA, 432 nt, Artificial Sequence
  derived and/or modified sequence opt1 from anti-HIV_cap256-059-187234_VR-Chain
caggugcagcuggucgagagcggcgggggcguggugcaggccgggcgcucccuccggcugagcugcgccgcgucccaguucaccuucggcagcuacgggaugcacuggguccgccaggcccccggcaagggccuggaguggguggccgccaucuccuucgccgggaccaagauccacuacgcggacagcgugaagggccgguucacgaucucccgcgacaacagcaagaacgcccucuaccugcagaugcacucccugcgggccgaggacaccgcccucuacuacugcgcgaaggaccugcgcgaguacgagugcgaggagugggccagcgacuacuacgacuucgggcgggaccagccgugccaggacccccgcggcgucguggggaucuucgacaucuggggccagggcaccauggugaccgucuccagc

SEQ ID NO: 9642 - RNA, 432 nt, Artificial Sequence
  derived and/or modified sequence opt1 from anti-HIV_cap256-059-187047_VR-Chain
caggugcagcuggucgagagcggcgggggcguggugcagcccgggcgcucccuccggcugagcugcgccgucucccagcugaccuucagcuccuacggcaugcacugggugcgccaggccccggggaagggccucgaguggguggcggccaucagcuucgucggcaucaagaaguacuacgccgacuccgugaaggggcgguucaccaucagccgcgacaacuccaagaacacgcuguaccugcagaugaacagccuccggguggaggacaccgcccuguacuacugcgccaaggaccugcgcgaguacgagugcgaggagugggcguccgacuacuacgacuucggccgggaccagcccugccaggacgcccgcggggucgugggcaccagcgacaucugggggcagggcaccauggugacggucuccagc

SEQ ID NO: 9643 - RNA, 432 nt, Artificial Sequence
  derived and/or modified sequence opt1 from anti-HIV_cap256-059-186068_VR-Chain
caggugcagcuggucgagagcggcgggggcguggugcagcccgggcggucccuccggcugagcugcgccgccucccaguucagcuucuccaacuacggcaugcacuggguccgccaggcgccggggaagggccuggaguggguggccggcaucagcuucgccgccaccaagaaguacuacgccgacuccgugaaggggcgguucagcgucucccgcgacaacagcaagaacgcgcucuaccugcagaugaacucccugcgggccgaggacaccgcccucuacuacugcgcccgcgaccugcgggacuacgagugcgaggagugggcgagcgacuacuacgacuucggccgcgaguaccccugccaggacccccgcgggguggugggcacguucgacaucugggggcagggcaccauggucaccguguccacc

SEQ ID NO: 9644 - RNA, 435 nt, Artificial Sequence
  derived and/or modified sequence opt1 from anti-HIV_cap256-059-182835_VR-Chain
caggugcagcuggucgagagcggcgggggccucgugcagcccgggcgcucccugcggcugagcugcgccgccuccggcuucagcuucaacaacuucgcgauggacugggugcgccaggccccggggaagggccucgagugggucgccuucguguccagcgacggcuccaacaagaacuacgccgacagcgugaaggggcgguucaucaucucccgcgacaacagcaagaacaccgucuaccugcagaugaacucccugcggguggaggacaccgccguguacuacugcgcgaaggaccucggcgccaacaaggacgacgagugggccacggacuacuacuacgaccugagcgucgcccgccccgugcccgacccccgggcgguggucggggccuucgacguguggggccaggggaccauggugaccgucuccagc

SEQ ID NO: 9645 - RNA, 432 nt, Artificial Sequence
  derived and/or modified sequence opt1 from anti-HIV_cap256-059-176659_VR-Chain
cgcgugcagcuggucgagagcggcgggggcguggugcagcccgggcggucccuccgccugagcugcgccgccucccaguucagcuucuccaacuacggcaugcacuggguccggcaggcgccggggaagggccuggaguggguggccggcaucagcuucgccgccaucaagaaguacuacgccgacuccgugaaggggcgcuucaccaucagccgggacaacuccaagaacgcgcucuaccugcagaugaacagccugcgcgccgaggacaccgcccucuacuacugcgcccgggaccugcgcgaguacgagugcgaggagugggcguccgacuacuacgacuucggccgggagcugcccugccaggacccccgcggggucgugggcacguucgacaccugggggcagggcaccauggugaccgucagcacg

SEQ ID NO: 9646 - RNA, 432 nt, Artificial Sequence
  derived and/or modified sequence opt1 from anti-HIV_cap256-059-172956_VR-Chain
caggugcagcuggucgagagcggcgggggcguggugcagcccgggcggucccuccggcugagcugcgccgccucccaguucagcuucuccagcuacggcaugcacuggguccgccaggcgccggggaagggccuggaguggguggccgccauguccuucgccggcaccaaccaguacuacgccgcgagcgugaaggggcgguucaccaucucccgcgacaacagcaagaacacgcucuaccugcacaugaacucccugcggcccgaggacaccgcccucuacuacugcgcccgcgaccugcgggaguacgagugcgaggagugggccgcggacuacuacgacuucggccgcgaguaccccugccaggacccccgcggggucgugggcaucuucgacgugugggggcagggcacccuggucaccgugagcucc

SEQ ID NO: 9647 - RNA, 432 nt, Artificial Sequence
  derived and/or modified sequence opt1 from anti-HIV_cap256-059-171272_VR-Chain
caggugcugcucgucgagagcggcgggggcguggugcagcccgggcgcucccugcggcugagcugcgccgccucccaguucaccuucagcaacuacggcaugcacuggguccgccaggcgccggggaagggccucgaguggguggccgccaucuccuucgccggcaugaagaaguacuacgccgacagcgugaaggggcgguucaccaucucccgcgacaacagcaagaacacgcuguaccugcagaugaacucccuccgggcggaggacaccgcccuguacuacugcgccaaggaccugcgcgaguucgagugcgaggagugggccagcgacuacuacgacuucggccgggcgcagcccugccaggacccccgcggggucgugggcaccuucgaccucugggggcagggcaccauggugacggucuccagc

SEQ ID NO: 9648 - RNA, 432 nt, Artificial Sequence
  derived and/or modified sequence opt1 from anti-HIV_cap256-059-168734_VR-Chain
caggugcagcuggucgagagcggcgggggcguggugcagcccgggcgcucccuccggcugagcugcaccgccucccaguucagcuucuccagcuacggcaugcacuggguccgccaggccccggggaagggccuggaguggguggcggccaucuccuucgccggcaccaagaaguacuacguggggacggucaagggccgguucaccaucagccgcgacaacuccaagaacacccucuaccugcagaugaacagccugcgggccgaggacaccgcccucuacuacugcgcgaaggacaugcgcgaguacgagugcgaggagugggccuccgacuacuacgacuucgggcgggaguaccccugccaggacccccgcggcgugguggggacguucgacaucuggggccagggcaccauggucaccgugagcucc

SEQ ID NO: 9649 - RNA, 432 nt, Artificial Sequence
  derived and/or modified sequence opt1 from anti-HIV_cap256-059-155838_VR-Chain
caggugcagcuggucgagagcggcgggggcguggugcagcccgggcgcucccuccggcugagcugcgccgucucccaguucaccuucagcaacuacggcaugcacugggugcgccaggccccggggaagggccuggaguggguggcggccaucuccuucgccggcaccaagaaguccuacgccgccagcgucaaggggcgguucacgaucagccgcgacaacuccaagaacacccucuaccugcagaugaacagccugcggcccgaggacaccgcgcucuacuacugcgccaaggacaugcgcggcuucgagugcgaggagugggccuccgacuacuacgacuucgggcgggagcagcccugccaggacccccgcggcgugguggggaucuucgaccuguggggccagggcaccauggucagcguguccagc

SEQ ID NO: 9650 - RNA, 432 nt, Artificial Sequence
  derived and/or modified sequence opt1 from anti-HIV_cap256-059-149799_VR-Chain
caggugcaccuggucgagagcggcgggggcguggugcagcccgggcgcucccuccggcugagcugcgccgccucccaguucaccuucagcaacuacggcuuccacuggguccgccaggcgccggggaagggccuggaguggguggccgccaucuccuucgccggcgugaagaagcacuacgccgacagcgucaaggggcgguucaccaucucccgcgacaacagcaagaacacgcucuaccugcagcugaacucccuccgggcggaggacaccgcccuguacuacugcgccaaggaccugcgcgaguacgagugcgaggagugggccagcgacuacuacgacuucggccgggacuuccccugccaggacccccgcgggguggugggcaccuucgacaucugggggcagggcaccauggucacgguguccagc

SEQ ID NO: 9651 - RNA, 432 nt, Artificial Sequence
  derived and/or modified sequence opt1 from anti-HIV_cap256-059-148168_VR-Chain
caggugcagcuggucgagagcggcgggggcguggugcagcccgggcgcucccuccggcugagcugcaccgccucccaguucaccuucagcaacuacggcaugcacuggguccgccaggccccggggaagggccuggaguggguggcgggcaucuccuucgccgccacgaagaaguacuacagcgacuccgugaaggggcgguucaccaucagccgcgacaacuccaagaacgcccucuaccugcagaugaacagccugcgggccgaggacaccgcgcucuaccacugcgccaaggaccugcgcgaguacgagugcgaggagugggccuccgacuacuacgacuucggccgggagcagcccugccaggacccccgcggggucgugggcaccuucgacaucugggggcagggcacgauggugaccgucagcacc

SEQ ID NO: 9652 - RNA, 435 nt, Artificial Sequence
  derived and/or modified sequence opt1 from anti-HIV_cap256-059-144685_VR-Chain
caggugcaccuggucgagagcggcgggggcguggugcagcccgggcgcucccuccggcugagcugcgccgccuccggcuucaccuucagcaacuucgcgauggacuggguccgccaggccccggggaagggccuggaguggguggccuucguguccagcgacggcaacaacaagaacuacggggacuccgucaagggccgguucaccaucagccgcgacaacuccaagaacacccucuuccugcagaugaacagccugcgggccgaggacacggcccucuacuacugcgugaaggacgugggggacuacaaguccgacgagugggcgacccacuacuacuacgaccugagcaucgccgaccccauccaggacccccgcgccgucgugggcgccuucgacaucugggggcggggcaccaugguggcggucuccagc

SEQ ID NO: 9653 - RNA, 432 nt, Artificial Sequence
  derived and/or modified sequence opt1 from anti-HIV_cap256-059-140017_VR-Chain
caggugcagcuggucgagagcggcgggggcguggugcagcccgggcgcucccuccggcugagcugcgccgccucccaguucagcuucggcaacuucgggaugcacuggguccgccaggcgccgggcaagggccuggaguggguggccgggaucuccuucgccggcaccaagaaguacuacgccgacagcgugaaggggcgguucaccaucucccgcgacaacagcaaguccgcccucuuccugcagaugaacagccugcgggcggaggacacggcccucuacuacugcgccaaggaccugcgcuacuacgagugcgaggagugggccuccgacuacuacgacuucggccgggaccagcccugccaggacccccgcggggucgugggcaccuucgacauguggggccaggggaccauggugaccgucagcucc

SEQ ID NO: 9654 - RNA, 432 nt, Artificial Sequence
  derived and/or modified sequence opt1 from anti-HIV_cap256-059-137547_VR-Chain
caggugcagcuggucgagagcggcgggggcguggugcagcccgggcgcucccuccggcugagcugcgccgccucccaguucaccuucagccgcuacggcaugcacuggguccggcaggcgccggggaagggccuggaguggguggccgccaucuccuucgccggcaucaagaagaacuacgccgacagcgugaaggggcgcuucaccaucucccgggacaacagcaagaacacgcucuaccugcagaugaacucccugcgcgcggaggacaccgcccucuacuacugcgcccgggaccugcgcgaguucgagugcgaggagugggccagcgacuacuacgacuucggccgggacuuccccugccaggacccccgcggggucgugggcaucuucgacaucugggggcagggcaccauggugaccgucuccagc

SEQ ID NO: 9655 - RNA, 435 nt, Artificial Sequence
  derived and/or modified sequence opt1 from anti-HIV_cap256-059-131908_VR-Chain
caggugcagcuggucgagagcggcgggggcguggugcagcccgggcgcucccuccggcugagcugcaccgccuccggcuucaccuucagcaacuacgggauccacuggguccgccaggccccgggcaagggccuggaguggguggcggccaucuccuacgaggggagcaucaaguacuacguggacuccgucaagggccgguucacgaucagccgcgacgacuccaagaacacccucuuccugcagaugaacagccugcggaccgaggacaccgccguguacuacugcacgcgcgacgugcgggagugggagaccgaggagugggccaccaacuacuacuacgaccucuccaucgccuaccccauccgccacccccgcggggucgugggcaucuucgacgugugggggcugggcacccgggucacggugagcucc

SEQ ID NO: 9656 - RNA, 432 nt, Artificial Sequence
  derived and/or modified sequence opt1 from anti-HIV_cap256-059-116006_VR-Chain
caggcccagcugguggagagcggcgggggcgucgugcagcccgggcgcucccuccggcugagcugcgccgcgucccaguucagcuucuccagcuacggcaugcacugggugcgccaggccccggggaagggccuggagugggucgccuccaucagcuucgccggcgugaagaagaccaacgccgacuccgugaaggggcgguucaccaucagccgcgacaacuccaagaacacgcuccaccuccagaugaacggccugcggaacgacgacaccgcgcuguacuacugcgcccgcgaccugcgggacuucgagugcgaggagugggccagcgacuacuacgacuucgggcgcgaguuccccugccaggacccccggggcgucguggggaccuucgacaucuggggccagggcaccaaggugacggucuccagc

SEQ ID NO: 9657 - RNA, 411 nt, Artificial Sequence
  derived and/or modified sequence opt1 from anti-HIV_cap256-059-115783_VR-Chain
caggugcagcuggucgagagcggcgggggcguggugcagcccgggcgcucccuccggcugagcugcgccgccucccaguucaccuucagcuccuacggcaugcacuggguccgccaggcgccggggaagggccuggaguggguggccgccaucagcuacgccgacuccgugaagggccgguucaccaucagccgcgacaacuccaagaacacgcucuaccugcagaugaacagccugcgggccgaggacaccgcgcucuacuacugcgccaaggaccugcgcgagauggagugcgaggagugggccuccgacuacuacgacuucgggcgggaccugcccugccaggacccccgcggcgucguggggacccucgacaucuggggccaggggaccauggugacggucagcucc

SEQ ID NO: 9658 - RNA, 432 nt, Artificial Sequence
  derived and/or modified sequence opt1 from anti-HIV_cap256-059-114609_VR-Chain
caggugcagcuggucgagagcggcgggggcguggugcagcccgggcgcucccuccggcugagcugcgccgccucccagcugaccuucagcaacuucggcaugcacuggguccgccaggcgccggggaagggccucgaguggguggccggcaucuccuucgccgggaccaagaaguacuacgccgacagcgugaagggccgguucacgaucucccgcgacaacagcaagaacgcccuguaccugcagaugaacacccuccgggcggaggacaccgcccuguacuucugcgccaaggaccugcgcgaguacgagugcgaggagugggccuccgacuacuacgacuucgggcgggaccagcccugccaggacccccgcggcgucguggggaucuucgacaucuggggccagggcaccauggugacggucagcucc

SEQ ID NO: 9659 - RNA, 432 nt, Artificial Sequence
  derived and/or modified sequence opt1 from anti-HIV_cap256-059-113952_VR-Chain
caggcccagcugguggagagcggcgggggcgucgugcagcccgggcgcucccuccggcugagcugcgccgcgucccacuucaccuucagcuccuacggcuuccacugggugcgccaggccccggggaagggccuggagugggucgccggcaucagcuucgccgccaccaagaaguacuacgcggacuccgugaaggggcgguucacgaucagccgcgacaacuccaaggacgcccucuaccugcagaugaacagccugcgggccgaggacaccgcccucuacuacugcgcgcgcgaccugcggggcuacgagugcgaggagugggccuccgacuacuacgacuucgggcgcgaccagcccugccaggacccccggggcguggucgggaucuucgaccuguggggccagggcaccauggugaccgugagcucc

SEQ ID NO: 9660 - RNA, 432 nt, Artificial Sequence
  derived and/or modified sequence opt1 from anti-HIV_cap256-059-113878_VR-Chain
caggugcagcuggucgagagcggcgggggcguggugcagcccgggcgcucccugcggcugagcugcgccgccuccggcuucaccuucagcaccuacgcgaugcacuggguccgccaggccccggggaagggccuggaguggguggcccucaucuccuacgacgccacgaacaaguacuacguggacagcgucaagggccgguucaccaucucccgcgacaacagcaagaacacccuguaccugcagauguccagccucaccgccgaggacacggcgguguacuacugcgccaaggaccucgggggcaucaagaucgacgagugggggaccgacuacuacgacaucuccgugagcuaccccguccaggacccccgggccguggccggcaucuucgacgugugggggcacggcaccauggucuccgugagcucc

SEQ ID NO: 9661 - RNA, 432 nt, Artificial Sequence
  derived and/or modified sequence opt1 from anti-HIV_cap256-059-113622_VR-Chain
caggugcagcuggucgagagcggcgggggcguggugcagcccgggcgcucccuccggcugagcugcgccgccucccaguucaccuucaccagcuacggcaugcacuggguccgccaggcgccggggaagggccuggaguggguggccggcaucuccuucgccgggacgaagaagcacuacgccgacagcgugaagggccgguucaccaucucccgcgacaacagcaaguccacccucuaccugcagaugaacagccugcgggccgaggacaccgcgcucuacuacugcgccaaggacaugcgcgaguacgagugcgaggagugggccuccgacuacuacgacuucgggcgggaccagcccugccaggacccccgcggcgucguggggaucuucgaccuguggggccagggcacgauggugaccgucagcucc

SEQ ID NO: 9662 - RNA, 432 nt, Artificial Sequence
  derived and/or modified sequence opt1 from anti-HIV_cap256-059-109427_VR-Chain
caggugcagcuggucgagagcggcgggggcguggugcagcccgggcggucccuccggcugagcugcgccgccucccaguucaccuucagcaacuacggcaugcacuggguccgccaggcgccggggaagggccuggaguggguggccuccaucagcuucgccggcaucaagaagcacuacaccgacuccgugaaggggcgguucacgaucagccgcgacaacuccaagaacacccucuuccugcagaugaacagccugcgggccgaggacaccgcccucuacuacugcgcgcgcgaccugcgggaguacgagugcgaggagugggccuccgacuacuacgacuucggccgcgaccagcccugccaggacccccgcggggucgugggcaccagcgacaucugggggcagggcacgaaggugaccgucuccagc

SEQ ID NO: 9663 - RNA, 432 nt, Artificial Sequence
  derived and/or modified sequence opt1 from anti-HIV_cap256-059-109081_VR-Chain
caggagcagcugguggagagcggcgggggcgucgugcagcccgggcgcucccuccggcugagcugcgccgccucccaguucagcuucuccgcguacggcaugcacugggugcgccaggccccggggaagggccuggagugggucgccggcaucagcuucgccgccaccaagaaguacuacgaggacuccgugaaggggcgguucaccaucagccgcgacaacuccaagaacacgcucuaccugcagaugaacagccugcggggcgaggacaccgcgcucuacuacugcgccaaggacaugcgcgagauggagugcgaggagugggccuccgacuacuacgacuucgggcggccccagcccugccaggacccccgcggcguggucgggaucuucgacauguggggccagggcaccauggugaccgugagcucc

SEQ ID NO: 9664 - RNA, 432 nt, Artificial Sequence
  derived and/or modified sequence opt1 from anti-HIV_cap256-059-107590_VR-Chain
caggagcagcugguggagagcggcgggggcgucgugcagcccgggcgcucccuccggcugagcugcgccgccucccaguucagcaucuccgcguacggcaugcacugggugcgccaggccccggggaagggccuggagugggucgccggcaucagcuucgccgggaccaagaaguacuacgccgacuccgugaagggccgguucaccaucagccgcgacaacuccaagaacacgcucuaccugcagaugaacagccugcgcggggaggacaccgcgcucuacuacugcgccaaggacaugcgggagauggagugcgaggagugggccuccgacuacuacgacuucggccgggaccagcccugccaggacccccgcgggguggucggcaucuucgacauguggggccaggggaccauggugaccgugagcucc

SEQ ID NO: 9665 - RNA, 435 nt, Artificial Sequence
  derived and/or modified sequence opt1 from anti-HIV_cap256-059-107504_VR-Chain
caggugcugcucgucgagagcggcgggggcguggugcagcccgggaagucccugcgccugagcugcuccgccagccgguucaccuucuccaacuacggcaugcacuggguccgccaggccccggggaagggccucgaguggguggcggccgugagcuucgccggcaucaagaagaccaacgccgacuccgucaaggggcgguucacgaucagccgcgacaacuccaagaacacccuguaccugcagaugaacagccuccgggccgaggacaccgcgcuguacuacugcgcccgcgaccugcgggacuucgagugcgaggagugggccuccgacuacuacgacuucuggggcgacccccagcccugccaggacccccgcgggguggugggcaccuucgaccucugggggcagggcacgauggucaccgugagcucc

SEQ ID NO: 9666 - RNA, 432 nt, Artificial Sequence
  derived and/or modified sequence opt1 from anti-HIV_cap256-059-099614_VR-Chain
gaggugcugcuccuggagagcggcgggggccugguccagcccgggcgcucccuccggcugagcugcgccgccucccaguucaccuucagcuccuacggcaugcacugggugcgccaggcgccggggaagggccuggaguggguggccggcaucagcuucgucgggaucaagaaguacuacgccgacuccgugaagggccgguucaccaucagccgcgacaacuccaagaacacgcucuaccugcagaugaacagccugcgggccgaggacaccgcccucuacuacugcgcgcgcgaccugcgggaguacgagugcgaggagugggccuccgacuacuacgacuucgggcgcgaccagcccugccaggacccccggggcguggucgggaccuucgacaucuggggccagggcaccauggugacggugagcucc

SEQ ID NO: 9667 - RNA, 432 nt, Artificial Sequence
  derived and/or modified sequence opt1 from anti-HIV_cap256-059-098972_VR-Chain
caggugcagcuggucgagagcggcgggggcguggugcagcccgggcgcucccuccggcugagcugcgccgccucccaguucaccuucagcuccuacggcaugcacuggguccgccaggcgccggggaagggccuggaguggguggccagcaucuccuucgccggcaucaagaagaacuaccgggacagcgugaaggggcgcuucaccaucucccgggacaacagcaagaacacgcucuaccugcagaugaccucccugcgccccgaggacaccgcccucuacuacugcgccaaggaccugcggggcuucgagugcgaggagugggcgagcgacuacuacgacuucgggcgcgagcugcccugccaggacccccggggcgucguggggaccuucgacauguggggccagggcacgauggugaccgucuccagc

SEQ ID NO: 9668 - RNA, 432 nt, Artificial Sequence
  derived and/or modified sequence opt1 from anti-HIV_cap256-059-097236_VR-Chain
caggugcagcuggucgagagcggcgggggcguggugcagcccgggcgcucccuccggcugagcugcgccgccuccggcuucagcuucuccaacuucggguuccacuggguccgccaggcgccgggcaagggccuggaguggguggccgccaucagcuucguggggaacaagaaguacuacgccgaguccgucaagggccgguucaccaucagccgcgagaacuccaagaacaugcuguuccuccagaugaacagccugcgcggggaggacaccgccguguacuacugcgcgaaggaccuccgggaguucgagugcgaggagugggccuccgacuacuacgacuucggccgggagcagcccugccaggacccccgcgggguggucggcagcaucgacguguggggccacgggucccuggugacggucagcucc

SEQ ID NO: 9669 - RNA, 432 nt, Artificial Sequence
  derived and/or modified sequence opt1 from anti-HIV_cap256-059-091487_VR-Chain
caggugcagcuggucgagagcggcgggggcguggugcagcccgggcgcucccuccggcugagcugcgccgccucccaguucaccuucaaccgcuacggcaugcacuggguccggcaggcgccggggaagggccuggaguggguggccgugaucagcuacgacggcaccaacaaguacuacggggaguccgucaagggccgcuucacgaucagccgggacaacuccaagaacacccucuaccugcagaugaacagccugcgcgccgaggacaccgcccucuacuacugcgccaaggaccugcgggaggacgagugcgaggaguggugguccgacuacuacgacuucgggcgcgagcugcccugccgcaagagccggggcguggcggggaucuucgacaucuggggccagggcaccauggugacggucuccagc

SEQ ID NO: 9670 - RNA, 432 nt, Artificial Sequence
  derived and/or modified sequence opt1 from anti-HIV_cap256-059-089812_VR-Chain
caggugcagcuggucgagagcggcgggggcguggugcagcccgggcgcucccuccggcugagcugcgccgccucccagcugaccuucagcuccuacggcaugcacuggguccgccaggcgccggggaagggccucgaguggguggccggcaucagcuucgccgggaccaagaagcacuacuccgacagcgugaagggccgguucacgaucucccgcgacaacagcaagaacgcccuguaccugcagaugaacucccuccgggccgaggacaccgcgcuguacuacugcgccaaggaccugcgcgaguacgagugcgaggagugggccagcgacuacuacgacuucgggcgggagcagcccugccaggacccccgcggcgucguggggaucuucgacauguggggccagggcaccauggugaccgucuccagc

SEQ ID NO: 9671 - RNA, 432 nt, Artificial Sequence
  derived and/or modified sequence opt1 from anti-HIV_cap256-059-088468_VR-Chain
caggugcagcuggucgagagcggcgggggcguggugcagcccgggcggucccuccggcugagcugcgccgccucccaguucaccuucagcuccuacggcaugcacuggguccgccaggcgccggggaagggccuggaguggguggccgccaucagcuucgugggcaucaagaaguacuacgccaacuccgucaaggggcgguucaccaucagccgcgacaacuccaagaacacgcucuaccugcagaugaacagccugcgggccgaggacaccgcgcucuacuacugcgcccgcgaccugcgggaguacgagugcgaggagugggccuccgacuacuacgacuucggccgcgggggccccugccaggacccccgcgggguggugggcagcuucgacaucuggggccaggggaccauggucaccguguccagc

SEQ ID NO: 9672 - RNA, 432 nt, Artificial Sequence
  derived and/or modified sequence opt1 from anti-HIV_cap256-059-088341_VR-Chain
caggugcagcuggucgagagcggcgggggcguggugcagcccgggcggucccuccggcugagcugcgccgccucccaguucaccuucagcuccuacggcaugcacuggguccgccaggcgccggggaagggccuggaguggguggccgccaucagcuucgccggcaucaagaagcacuacgccgacuccgugaaggggcgguucaccaucagccgcgacaacuccaagaacauggucuuccuccagaugaacagccugcgggcggaggacacggcccuguacuacugcgcccgcgaccuccgggaguacgagugcgaggagugggccuccgacuacuacgacuucggccgcgaccagcccugccaggacccccgcgggguggugggcaccagcgacaucugggggcagggcaccauggucaccguguccagc

SEQ ID NO: 9673 - RNA, 432 nt, Artificial Sequence
  derived and/or modified sequence opt1 from anti-HIV_cap256-059-086533_VR-Chain
caggugcugcucgucgagagcggcgggggcguggugcagcccgggcgcucccugcggcugagcugcgccgccucccaguucaccuucagcaacuucggcaugcacuggguccgccaggcgccggggaagggccucgaguggguggccggcaucuccuucguggggaucaagaaguacuacgccggcagcgucaaggggcgguucaccaucucccgcgacaacagcaagaacacgcuguaccugcagaugaacucccuccgggccgaggacaccgcccuguacuacugcgcgaaggaccugcgcgaguucgagugcgaggagugggccagcgacuacuacgacuucggccggccccagcccugccaggacccccgcgggguggugggcaccuucgaccucuggggccuggggacccuggucacgguguccagc

SEQ ID NO: 9674 - RNA, 432 nt, Artificial Sequence
  derived and/or modified sequence opt1 from anti-HIV_cap256-059-086043_VR-Chain
gaggugcaccuggucgagagcggcgggggccucgugaagcccgggggcucccugcgccugagcugcgccgccuccggguucaccuucagcaccuacuccaugaacugggugcggcaggcgccgggcaagggccucgagugggucgccuucguggccuucgacgagagcgacaaguacuacgccgacuccgugaaggggcgcuucacgaucagccgggacaacuccaagaacacccugagccugcagaugaacucccuccgcgucgaggacaccgccaucuacuacugcgcgaaggaggugggcgacaacaaggacgacgagugggccagcgacuacuacgaccuguccaucgccuaccccauccaggacccccgggccguggggcgcggcuacgacaucugggggcagggcaccauggucacggugagcucc

SEQ ID NO: 9675 - RNA, 432 nt, Artificial Sequence
  derived and/or modified sequence opt1 from anti-HIV_cap256-059-084191_VR-Chain
caggugcagcuggucgagagcggcgggggcguggugcagcccgggcggucccuccggcugagcugcgccgccucccaguucaccuucagcuccuacggcaugcacuggguccgccaggcgccggggaagggccuggaguggguggccgccaucagcuucgugggcaucaagaaguacuacgccgacuccgucaaggggcgguucaccgugagccgcgacaacuccaagagcacgcucuaccugcagaugaacucccugcgggccgaggacaccgcgcucuacuacugcgcccgcgaccugcgggaguacgagugcgaggagugggccagcgacuacuacgacuucggccgcgaccagcccugccaggacccccgcgggguggucggcaucuucgacaucugggggcagggcaccgccgugaccguguccagc

SEQ ID NO: 9676 - RNA, 417 nt, Artificial Sequence
  derived and/or modified sequence opt1 from anti-HIV_cap256-059-082135_VR-Chain
caggugcagcuggucgagagcggcgggggcguggugcagcccgggcgcucccuccggcugagcugcaccgccuccggcuucaccuuccgcagcuacgccauccacuggguccggcaggcgccggggaagggccuggaguggguggcccucaucuccuacgacggcagcaacaaguacuacgccgacuccgugaaggggcgcuucacgaucagccgggacaacuccaagaacacccuguaccugcagaugaacagccucaccuccgaggacaccgccgucuacuacugcgccaaggaccugggcgggagcaagacggacgaguggggcaccgacuacugcuaccccgugcaggacccccgcguggucgugggggcguucgacaucuggggccacggcaccauggugaccgucuccagc

SEQ ID NO: 9677 - RNA, 432 nt, Artificial Sequence
  derived and/or modified sequence opt1 from anti-HIV_cap256-059-079417_VR-Chain
caggugcagcuggucgagagcggcgggggcguggugcagcccgggcgcucccuccggcugagcugcgccgccuccggcuucagcuucuccaacuacgcgauggacuggguccgccaggccccggggaagggccuggaguggguggccuucgugagcuccgacggcaacaacaagaaguacgccgacagcgucaaggggcgguucacccucucccgcgacaacuacaagaacaccguguaccugcagaugaacagccugacgguggaggacaccgccgucuacuacugcgcgaaggaccucggcgccaacaaggacgacgagugggggaccgacuacuacgacauguccgugagcuaccccauccccgacccccgggccguggucggcgccuucgacgugugggggcagggcacccuggugacggucuccagc

SEQ ID NO: 9678 - RNA, 435 nt, Artificial Sequence
  derived and/or modified sequence opt1 from anti-HIV_cap256-059-076027_VR-Chain
caggugcagcuggucgagagcggcgggggcguggugcagcccgggcgcucccuccggcugagcugcgccgccuccggcuucagcuucuccaaguacgggaugcacuggguccgccaggcgccgggcaagggccuggaguggguggccuucguggccuucgacgagagcgagaaguacuacgccgccuccgucaaggggcgguucaccaucagccgcgacaacuccaagaacacccucagccugcagaugaacucccugcggacggaggacaccgcgaucuacuacugcgccaaggaggugggcgacaacaaggacgacgaguggaccagccccuacuacuacgacaucuccaucgccuaccccgugcacgacccccgcgccgucgugggggugagcgacgucuggggccaggggaccauggugacgguguccagc

SEQ ID NO: 9679 - RNA, 432 nt, Artificial Sequence
  derived and/or modified sequence opt1 from anti-HIV_cap256-059-075082_VR-Chain
caggugcagcuggucgagagcggcgggggcguggugcagcccgggcgcucccuccggcugagcugcgccgccucccaguucaccuucagcuccuacggcaugcacuggguccgccaggcgccggggaagggccuggaguggguggccgccaucagcuucgugggcaucaagaaguacuacgccgacuccgucaaggggcgguucaccaucagccgcgacaacuccaagaacacgcucuaccugcagaugaacagccugcgggccgaggacaccgcgcucuacuacugcgccaaggaccugcgcgagauggagugcgaggagugggccuccgacuacuacgacuucggccgggaccugcccugccaggacccccgcgggguggugggcacccucgacaucugggggcagggcaccauggucacggugagcucc

SEQ ID NO: 9680 - RNA, 432 nt, Artificial Sequence
  derived and/or modified sequence opt1 from anti-HIV_cap256-059-072575_VR-Chain
cagggccagcugguggagagcgggggcggggucgugcagcccggccggucccuccggcugagcugcgccgccucccaguucaccuucagcaacuucgggaugcacugggugcgccaggcgccgggcaagggccuggagugggucgccgugaucuccuacgacgggaccaagaaguacuacgccgacagcgugaagggccgguucacgaucucccgcgacaacagcaagaacacccucuaccugcagaugaacucccugcgggccgaggacaccgcccucuacuacugcgcgaaggacaugcgcgaggacgagugcgaggaguggggcgccgacuacuacgacuucgggaaggacuaccccugccaggccagccgcggggucgugggcaucuucgacaucuggggccaggggaccauggugacggucuccgcc

SEQ ID NO: 9681 - RNA, 432 nt, Artificial Sequence
  derived and/or modified sequence opt1 from anti-HIV_cap256-059-071926_VR-Chain
caggugcagcuggucgagagcggcgggggcguggugcagcccgggcgcucccuccggcugagcugcgccgccucccagcugagcuucuccaacuacggcaugcacuggguccgccaggcgccggggaagggccucgaguggguggccggcaucagcuucguggggaucaagaaguacuaccgggacuccgucaagggccgcuucaccaucagccgggacaacuccaagaacacccuguaccugcagaugaacagccuccgcacggaggacaccgcccuguacuacugcgugaaggaccugcgggaguucgagugcgaggagugggccuccgacuacuacgacuucgggcgcgaccagcccugccucgacccccggggcguggucgggaccuucgacaucuggggccagggcaccauggugacggugagcucc

SEQ ID NO: 9682 - RNA, 432 nt, Artificial Sequence
  derived and/or modified sequence opt1 from anti-HIV_cap256-059-069638_VR-Chain
caggugcagcuggucgagagcggcgggggcguggugcagcccgggcgcucccuccggcugagcugcgccgccuccggcuucaccuucagcaagaacgcgaugcacuggguccgccaggccccggggcggggccuggaguggguggccuccguggccuucgacggcagcgacaaguacuacgccgacuccgucaaggggcgcuucaccaucagccgggacaacuccaagaacacgcucagccugcagaugaacucccugcgcgcggaggacaccgccguguacuacugcgccaaggagguggaccucuacaaggacgacgaguggggcagcgacuacuacgaccuguccaucgccuaccccauccaggacccccgggcggucgucgggggcuucgggaucuggggccagggcaccauggugaccgugagcucc

SEQ ID NO: 9683 - RNA, 432 nt, Artificial Sequence
  derived and/or modified sequence opt1 from anti-HIV_cap256-059-069165_VR-Chain
cuggugcagcucgucgagagcggcgggggcguggugcagcccgggcgcucccugcggcugagcugcgccgccucccgcuucaccuucagcaacuacggcaugcacuggguccggcaggcgccggggaagggccucgaguggguggccggcaucuccuucgccgggaccacgaaguacuacgccgacagcgugcgcggccgguucaccaucucccgcgacaacagcaagaacacccuguaccugcagaugaacucccuccgggccgaggacaccgcgcuguacuacugcgccaaggacaugcgcgagauggagugcgaggagugggccagcgacuacuacgacuucgggcggccccagcccugccaggacccccgcggcgucguggggaucuucgacaucuggggccagggcacgauggugaccgucuccagc

SEQ ID NO: 9684 - RNA, 432 nt, Artificial Sequence
  derived and/or modified sequence opt1 from anti-HIV_cap256-059-068956_VR-Chain
caggugcagcuggucgagagcggcgggggcguggugcagcccgggcgcucccuccggcugagcugcgccgccuccggcuucaccuucagcaccuacgcgaugcacuggguccgccaggccccggggcggggccuggaguggguggcccucaucuccuacgacggcagcaacaaguacuacguggacuccgucaaggggcgcuucacgaucagccgggacaacuccaagaacacccuguaccugcagaugaacagccucaccgccgaggacaccgccguguacuacugcgcgaaggaccugggcggguccaaggacgacgagugggccacggacuacuacgaccugagcaucgccuaccccauccaggacccccgcgccguggcgggcaucuucgacgucugggggcggggcaccguggugaccgucuccagc

SEQ ID NO: 9685 - RNA, 432 nt, Artificial Sequence
  derived and/or modified sequence opt1 from anti-HIV_cap256-059-068876_VR-Chain
caggugcagcuggucgagagcggcgggggcguggugcagcccgggcgcucccuccggcugagcugcgccgccucccaguucaccuucagcuccuacggcaugcacuggguccgccaggcgccggggaagggccuggaguggguggccgccaucagcuucgccggcaccaagaaguacuacgccaacuccgugaaggggcgguucacgaucagccgcgacaacuccaagaacacccucagccugcagaugaacucccugcggggcgaggacaccgcgcgcuacuacugcgcccgggacccccgcgaguacgagugcgaggagugggccagcgacuacuacgacuucgggcgggaccagcccugccaggacccccgcggcgucaucgggaucuucgacaucuggggccagggcaccauggugacgguguccagc

SEQ ID NO: 9686 - RNA, 432 nt, Artificial Sequence
  derived and/or modified sequence opt1 from anti-HIV_cap256-059-067733_VR-Chain
caggugcagcuggucgagagcggcgggggcguggugcagcccgggcgcucccuccggcugagcugcaccgccucccaguucagcuucuccagcuacggcaugcacuggguccgccaggccccggggaagggccuggaguggguggcggccaucuccuucgccggcaccaagaagaacuacguggacagcgucaaggggcgguucacgaucucccgcgacaacagcaagaacacccucuaccugcagaugaacucccugcgggccgacgacaccgcccucuacuacugcgcgaaggacaugcgcgaguacgagugcgaggagugggccagcgacuacuacgacuucggccgggaguaccccugcaccgacccccgcgggguggugggcacguucgacgucugggggcagggcaccauggugaccguguccagc

SEQ ID NO: 9687 - RNA, 432 nt, Artificial Sequence
  derived and/or modified sequence opt1 from anti-HIV_cap256-059-067450_VR-Chain
caggugcagcuggucgagagcggcgggggcguggugcagcccgggcgcucccuccggcugagcugcgccgccucccaguucaccuucagcaacuacggcaugcacuggguccgccaggcgccggggaagggccuggaguggguggccggcaucuccuucgccgggaucaagaaguacuacgccgacagcgugaagggccgguucaccaucucccgcgacaacgccaagaacacgcucuaccugcagaugaacagccugcgggcggaggacaccgcccucuacuacugcgccaaggaccugcgcgaguacgagugcgaggagugggccuccgacuacuacgacuucgggcgggagcugcccugccaggacccccgcggcgucguggggaccuucgacaucuggggccagggcaccauggugacggucagcucc

SEQ ID NO: 9688 - RNA, 432 nt, Artificial Sequence
  derived and/or modified sequence opt1 from anti-HIV_cap256-059-065694_VR-Chain
caggugcagcuggucgagagcggcgggggcguggugcagcccgggcgcucccuccggcugagcugcgccgccucccagcugaccuucaacaacuacggcaugcacuggguccgccagaccccggggaagggccucgaguggguggcgggcaucagcuucgccgggaucaacaaguacuacgccgacuccgugaagggccgguucacgaucagccgcgacaacuccaagaacgcccuguaccugcagaugaccagccuccgggccgaggacaccgcgcuguacuacugcgucaaggaccugcgcgagauggagugcgaggagugggccuccgacuacuacgacuucgggcgggaccagcccugccaggacccccgcggcgugguggggaccuucgacaucuggggccagggcacgauggucaccgugagcucc

SEQ ID NO: 9689 - RNA, 432 nt, Artificial Sequence
  derived and/or modified sequence opt1 from anti-HIV_cap256-059-065109_VR-Chain
caggugcagcuggucgagagcggcgggggcguggugcagcccgggaagucccuccgccugagcugcgccgccuccggcuucaccuucaccaacaacgcgaugaacuggguccggcaggccccggggaagggccuggaguggguggccuucgugagcuccgacggccgcaacaagaacuacgccgacagcgucaaggggcgguucacgaucucccgcgacaacagcaagaacaccguguaccuccagaugaacucccugcggguggaggacaccgcccuguacuacugcgcgaaggaccucggcgccaacaaggacgacgagugggccaccgacuacuacgaccugagcgucgccuaccccauccccgacccccgcgcgguggugggggccuucgacgucuggggccaggggacgauggugaccguguccagc

SEQ ID NO: 9690 - RNA, 432 nt, Artificial Sequence
  derived and/or modified sequence opt1 from anti-HIV_cap256-059-065060_VR-Chain
caggugcagcuggucgagagcggcgggggcguggugcagcccgggaccucccuccgccugagcugcgccgccuccggcuucaccuucagcaacuacgcgaugggguggguccggcaggccccgggcaagggccuggaguggguggccguggucuccuacgacgggagcaagaaguccuacgccgacagcgugaagggccgcuucacgaucucccgggacaacagccgcaacacccucuaccugcagcugaacucccuccgggccgaggacaccgcgauguucuacugcgccaaggaccuggggaagggcgagaucgaggagugggccaccgacuacuacgacuggagcaaggccuaccccaucgaggggccccgcgacguggucggcgcguucgacacguggggccaggggacccuggugaccguguccagc

SEQ ID NO: 9691 - RNA, 432 nt, Artificial Sequence
  derived and/or modified sequence opt1 from anti-HIV_cap256-059-064001_VR-Chain
caggugcagcuggucgagagcggcgggggcguggugcagcccgggcgcucccuccggcugagcugcgccgccucccaguucaccuucagcaacuacggcaugcacuggguccgccaggcgccggggaagggccuggaguggguggccggcaucuccuucgccgggaccaagaacuacuacgccaagagcgugaagggccgguucacgaucucccgcgacaacagcaagaacgcccucuaccugcagaugaacucccugcgggcggaggacaccgcccucuacuacugcgccaaggacaugcgcgaguacgagugcgaggagugggccagcgacuacuacgacuucgggcgggaccagcccugccaggacccccgcggcgucguggggaccuucgacaucuggggccagggcaccaugguggcggucuccagc

SEQ ID NO: 9692 - RNA, 432 nt, Artificial Sequence
  derived and/or modified sequence opt1 from anti-HIV_cap256-059-063270_VR-Chain
caggugcagcuggucgagagcggcgggggcguggugcagcccgggcgcucccuccggcugagcugcgccgccucccaguucaccuucagcaacuacggcaugcacuggguccgccaggcgccggggaagggccuggaguggguggccgccaucuccuucgccggcaccaagaagcacuacgccgacagcgugaaggggcgguucacgaucucccgcgacaacagcaagaacgcgcucuaccugcagaugaacucccugcgggccgaggacaccgcccucuacuacugcgccaaggaccugcgcgaguacgagugcgaggagugggcgagcgacuacuacgacuucggccgggaccagcccugccuggacccccgcggggucgugggcaucuucgacaucugggggcagggcacccucgugaccgucuccagc

SEQ ID NO: 9693 - RNA, 432 nt, Artificial Sequence
  derived and/or modified sequence opt1 from anti-HIV_cap256-059-061357_VR-Chain
caggugcagcuggucgagagcggcgggggcguggugcagcccgggcgcucccuccggcugagcugcgccgccuccggcuucaccuucagcaacuucggguuccacuggguccgccaggcgccgggcaagggccuggaguggguggccgggaucuccuucgccggcaccaagaucuacuacgccgacagcgugaaggggcgguucacgaucucccgcgagaacagcaagaacaugcucuaccugcagaugaacucccugcggggcgaggacaccgccgucuacuucugcgcgaaggaccuccgcgaguucgagugcgaggagugggccagcgacuacuacgacuucgggcgggaguuccccugccaggacccccgcggcguggugggcaccuucgacgucugggggcacggcgccguggugaccgucuccagc

SEQ ID NO: 9694 - RNA, 435 nt, Artificial Sequence
  derived and/or modified sequence opt1 from anti-HIV_cap256-059-059834_VR-Chain
caggugcagcuggucgagagcggcgggggcguggugcagcccgggcgcucccuccggcugagcugcgccgccuccggcuucaccuucagcaacuucgggaugcacuggguccgccaggcgccgggcaagggccuggaguggguggccuucguggccuucgacgaguccgacaaguacuacgccgccagcgucaaggggcgguucaccgugucccgcgacaacagcaagaacacggugucccuccagaugaacagccugcggaccgaggacaccgcggucuacuacugcgccaaggaggugggcgacaacaaggacgacgaguggaccucccccuacuacuacgacuucagcaucgccuaccccgugcacgacccccgcgccgucgucgggggcuacgacgugugggggcagggcacgauggugaccguguccagc

SEQ ID NO: 9695 - RNA, 432 nt, Artificial Sequence
  derived and/or modified sequence opt1 from anti-HIV_cap256-059-059313_VR-Chain
caggugcaccuggucgagagcggcgggggcguggugcagcccgggaagucccuccgccugagcugcgccgccucccaguucaccuucagcaacuucggcaugcacuggguccggcaggcgccggggaagggccuggaguggguggccggcaucuccuucgccgggaccaagaaguacuacgccgacagcgugaagggccgcuucacgaucucccgggacaacagcaagaacacccucuaccugcagaugaacuccguccgcgccgaggacaccgcgcuguacuacugcgccaaggacaugcgggaguacgagugcgaggagugggccagcgacuacuacgacuucgggaagccccagcccugccaggacccccgcggcgugguggggaccuucgacauguggggccucggcacgcuggucaccguguccagc

SEQ ID NO: 9696 - RNA, 432 nt, Artificial Sequence
  derived and/or modified sequence opt1 from anti-HIV_cap256-059-057130_VR-Chain
caggugcagcuggucgagagcggcgggggcguggugcagcccgggcgcucccuccggcugagcugcgccgccucccaguucagcuucuccagcuacggcaugcacuggguccgccaggcgccggggaagggccuggaguggguggccgccaucuccuucgccggcaucaagaagcacuacgccgacagcgugaaggggcgguucaccaucucccgcgacaacagcaagaacacccucuaccugcagaugaacucccugcgggucgaggacacggcgcucuacuacugcgccaaggaccugcgcgaguacgagugcgaggagugggccagcgacuacuacgacuucggccggccccagcccugccaggacccccgcgggguggugggcaccuccgacaucugggggcagggcaccauggucaccgugagcucc

SEQ ID NO: 9697 - RNA, 411 nt, Artificial Sequence
  derived and/or modified sequence opt1 from anti-HIV_cap256-059-050520_VR-Chain
caggugcagcuggucgagagcggcgggggcguggugcagcccgggcgcucccuccggcugagcugcgccgccucccaguucaccuucaaccgcuacggcaugcacuggguccggcaggcgccggggaagggccuggaguggguggccgugaucagcuacgccgacuccgucaagggccgcuucaccaucagccgggacaacuccaagaacacgcucuaccugcagaugaacagccugcgcgccgaggacaccgcccucuacuacugcgcgaaggaccugcgggaggacgagugcgaggaguggugguccgacuacuacgacuucgggcgcgagcugcccugccgcaagagccggggcguggccgggaucuucgacaucuggggccaggggaccauggugaccgucuccagc

SEQ ID NO: 9698 - RNA, 432 nt, Artificial Sequence
  derived and/or modified sequence opt1 from anti-HIV_cap256-059-049839_VR-Chain
caggugcagcuggucgagagcggcgggggcguggugcagcccgggcgcucccuccggcugagcugcgccgccuccggcuucagcuucuccaacuacgcgauggacuggguccgccaggccccggggaagggccuggaguggguggccguggucagcuccgacggcaagaccaagaacuacgccgacagcgugaaggggcgguucaccaucucccgcgacaacagcaagaacacgguguaccuccagaugaacucccugcggcccgaggacaccgccgucuacuacugcgcgaaggaccugggcgccaacaaggacgacgaguggaccaccgacuacuacgacuggagcguggccuaccccgugcccgacccgcgcgccgucgugggggcguucgacguguggggccaggggacgauggucaccguguccagc

SEQ ID NO: 9699 - RNA, 432 nt, Artificial Sequence
  derived and/or modified sequence opt1 from anti-HIV_cap256-059-048503_VR-Chain
caggugcagcuggucgagagcggcgggggcguggugcagcccgggcgcucccuccggcugagcugcgccgccucccagcugagcuucuccaacuacggcaugcacuggguccgccaggcgccggggaagggccucgaguggguggccggcaccagcuucgccgggaccaagaaguacuacgccgacuccgugaagggccgguucacgaucagccgcgacaacuccaagaacgcccuguaccugcagaugaacagccuccgggcggaggacaccgcccuguacuacugcgccaaggaccugcgcgaguacgagugcgaggagugggccuccgacuacuacgacuucgggcgggaccagcccugccaggacccccgcggcgucguggggaccuucgacaucuggggccagggcaccauggugacggucagcgcg

SEQ ID NO: 9700 - RNA, 432 nt, Artificial Sequence
  derived and/or modified sequence opt1 from anti-HIV_cap256-059-045516_VR-Chain
caggugcagcuggucgagagcggcgggggcguggugcagcccgggcgcucccuccggcugagcugcgccgccucccaguucaccuucagcggcuacgggaugcacuggguccgccaggcgccgggcaagggccuggaguggguggccgccaucuccuucgccgggaacaagcgguacuucgccgacagcgugaagggccgcuucaccaucucccgggacaacagcaagaacacccucuuccugcagaugaacucccugcgcgcggaggacacggcccucuacuacugcgcccgggacaugcgcgaguacgagugcgaggagugggccagcgacuacuacgacuucgggcggccccagcccugccaggacccccgcggcgucguggggguguucgacaucuggggccagggcaccauggucaccguguccagc

SEQ ID NO: 9701 - RNA, 432 nt, Artificial Sequence
  derived and/or modified sequence opt1 from anti-HIV_cap256-059-044188_VR-Chain
caggugcaccuggucgagagcggcgggggcguggugcagcccgggcgcucccuccggcugagcugcgccgccucccaguucaccuucagcuccuacggcaugcacuggguccgccaggcgccggggaagggccuggaguggguggccggcaucagcuucgccgggaccaacaaguacuacgccgacuccgugaagggccgguucacggucagccgcgacaacuccaagaacacccucuacgugcagaugaacagccugcgggccgaggacaccgcgcuguacuacugcgcccgcgaccuccgggaguacgagugcgaggagugggccuccgacuacuacgacuucgggcgcgagcagcccugccaggacccccggggcguggucgggaucuucgacaucuggggccccggcaccauggugacggugagcucc

SEQ ID NO: 9702 - RNA, 435 nt, Artificial Sequence
  derived and/or modified sequence opt1 from anti-HIV_cap256-059-044105_VR-Chain
cagggccagcugguggagagcgggggcggggucgugcagcccggccgcucccucagccuguccugcgccgccagcggguucuccuucaacaacuacgcgauggacugggugcggcaggccccgggcaagggccuggagugggucgccguggugagcuccgacgggaacaacaagaacuacgccgacagcgucaagggccgcuucaccaucucccgggacaacagcaagaacaccguguaccuccagaugaacucccugcgcgccgaggacacggcgaucuacuacugcgccaaggacgugggggccaacaaggacgacgagugggccaccaacuacuacuacgacuggagcgucgcguaccccgugcccgacccccgggccgugaucggcgccuucgacgucugggggcagggcaccauggugaccguguccagc

SEQ ID NO: 9703 - RNA, 432 nt, Artificial Sequence
  derived and/or modified sequence opt1 from anti-HIV_cap256-059-042100_VR-Chain
caggugcagcuggucgagagcggcgggggcguggugcagcccgggcgcucccagcggcucagcugcgccgccucccaguucaccuucagcuccuacggcaugcacuggguccgccaggcgccggggaagggccuggaguggguggccgccaucagcuucgccggcaccaacaaguacuacggggacuccgugaagggccgguucacgaucagccgcgacaacuccaagaacacccuguaccuccagaugaacagccugcgggccgaggacaccgcgcuguaccacugcgcccgcgacaugcgggaguacgagugcgaggagugggccuccgacuacuacgacuucgggcgcgaccagcccugccaggacccccggggcgucguggggaucuucgaccucuggggccagggcaccauggugacggucagcucc

SEQ ID NO: 9704 - RNA, 432 nt, Artificial Sequence
  derived and/or modified sequence opt1 from anti-HIV_cap256-059-040742_VR-Chain
caggugcagcuggucgagaccggcgggggcguggggcagcccggcaagagccuccgccuguccugcgccgccagcggguucaccuucuccaacuucgcgauggacugggugcggcaggccccgggcaagggccuggagugggucgccuucaucagcuccgacgggaucaacaagaaguacggcgacuucgugaaggggcgcuucacgaucagccgggacaacuccaagaacacccucuuccugcagaugaacagccugcgcgccgaggacaccgcccucuacuacugcgcgaaggacgugggcgacuacaaguccgacgagugggggaccgacuacuacgaccugagcaucgaguaccccauccaggacccccgggccgucgugggcgccuucgacaacuggggccaggggacgauggugaucgucuccagc

SEQ ID NO: 9705 - RNA, 432 nt, Artificial Sequence
  derived and/or modified sequence opt1 from anti-HIV_cap256-059-040554_VR-Chain
caggugcagcuggucgagagcggcgggggcguggugcagcccgggcgcucccuccggcugagcugcgccgccucccaguucaccuucagcuccuacggcaugcacuggguccgccaggcgccggggaagggccuggaguggguggccggcaucagcuucgccgccaccaacaaguacuacgggggcuccgugaaggggcgguucacgaucagccgcgacaacuccaagaacacccucuaccugcagaugaacagccugcgggccgaggacaccgcgcucuacuacugcacccgcgacaugcgggaguacgagugcgaggagugggccuccgacuacuacgacuucggcaaggaccagcccugccaggacccccgcggggucgugggcacgcuggacaucuggggccaggggaccauggugaccgucagcucc

SEQ ID NO: 9706 - RNA, 432 nt, Artificial Sequence
  derived and/or modified sequence opt1 from anti-HIV_cap256-059-039660_VR-Chain
caggugcagcuggucgagagcggcgggggcguggugcagcccgggcgcucccuccggcugagcugcgccgccucccaguucagcuucuccaacuacggcaugcacuggguccgccaggcgccggggaagggccuggaguggguggccagcaucuccuucgccggcaccaagaagaaguacgccgacagcgugaaggggcgguucaccaucucccgcgacaacagcaagaacacccucuuccugcagaugaacucccugcggacggaggacgccgcgcucuacuacugcgccaaggacaugcgcgaguucgagugcgaggagugggccagcgacuacuacgacuucggccgggagcagcccugccaggacacccgcgacgucguggggaucuucgacaucuggggccaggggaccauggugacggucuccagc

SEQ ID NO: 9707 - RNA, 435 nt, Artificial Sequence
  derived and/or modified sequence opt1 from anti-HIV_cap256-059-039298_VR-Chain
caggugcagcuggucgagagcggcgggggcguggugcagcccgggcgcucccuccggcugagcugcgccgccuccggcuucaccuucagcaaguacgggaugcacuggguccgccaggcgccgggcaagggccuggaguggguggccuucguggccuucgacgaguccgacaaguacuacgccgccagcgcgaaggggcgguucaucaucucccgcgacaacagcaagaacacccucucccugcagaugaacagccugcggacggaggacaccgccgucuacuacugcgccaaggaggugggcgacaacaaggacgacgaguggaccucccccuacuacuacgacaucagcaucgccuaccccgugcaggacccccgcgcggucgucgggggcuacgacgugugggggcagggcaccauggugacgguguccagc

SEQ ID NO: 9708 - RNA, 432 nt, Artificial Sequence
  derived and/or modified sequence opt1 from anti-HIV_cap256-059-037873_VR-Chain
caggugcagcuggucgagagcggcgggggcguggugcagcccgggcggucccuccggcugagcugcgccgccucccaguucaccuucagcaacuacggcaugcacuggguccgccaggcgccggggaagggccuggaguggguggccgccaucuccuucgccggcaucaacaaguacuacgccgacagcgugaaggggcgguucacccucucccgcgacaacacgaagaacacccuguaccugcagaugaacagccuccgggcggaggacaccgcccuguacuacugcgcccgcgaccugcgggaguacgagugcgaggagugggccuccgacuacuacgacuucggccgcccccagcccugccaggacccccgcggggucgugggcaccagcgacaucugggggcagggcacgauggugaccgucuccagc

SEQ ID NO: 9709 - RNA, 432 nt, Artificial Sequence
  derived and/or modified sequence opt1 from anti-HIV_cap256-059-037633_VR-Chain
caggugcagcuggucgagagcggcgggggcguggugcagcccgggcgcucccuccggcugagcugcgccgccucccaguucaccuucagcaacuucggcaugcacuggguccgccaggcgccggggaagggccuggaguggguggccgccaucuccuucgccggcaucaacaagaacuacgccgacagcgugaaggggcgguucaccaucucccgcgacaacagcaagaacacgcuccaccuccagcugaacucccugcgggcggaggacaccgcccuguacuacugcgccaaggaccugcgcgaguacgagugcgaggagugggccagcgacuacuacgacuucggccgggaccagcccugccaggacccccgcggggucgugggcaccuucgacaucugggggcagggcaccauggugacggucuccagc

SEQ ID NO: 9710 - RNA, 432 nt, Artificial Sequence
  derived and/or modified sequence opt1 from anti-HIV_cap256-059-036817_VR-Chain
caggugcagcugcucgagagcggcgggggcgucgugcagcccgggcgcucccugcggcugagcugcgaggccucccaguucaccuucagcaacuucggcaugcacugggugcgccaggccccggggaagggccucgagugggucgcggccaucuccuucgccggcaucaagaagaacuacgccgacagcgugaaggggcgguucaccaucucccgcgacaacagcaagaacacgcuguaccugcagaugaacucccuccggguggaggacaccgcccuguacuacugcgcgaaggaccugcgcgaguacgagugcgaggagugggccagcgacuacuacgacuucggccgggagcagcccugccaggacccccgcggggucaucggcaccuucgacaucugggggcagggcaccauggugacgguguccagc

SEQ ID NO: 9711 - RNA, 432 nt, Artificial Sequence
  derived and/or modified sequence opt1 from anti-HIV_cap256-059-032787_VR-Chain
caggugcagcuggucgagagcggcgggggcguggugcagcccgggcgcucccuccggcugagcugcgccgccuccggcuucaccuucagcaaguacgcgaugcacuggguccgccaggccccggggaagggccuggaguggguggccuucguggccuucgacgaguccgacaaguacuacgucgacagcgugaagggccgguucaccaucucccgcgacaacagcaagaacacgcucucccugcagaugaacagccugcgggccgaggacaccgcgguguacuacugcgccaaggagguccacgugaacaaggacgacgagugggccuccgacuacuacgaccucagcaucgccuaccccauccaggacccccgcgcgguggucgggggccuggacaucugggggcagggcaccauggugaccguguccagc

SEQ ID NO: 9712 - RNA, 432 nt, Artificial Sequence
  derived and/or modified sequence opt1 from anti-HIV_cap256-059-032427_VR-Chain
caggugcagcuggucgagagcggcgggggcguggugcagcccgggcgcucccuccggcugagcugcgccgccucccaguucaccuucagcaacuucggcaugcacuggguccgccaggcgccggggaagggccuggaguggguggccggcaucuccuuccccgggaccaagaaguacuacgccgacagcgugaagggccgguucacgaucucccgcgacaacagcaagaacgcccucuaccugcagaugaacucccugcgggccgaggacaccgcgcucuacuacugcgcccgcgaccugcgggaguacgagugcgaggagugggccagcgacuacuacgacuucgggaagccccagcccugccuggacccgcgcggcgucguggggaccuucgacaucuggggccagggcaccauggugacggucuccagc

SEQ ID NO: 9713 - RNA, 435 nt, Artificial Sequence
  derived and/or modified sequence opt1 from anti-HIV_cap256-059-029390_VR-Chain
caggugcagcuggucgagagcggcgggggcguggugcagcccgggcgcucccuccggcugagcugcgccgccuccggcuucaccuucaaccagcacgggaugcacuggguccgccaggcgccggacaagggccuggaguggguggccuucgugggcuucgacgagagcgagaaguacuacgccgacuccgucaaggggcgguucaccaucagccgcgacaacuccaagaacacgcucagccugcagaugaacucccugcggcccgaggacaccgccguguacuacugcgccaaggaggugggcgacaacaaggaggacgagugggcgagcgacuacuacuacgaccucuccaacgccuaccccauccacgacccccgcgccgucgucgggggcuacgacaucugggggcagggcaccauggugaccgugugcagc

SEQ ID NO: 9714 - RNA, 435 nt, Artificial Sequence
  derived and/or modified sequence opt1 from anti-HIV_cap256-059-027877_VR-Chain
caggugcagcuggucgagagcggcgggggcguggugcagcccgggcgcucccugcggcugagcugcuccgccagcgccuucuccuucagcuacuucgcgauggacuggguccgccaggccccgggcaaggggcuggaguggguggccuucguguccagcgacggcaacaacaagaacuacgccgacuccgucaagggccgguucaccaucagccgcgacaacuccaagaacaccguguuccuccagauggacagccugcggcccgaggacacggccguguacuacugcgcgaaggaccucgggggcaacaaggacgacgagugguccaccaacuacuacuacgacaucagcaucgccgaccccguccccgacccgcgcgccguggccggggcguucgacguguggggccaggggaccauggucaccguguccagc

SEQ ID NO: 9715 - RNA, 435 nt, Artificial Sequence
  derived and/or modified sequence opt1 from anti-HIV_cap256-059-026640_VR-Chain
caggugcagcuggucgagagcggcgggggcguggugcagcccgggcgcucccuccggcugagcugcgccgccuccggcuucagcuucuccaaguacgggaugcacuggguccgccaggcgccgggcaagggccuggaguggguggccuucguggccuucgacgagagcgaccgguacuacgccgccuccgucaaggggcgcuucaccaucagccgggacaacuccaagaacacccucagccugcagaugaacucccugcgcacggaggacaccgcgaucuacuacugcgccaaggaggugggcgacaacaaggacgacgaguggaccagccccuacuacuacgacauguccaucgccuaccccgugcaggacccccgggccgucgucgggggcuacgacaucugggggcagggcaccauggugacggugagcucc

SEQ ID NO: 9716 - RNA, 432 nt, Artificial Sequence
  derived and/or modified sequence opt1 from anti-HIV_cap256-059-026017_VR-Chain
caggugcagcuggucgagagcggcgggggcguggugcagcccgggcgcucccuccggcugagcugcgccgccuccggcuucaccuucagcaccuacgcgaugcacuggguccgccaggccccggggaagggccuggaguggguggcccucaucuccuacgacggcacgaacaaguacuacguggacagcgccaaggggcgguucaccaucucccgcgacaacagcaagaacacccuguaccugcagaugaacucccucacccccgaggacacggccgucuucuacugcgcgaaggaccugggcggguacaaggacgacgaguggggcaccgaguacuacgacaucagcguguccuaccccgugcaggacccccgggccgucgccgggguguucgacguguggggccacggcaccauggucaccgugagcucc

SEQ ID NO: 9717 - RNA, 432 nt, Artificial Sequence
  derived and/or modified sequence opt1 from anti-HIV_cap256-059-024100_VR-Chain
ugccaggugcuggucgagagcggcgggggcguggugcagcccgggcggucccuccggcugagcugcgccgccucccaguucaccuucagcuccuacggcaugcacuggguccgccaggcgccggggaagggccuggaguggguggccgccaucagcuucgccggcaccaagaaguacuacgccgacuccgugaaggggcgguucgcgaucagccgcgacacguccaagaacgcccucuaccugcagaugaacacccugcgggccgaggacaccgcccucuacuacugcgcgcgcgaccugcgggaguucgagugcgaggagugggccagcgacuacuacgacuucggccgcccccagcccugccaggacccccgcggggucgugggcuccuucgacaucugggggcagggcaccauggugacggucagccug

SEQ ID NO: 9718 - RNA, 432 nt, Artificial Sequence
  derived and/or modified sequence opt1 from anti-HIV_cap256-059-023966_VR-Chain
caggugcagcuggucgagagcggcgggggcguggugcagcccgggcgcucccuccggcugagcugcgccgccucccaguucagcuucuccagcuacggcaugcacuggguccgccaggcgccggggaagggccuggaguggguggccgccaucuccuucgccggcaucaagaagcacuacaccgacagcgugaaggggcgguucaccaucucccgcgacaacagcaagaacacgcucuaccugcagaugaacucccugcgggccgaggacaccgcgcucuacuacugcgccaaggaccugcgcggcuucgagugcgaggagugggccagcgacuacuacgacuucgggcgggaccagcccugccaggacccccgcggcgucguggggaccuucgacaucuggggccagggcacccuggugacggucuccagc

SEQ ID NO: 9719 - RNA, 432 nt, Artificial Sequence
  derived and/or modified sequence opt1 from anti-HIV_cap256-059-020534_VR-Chain
caggugcagcuggucgagagcggcgggggcguggugcagcccgggcgcucccuccggcugagcugcgccgccucccaguucaccuucagcaacuacggcaugcacuggguccgccaggcgccggggaagggccuggaguggguggccggcauguccuucgccgggaccaacacguacuacgccgacagcgugaagggccgguucaccaucucccgcgacaacagcaagaacacccucuaccugcagaugaacucccugcgggccgucgacaccgcgcucuacuacugcgcccgcgacaugcgggaguacgagugcgaggagugggccagcgacuacuacgacuucgggcgcgaguaccccugccaggacccccggggcgugguggggaucuucgaccuguggggccagggcacgauggucaccguguccagc

SEQ ID NO: 9720 - RNA, 435 nt, Artificial Sequence
  derived and/or modified sequence opt1 from anti-HIV_cap256-059-019513_VR-Chain
caggugcagcuggucgagagcggcgggggcguggugcagcccgggcgcucccuccggcugagcugcgccgccuccggcuucaccuucagcaacuucgcgaugggguggguccgccaggccccgggcaagggccuggaguggguggccgugaucuccagcgacgggaccaacaagaacuacggcgacuccgucaaggggcgguucacgaucagccgcgacaacuccaagaacacccucuuccugcagaugaacagccugcgggccgaggacaccucccucuacuacugcgccaaggaccugggcggguacaagaccgacgagugggcgacgaacuacuacuacgacaucagcaucgccucccccauccaggacccccgcgccguggugggcgccuucgacaucuggggccaggggaccauggucaccgugaccagc

SEQ ID NO: 9721 - RNA, 432 nt, Artificial Sequence
  derived and/or modified sequence opt1 from anti-HIV_cap256-059-012963_VR-Chain
caggugcagcuggucgagagcggcgggggcguggugcagcccgggcgcucccuccggcugagcugcgucgccuccggcuucagcuucuccagcuacgggauggccugggugcgccaggcgccgggcaagggccuggagugggugaccgucaucuccuucgccggggugaagaccuacuacgccgacagcgugaagggccgguucacgaucucccgcgacaacagcaaggggacccucuaccugcagauggacggccugcggcccgaggacaccgcccucuacuacugcgccaaggaccuggcggagcgcgagugcgaggagugggccuccgacuacuacgacuucgggcgggagcugcccugccaggacccccgcggcgucgugggcaccuucgacgugugggggcagggcacgauggucaccgugagcucc

SEQ ID NO: 9722 - RNA, 435 nt, Artificial Sequence
  derived and/or modified sequence opt1 from anti-HIV_cap256-059-010396_VR-Chain
caggugcagcuggucgagagcggcgggggcguggugcagcccgggcgcucccuccggcugagcugcgccgccuccggcuucagcuucaacaacuacgcgaugaacuggguccgccaggccccggggaagggccuggaguggguggccuucguguccagcgacggcuccaacaagaacuacgccgacagcgucaccgggcgguucacccucucccgcgacaacagcaagaacacgguguuccugcagaugaacucccugcggguggaggacaccgccgucuacuacugcgcgaaggacgugggcgccaacaaggacgacgaguggaccaccaacuacuacuacgacaucagcaucgccgaccccgugcccgacccccgcgccgucaucggggcguucgacguguggggccaggggacgauggugaccgucuccagc

SEQ ID NO: 9723 - RNA, 432 nt, Artificial Sequence
  derived and/or modified sequence opt1 from anti-HIV_cap256-059-008136_VR-Chain
caggugcagcuggucgagagcggcgggggcguggugcagcccgggcgcucccuccggcugagcugcgccgccuccggcuucaccuucaacaccuacgcgaugcacuggguccgccaggccccggggaagggccuggaguggguggcccucaucagcuacgacggcacggagaaguacuacgccgacuccgugaaggggcgguucaccaucagccgcgacaacucccggaacacccuguaccugcagaugaacagccuccgccuggaggacgccgcgcuguaccagugcgccaaggaccucggcggguccaagagcgacgaguggggcaccgacuacuacgacauguccaucagcuaccccauccaggacccccgggccgucgccgggguguucgacaucuggggccagggcacgcuggugaccgucuccagc

SEQ ID NO: 9724 - RNA, 432 nt, Artificial Sequence
  derived and/or modified sequence opt1 from anti-HIV_cap256-059-006147_VR-Chain
caggugcaggucguggagagcggcgggggcgugguccagcccgggcgcucccugcggcucagcugcaccgccuccggcuucaccuucagcaacuucgccauggggugggugcgccaggcgccgggcaagggccuggaguggguggccuucaucuccagcgacggguccaacaagaacuacggcgacagcgucaaggggcgguucacgaucucccgcgacaacagcaagaacaccguguuccugcagaugaacucccuccggguggaggacaccgcccuguacuacugcgccaaggacgucggcgacuacaagagcgacgagugggggaccgaguacuacgacaucuccaucagcuaccccauccaggacccccgcgccauggugggcgcguucgaccuguggggccaggggacgauggugaccgucuccccc

SEQ ID NO: 9725 - RNA, 432 nt, Artificial Sequence
  derived and/or modified sequence opt1 from anti-HIV_cap256-059-005081_VR-Chain
caggugcagcuggucgagagcggcgggggcguggugcagcccgggcgcucccuccggcugagcugcgccgccucccaguucaccuucagcuccuacggcaugcacuggguccgccaggcgccggggaagggccuggaguggguggccggcaucagcuucgccgccaccaagaaguacuacuccgagagcgugaaggggcgguucacgaucucccgcgacaacagcaagaacgcccuccaccuccacaugaacucccugcgggcggaggacaccgcccuguacuacugcgccaaggaccugcgcgaguucgagugcgaggagugggccagcgacuacuacgacuucggccgggaccagcccugccaggacccccgcggggucgugggcaucuucgacaugugggggcagggcaccauggugaccgucuccagc

SEQ ID NO: 9726 - RNA, 432 nt, Artificial Sequence
  derived and/or modified sequence opt1 from anti-HIV_cap256-059-005006_VR-Chain
caggcccagcugguggagagcggcgggggcgucgugcagcccgccaagucccuccgccugagcugcgcggccuccggguucaccuucaacaaguacgccaugcacugggugcggcaggccccgggcaaggggcuggagugggucgccuucguggcguucgacgagagcgacaaguacuacgccgacuccgugaagggccgcuucaccaucagccgggacaacuccaagaacacgcucagccugcagaugaacaaccugcgcgccgaggacaccgccgucuacuacugcgcgaaggaggugggcgacaacaaggacgacgagugggccuccgacuacuacgaccucagcaucgccuaccccauccaggacccccgggccguggggcgcggcuacgacaucugggggcagggcaccauggucaccguguccagc

SEQ ID NO: 9727 - RNA, 432 nt, Artificial Sequence
  derived and/or modified sequence opt1 from anti-HIV_cap256-059-004451_VR-Chain
caggugcaccuggucgagagcggcgggggcguggugcagcccgggaagucccuccgccugagcugcaccgccuccggcuucaccuucacgaacuucgccauggacuggguccggcaggcgccggggaagggccuggaguggguggccuucaucagcuccgacggcagcaacaaguacuacuccgagagcgugaaggggcgcuucaccaucucccgggacaacagcaagaacacccucuacguccagaugaacucccugcgcaccgaggacacggccguguacuacugcgccaaggaccugggcggguacaaggacgacgaguggagcaccgacuacuacgacugguccaccgccuaccccgugcaggacccccgggcggucgccggcgccuucgaccucugggggcagggcaccauggugagcguguccagc

SEQ ID NO: 9728 - RNA, 432 nt, Artificial Sequence
  derived and/or modified sequence opt1 from anti-HIV_cap256-059-003571_VR-Chain
caggagcagcugguggagagcggcgggggcgucgugcagcccgggcgcucccuccggcugagcugcgccgccucccaguucaccuucggcgcguacgggaugcacugggugcgccaggccccgggcaagggccuggagugggucgccggggugagcuucgugggcaacaacaaguacuacgccgacuccgucaaggggcgguucaccaucagccgcgacaacuccaagaacacgcucuaccugcagaugaacagccugcggggcgaggacaccgcccucuacuacugcgcgcgcgacaugcgggagauggagugcgaggagugggccuccgacuacuacgacuucgggcgcccccagcccugccaggacccccggggcguggugggcaucuucgacaugugggggcagggcaccauggucaccgugagcucc

SEQ ID NO: 9729 - RNA, 432 nt, Artificial Sequence
  derived and/or modified sequence opt1 from anti-HIV_cap256-059-003449_VR-Chain
caggugcagcuggucgagagcggcgggggcguggugcagcccgggaagucccuccgccugagcugcgccgccucccaggucaccuucagcuccuacggcaugcacugggugcggcaggcgccggggaagggccuggaguggguggccggcaucagcuucgccgggaccaagaaguacuacgccgacuccgucaagggccgcuucacgaucagccgggacaacuccaagaacgcccucuaccugcagaugaaccgccugcgggcgggggacaccgcccucuacuacugcgccaaggaccugcgcgaguacgagugcgaggagugggccagcgacuacuacgacuucggccgggagcagcccugccaggacccccgcgggguggugggcaucuucgacaucuggggccuggggaccauggucaccguguccagc

SEQ ID NO: 9730 - RNA, 432 nt, Artificial Sequence
  derived and/or modified sequence opt1 from anti-HIV_cap256-059-002712_VR-Chain
caggugcagcuggccgagagcggcgggggcgucgugcagcccgggcggucccuccggcugagcugcgccgcgucccaguucaccuucagcuccuacggcaugcacugggugcgccaggccccggggaagggccuggagugggucgccgccaucagcuucgccggcaccaagaagcacuacgcggacuccgugaaggggcgguucacgaucagccgcgacaacuccaagaacacccucaaccugcagaugaacagccugcgggccgaggacaccgcccucuacuacugcgcccgcgacaugcgggaguacgagugcgaggugugggcguccgacuacuacgacuucggccgcgagcagcccugccaggacccccgcggggucgugggcaccuucgacaucugggggcagggcacgauggugaccgucagcccc

SEQ ID NO: 9731 - RNA, 432 nt, Artificial Sequence
  derived and/or modified sequence opt1 from anti-HIV_cap256-059-001573_VR-Chain
caggugcagcuggucgagagcggcgggggcguggugcagcccgggcgcucccuccggcugagcugcgccgccucccaguucaccuucagcuccuacggcaugcacuggguccgccaggcgccggggaagggccuggaguggguggccggcaucagcuacgacgggaccuccaaguacuacgccgacagcgugaagggccgguucacgaucucccgcgacaacagcaagaacacccucuaccugcagaugaacucccugcgggccgaggacaccgcccucuacuacugcgcgaaggaccugcgcgaggacgagugcgaggagugguggagcgacuacuacgacuucgggcgggagcugcccugccgcaagucccggggcgucgccgggaccuucgacaucuggggccacggcacgauggugaccgugagcucc

SEQ ID NO: 9732 - RNA, 432 nt, Artificial Sequence
  derived and/or modified sequence opt1 from anti-HIV_cap256-059-001379_VR-Chain
caggugcgccuggucgagagcggcgggggcguggugcagcccgggcggucccuccgccugagcugcgccgccuccggcuucaccuucaacagcuacccgaugcacuggguccggcaggcgcccgggaagggccuggacuggguggcccucaucuccuacgacggcaccaacaaguucuacguggacagcgucaaggggcgcuucacgaucucccgggacaacagcaagaacacccuguaccugcagaugaacucccucaccgccgaggacaccgccauguacuacugcgccaaggaccugggcgggaacaaggacgacgaguggggcacggacuacuacgacaucagcguggcguaccccauccacgacccccgcgccguggccgggaucuucgacgucuggggccacggcaccauggugaccguguccagc

SEQ ID NO: 9733 - RNA, 432 nt, Artificial Sequence
  derived and/or modified sequence opt1 from anti-HIV_cap256-059-001029_VR-Chain
caggagcagcuggugcagagcggcgggggcgucgugcagcccgggcgcucccuccggcugagcugcgccccgucccaguucaccuucagcgcccacggcaugcacugggugcgccaggcgcccgggaagggccuggagugggucgccggcaucuccuucgccgggaccaagaacuacuacgccgacagcgugaagggccgguucacgaucucccgcgacaacagcaagaacacccucuaccugcagaugaacucccugcggguggaggacaccgcccucuacuacugcgcgaaggacaugcgcgagauggagugcgaggagugggccagcgacuacuacgacuucgggcggcaccagcccugccaggacccccgcggcgucguggggaucuucgacaucuggggccagggcaccauggugacggucuccagc

SEQ ID NO: 9734 - RNA, 432 nt, Artificial Sequence
  derived and/or modified sequence opt1 from anti-HIV_cap256-048-165087_VR-Chain
gaggugaagcugcucgagagcggcgggggccugguccagcccgggggcuaccgccggcuguccugcgccgccagcggguucaccuucucccgcuacgcgaugcacugggcccggcaggccccgggcaagggccucgaguggguggccguggucagcgacgacggggugaagaaguacuaccccgacuccgugcgcggccgguucaccaucagccgcgacaacucccggaacacggucagccugcagaugaacucccugcgccccgaggacaccgccguguacuacugcgcgaaggacgugggggccaacaaggacgacgagugggccaccgacuacuacgaccucagcaucgccuaccccgucccggacccccgggcgguggugggcgccuucgacaucugggggcagggcaccauggucacgguguccagc

SEQ ID NO: 9735 - RNA, 432 nt, Artificial Sequence
  derived and/or modified sequence opt1 from anti-HIV_cap256-048-158861_VR-Chain
gaggugcagcuggucgagagcggcgggggccucgugcagcccgggggcucccugcgccugagcugcguggacuucggguuccgguucuccgaguacuggaugagcuggguccgccaggccccgggcaagggccucgaguggguggccgugaucuccuacgacgggaccaacaaguacuacgcggacagcgucaagggccgguucaccaucucccgcgacaacagcaagaacacgcuguaccugcagaugaacucccuccgggccgaggacaccgcccuguacuacugcgccaaggacaugcgcgagagcgagugcgaggagugggccuccgacuacuacgacuucgggaaggacuaccccugccaggacccccggggcgugguggggaccuucgacaucuggggccagggcaccauggucacggugagcucc

SEQ ID NO: 9736 - RNA, 435 nt, Artificial Sequence
  derived and/or modified sequence opt1 from anti-HIV_cap256-048-158280_VR-Chain
caggugcaccuggucgagagcggcgggggcguggugcagcccgggcgcucccuccggaucuacugcgccgucagcgaguucaccuuccgcaacuacgccaugcacugggugcggcuggcgccgggcaaggggcugcaguggguggccgucaucucccacgacggcaucaacgacuacuacgccgacagcgugaagggccgcuucaccaucucccgggacaacagcaagaacacggugucccuccagaugaacagccugcgccccgaggacaccgccgucuacuacugcgccaaggaccugggggcgaacaaggacgacgagugggccaccgacuacuacgaccucuccaucgccuaccccgugcccgacccgaccggccccugguucggggccuucgacaucuggggccaggggacgauggugaccgucagcucc

SEQ ID NO: 9737 - RNA, 432 nt, Artificial Sequence
  derived and/or modified sequence opt1 from anti-HIV_cap256-048-157928_VR-Chain
caggugcagcugauggagagcggcgggggcgucgugcagcccgggcgcucccuccggcugagcugcgccaucuccggcuucaccuucagcaacuacuggauguccugggugcgccaggccccggggaagggccuggagugggucgcggugaucagcuccgacggcagcuccaagaacuacgccgacagcgugaaggggcgguucaccaucucccgcgacaacagcaagaacacggucucccuccagaugaacagccugcggcccgaggacaccgccguguacuacugcgccaaggacgugggcgccaacaaggacgacgagugggcgaccgacuacuacgaccuguccaucgccuaccccguccccgacccgcgcgccguggugggggccuucgacaucuggggccaggggaccauggucacggugagcucc

SEQ ID NO: 9738 - RNA, 432 nt, Artificial Sequence
  derived and/or modified sequence opt1 from anti-HIV_cap256-048-157056_VR-Chain
caggugcagcuggucgagagcggcgggggcguggugcagcccgggcgcucccuccggcugagcugcgccgccuccggcuucacccugagcuccuacgcgaugcacuggguccgccaggccccggggaagggccucgaguggguggccuucaucagcaacgacggcuccaacaaguacuucgccgacagcgugaaggggcgguucaccaucucccgcgacaacagcaagaacacgcuguaccugcagaugaacucccuccgggccgaggacaccgcggucuacuacugcgccaaggaccugggcgggaacaaggacgacgagugggccaccgacuacuacgaccugagcaucgccuaccccgugcaggacccccgcguggucgugggcaucuucgacaucugggggcagggcaccauggugacggucuccagc

SEQ ID NO: 9739 - RNA, 432 nt, Artificial Sequence
  derived and/or modified sequence opt1 from anti-HIV_cap256-048-156422_VR-Chain
caggugcagcuggucgagagcggcgggaccguggugcagcccggccgcucccuccggcugagcugcgucggguccggcuucagccuguccuacuacgccauccacugggugcgccaggccccggggaagggccucgaguggguggcggucaucagcuacgacggcuccaacuacuacuacgccgacagcgugaaggggcgguucaccaucucccgcgacaacagcaagaacacgguguaccugcagaugaacucccugcggggcgucgacaccgccguguacuacugcgccaaggaccucgggggcggggagguggaggagugggccaccgacuacuacgacuggagcaucgcguaccccgucgagcacccccgcgccguggugggcgucuucgacaucuggggccaggggaccaaggugacgguguccagc

SEQ ID NO: 9740 - RNA, 432 nt, Artificial Sequence
  derived and/or modified sequence opt1 from anti-HIV_cap256-048-152863_VR-Chain
gaggugcagcugcucgagagcggcgggggccugguccagcccgggggcucccugcgccucagcugcgccggguccggcuucaccuucagcaagcacggcaugcacugggugcggcaggccccggggaagggccuggaguggguggcguucgucgccuucgacgaguccgacaaguacuacgccgacagcgugaaggggcgcuucaccaucucccgggacaacagcaagaacacgcugucccuccagaugaacagccugcgcgccgaggacaccgccauguacuacugcgcgaaggaggugggcgacaacaaggacgacgagugggccuccgacuacuacgaccugagcaucgccuaccccguccacgacccccgggccguggucgggggcuacgacaucuggggccaggggaccauggugaccguguccagc

SEQ ID NO: 9741 - RNA, 432 nt, Artificial Sequence
  derived and/or modified sequence opt1 from anti-HIV_cap256-048-152770_VR-Chain
caggugcagcuggucgagagcggcgggggcguggugcagcccgggcggucccuccggcugagcugcgccgccuccggcuucaccuuccgcagcaacgcgaugcacuggguccggcaggccccggggaagggccuggaguggguggccgugaucuccuacgacggcagcaagaccuacuacgccgacuccgucaaggggcgcuucacgaucagccgggacaacuccaagaacacccucuaccugcagaugaacagccugcgcgccgaggacaccgcgguguacuacugcgccaaggaccucggcgaguacaaguccgacgagugggccaccgacuacuacgaccugagcaucgccuaccccgugcaggacccccgcggggucgcgggcgccuucgacaucugggggcagggcacgauggugaccguguccagc

SEQ ID NO: 9742 - RNA, 432 nt, Artificial Sequence
  derived and/or modified sequence opt1 from anti-HIV_cap256-048-150027_VR-Chain
gaggugcagcuggucgagagcggcgggggccucgugcagcccgggggcucccugcgccugagcugcgccguguccggguucaccuucagcuccuacaucaugcacuggguccggcaggccccgggcaagggccucgaguggguggcggugaucagcuacgacggguccaacaaggacuacgccgacagcgucaagggccgcuucaccaucucccgggacaacagcaagaacacgcuguaccugcagaugaacucccuccgcgccgaggacaccgcccuguacuacugcgccaaggaccugcgggaguacgagugcgaggagugggcgagcgacuacuacgacuucgggcgcgacuaccccugccaggacccccggggcgugguggggaccuucgacaucuggggccagggcaccauggucacgguguccagc

SEQ ID NO: 9743 - RNA, 432 nt, Artificial Sequence
  derived and/or modified sequence opt1 from anti-HIV_cap256-048-148246_VR-Chain
caggugcagcuggucgagagcggcgggggcguggugcagcccgggcgcucccuccggcugagcugcgccaccuccggcuucaccuucagcacguacuccaugcacuggguccgccaggccccggggaagggccuggaguggguggcggugaucagcuacgacggcuccaacgaguacuacgucgacagcgugaaggggcgguucaccaucucccgcgacaacagcaagaacacccucuaccugcagaugaacucccugcggguggaggacaccgcccucuacuacugcgccaaggaccugggcgggaacaaggacgacgaguggggcacggacuacuacgacuucagcgucgccuaccccgugcaggacccccgcgccguguccgggaucuucgacgucuggggccacggcaccauggugaccgugagcucc

SEQ ID NO: 9744 - RNA, 432 nt, Artificial Sequence
  derived and/or modified sequence opt1 from anti-HIV_cap256-048-147428_VR-Chain
caggugcagcuggucgagagcggcgggggcguggugcagcccgggcgcucccuccggcugagcugcuccgccagcggcuucaccuucuccaacuacgggaugcacuggguccgccaggccccgggcaagggccuggaguggguggcggugaucagcuucgacggguccaacaaggucuacgccgacagcgugaagggccgguucaccaucucccgcgacaacagcaagaacacgcucuaccuggagaugaacucccugcgggccgaggacaccgccgaguacuacugcgccaaggaccucggggagagcgacaaggaggaguggcccuccgacuacuacgacuucggccgcgacuucaccggccaggugccccgggcggucguggggaucuucgacauguggggccaggggaccauggugacggucagcucc

SEQ ID NO: 9745 - RNA, 432 nt, Artificial Sequence
  derived and/or modified sequence opt1 from anti-HIV_cap256-048-146603_VR-Chain
gaggugcagcuggucgagagcggcgggggccucgugcagcccgggcgcucccugcggcugagcugcgccgccuccggcuucaccuucgacgacuacgcgauccacugggugcgccaggccccggggaagggccucgagugggucgcccugaucagcuacgacggcaccgacaaguacuacgccgacuccgugaaggggcgguucacgaucagccgcgacaacuccaagaacacccuguaccuccagaugaacagccugcggguggaggacaccgccgucuaccacugcgcgaaggaccugggcgggaccaaguccgacgagugggccacggacuacuacgaccucagcaucgccuaccccauccaggaccccggcgccguggugggggucuucgacaucuggggccagggcaccauggugaccguguccagc

SEQ ID NO: 9746 - RNA, 432 nt, Artificial Sequence
  derived and/or modified sequence opt1 from anti-HIV_cap256-048-145735_VR-Chain
caggugcagcugguccagagcggcgggggcguggugcagcccgggcgcucccuccggcugagcugcggcgccuccggguucaccuucagcaacuacgccaugcacuggguccgccaggcgccgggcaagggccuggacuggguggccgugaucuccuacgacgggaccaacgagaaccacgccgacagcgucaagggccgguucacgaucucccgcgacaacagcaagaacaccguguaccuccagaugaacucccugcgggccgaggacaccgccguguacuacugcgcgaaggacgucgggggcagcaaggacgacgagugggccaccgacuacuacgaccuguccaucgccuaccccgugcccgacccccgcgccguggucggggcguucgacaucuggggccagggcacgauggugaccgugagcucc

SEQ ID NO: 9747 - RNA, 432 nt, Artificial Sequence
  derived and/or modified sequence opt1 from anti-HIV_cap256-048-145116_VR-Chain
caggugcaccuggucgagagcggcgggggcguggugcagcccgggggcucccuccggcugagcugcgccgccuccggguucaccuucagcaacuacggcaugcacuggguccggcaggcgccgggcaaggggcuggaguggguggccgccaucuccuucgccggcaccaacaaguacuacgccgacagcgugaaggggcgcuucacgaucucccgggacaacagcaagaacgcgcucuaccugcagaugaacucccugcgcgccgaggacaccgcccucuacuacugcgccaaggaccugcgggagagcgagugcgaggagugggcguccgacuacuacgacuucggccgcgacuaccccugccaggacccccgcggggucgugggcacccuggacaucuggggccaggggaccauggugacggucagcucc

SEQ ID NO: 9748 - RNA, 432 nt, Artificial Sequence
  derived and/or modified sequence opt1 from anti-HIV_cap256-048-144077_VR-Chain
caggugaagcuggucgagagcggcgggggcguggugcagcccgggcgcucccuccggcugagcugcgccgccuccggcuucacccugagcuccuacgcgaugcacuggguccgccaggccccggggaagggccucgaguggguggccgugaucagcuacgacggcuccaaccgguacaccgccgacagcgucaaggggcgcuucacgaucucccgggacaacagcaagaacacccugaaccugcagaugaacucccuccgccccgaggacaccgccguguacuacugcgcgaaggacgugggcgccaacaaggacgacgagugggccaccgacuacuacgaccugagcaucgccuaccccguccccgacccgcgggcgguggugggggccuucgacaucuggggccaggggacgaccgucaccguguccagc

SEQ ID NO: 9749 - RNA, 432 nt, Artificial Sequence
  derived and/or modified sequence opt1 from anti-HIV_cap256-048-142876_VR-Chain
caggugcagcuggucgagagcggcgggggcguggugcagcccgggggcucccuccgccugagcugcgucgccuccggguucaccuucagcaccuacggcaugcacugggugcggcaggccccgggcaaggggcuggaguggguggcguucaugcgcuucgacggcuccaaccgguacuacggggacagcgucaagggccgcuucacgaucucccgggacaacagcaagaacacccucuaccugcagaugaucucccugcgcgccgaggacaccgccguguaccacugcgccaaggaccucgggggcaacaagcccgacgagugggccaccgacuacuacgaccugagcaucgcguaccccgugcaggacccccgggccgucgugggcguguucgacaucugggggcagggcacgaucaucaccgucuccagc

SEQ ID NO: 9750 - RNA, 432 nt, Artificial Sequence
  derived and/or modified sequence opt1 from anti-HIV_cap256-048-140582_VR-Chain
caggugcagcuggucgagagcggcgggggcguggugcagcccgggcgcucccuccggcugagcugcgccgccuccggcuucagcuucuccaacuacgcgauggacuggguccgccaggccccggggaagggccuggaguggguggccuucgugagcuccgacggcagcaacaagaacuacgccgacuccgucaaggggcgguucaccaucagccgcgacaacuccaagaacaccguguaccuccagaugaacagccugcggguggaggacacggccgucuacuacugcgcgaaggaccugggcgccaacaaggacgacgagugggccaccgacuacuacgaccucuccguggccuaccccgugcccgacccccgcgcggucgugggggccuucgacguguggggccaggggaccauggucaccgugagcucc

SEQ ID NO: 9751 - RNA, 432 nt, Artificial Sequence
  derived and/or modified sequence opt1 from anti-HIV_cap256-048-139355_VR-Chain
caggugcagcuggucgagagcggcgggggcguggugcagcccgggcgcucccuccggcugagcugcgccgccuccggcuucaccuucagcuccuacgcgaugcacuggguccgccaggccccggggaagggccuggaguggguggccaucaucagcuacgacggcuccaacaaguacuacgccgacagcgugaaggggcgguucaccaucucccgcgacaacagcaagggcacgcucuaccugcagauggacgggccccggcccgaggacaccgcccuguacuacugcgcgaaggaccucggcgagcgcgagugcgaggagugggccuccgacuacuacgacuucgggcgggacuuccccugccaggacccgcgcggcgucgugggcaccuucgacaucugggggcagggcaccauggugacggucagcucc

SEQ ID NO: 9752 - RNA, 432 nt, Artificial Sequence
  derived and/or modified sequence opt1 from anti-HIV_cap256-048-139151_VR-Chain
caggugcagcuggucgagagcggcgggggcguggugcagcccgggaagucccuccgccugagcugcgccgccuccggcuucaccuucaacaccuacgggaugcacuggguccggcaggcgccgggcaagggccuggaguggguggccgugaucagcuacgacggguccauccagaaguacgccgacagcgucaagggccgcuucacgaucucccgggacaacagcaagaacacccucuaccugcagaugaacucccugagcguggaggacaccgccguguacuacugcgccaaggaccucgggaagaacaaggacgacgagugggcgaccgacuacuacgacaucuccaucgccuaccccguccccgacccccgcgccguggugggcgucuucgacaucugggggcagggcacgguggugaccgucagcucc

SEQ ID NO: 9753 - RNA, 432 nt, Artificial Sequence
  derived and/or modified sequence opt1 from anti-HIV_cap256-048-137672_VR-Chain
gaggugcagcuggucgagagcggcgggggcguggcccgccccgggggcucccuccggcugagcugcgccgcguccggguucaucuucacccacuacgccauggacugggugcgccaggccccgggcaagggccuggagugggucgccgugaucagcuccgacgggagcuccaagaacuacgccgacagcgugaagggccgguucaccaucucccgcgacaacagcaagaacacggucucccuccagaugaacagccugcggcccgaggacaccgcgguguacuacugcgccaaggacgugggggccaacaaggacgacgagugggccaccgacuacuacgaccuguccaucgcguaccccguccccgacccgcgcgccguggugggcgccuucgacaucugggggcagggcaccauggucacggugagcucc

SEQ ID NO: 9754 - RNA, 432 nt, Artificial Sequence
  derived and/or modified sequence opt1 from anti-HIV_cap256-048-137506_VR-Chain
caggugcgccuggucgacagcggcgggggcguggugcagcccgggggcucccuccggcugagcugcgccgccuccggguucaccuucagcaccuacggcaugcacuggguccgccaggcgccgggcaaggggcuggaguggguggccuucauccgguccgacggcagcaacaaguacuacgccgacuccgugcaggggcgcuucagcaucucccgggacaacagcaagaacacgcucuaccugcagaugaacucccugcgcgccgaggacaccgccgucuacuacugcgcgaaggaccucggcgagagcgacaaggaggaguggcccuccgacuacuacgacuucgggcgggacuucaccggccaggacccccgcgccguggugggcgucuucgacaucugggggcagggcaccacggugaucgugagcucc

SEQ ID NO: 9755 - RNA, 432 nt, Artificial Sequence
  derived and/or modified sequence opt1 from anti-HIV_cap256-048-137270_VR-Chain
caggugcagcuggucgagagcggcgggggcguggugcagcccgggcgcucccuccggcugagcugcgccgccuccggcuucaccuucagcuccuacgcgaugcacuggguccgccaggccccggggaagggccuggaguggguggccgugaugagccccgacggcuccaaccgguacuacaccgacagcgucaaggggcgcuucacgaucucccgggacaacagcaagaacacccucucccugcagaugaacagccugcgccccgaggacaccgccguguacuacugcgccaaggacgugggcgcgaacaaggacgacgagugggccaccgacuacuacgaccucuccaucgccuaccccgucccggacccccgggccguggugggggcguucgacaucuggggccaggggacgauggucaccgugagcucc

SEQ ID NO: 9756 - RNA, 432 nt, Artificial Sequence
  derived and/or modified sequence opt1 from anti-HIV_cap256-048-135447_VR-Chain
gaggugcagcuggucgagagcggcggggccguggugcagcccggccgcucccuccggcugagcugcaccgccuccggguucagcuucaccuccuacacgauccacuggguccgccaggcgccgggcaaggggcuggaguggguggccuucaucagcuacgacggcaccgagaagaaguacaccgacuccgugaagggccgguucaccaucagccgcgacaacuccaagaacacgcucagccugcagaugaacucccugcggcccgaggacaccgccgucuacuacugcgccaaggaccucggggccagcaaggacgacgagugggcgaccgacuacuacgacuucuccaucgccuaccccgugcaggacccccgcgccguggucggcgccuucgacaucugggggcagggcaccauggugacggugagcucc

SEQ ID NO: 9757 - RNA, 432 nt, Artificial Sequence
  derived and/or modified sequence opt1 from anti-HIV_cap256-048-131966_VR-Chain
caggagcagcugguggagagcggcgggggcgucgugcagcccgggcgcucccuccggcugagcugcgccgccuccggcuucaccuucagcaacuacgcgaugcacugggugcgccaggccccggggaagggccuggagugggucgccgccaugucccacgacggcagcgacaaguacuacgccgacuccgugaaggggcgguucaccaucagccgcgacaacuccaagaacacgcucuacaugcagaugaacagccugcgggcggaggacaccgccguguacuacugcgccaaggaccagggcgaguccgagaaggaggagugggccagcgacuacuacgacuucgggcgcgacuaccccggccaggacccccggcgcgucguggcgaccuucgccaucugggggcagggcaccauggugacggucuccagc

SEQ ID NO: 9758 - RNA, 432 nt, Artificial Sequence
  derived and/or modified sequence opt1 from anti-HIV_cap256-048-131008_VR-Chain
gaggugcgccuggucgagagcggcgggggccucgugaagcccgggggcucccugcggcugagcugcgccgccuccggguucaccgugagcuccaacuacaugagcuggguccgccaggcgccgggcaagggccucgaguggguggccgccaucuccuucgccgggaccaacaaguacuacgccgacagcgugaagggccgguucacgaucucccgcgacaacagcaagaacgcgcuguaccugcagaugaacucccuccgggccgaggacaccgcccuguacuacugcgccaaggaccugcgcgagagcgagugcgaggagugggcguccgacuacuacgacuucgggcgggacuaccccugccaggacccccgcggcgucguggggacccucgacaucuggggccagggcaccauggugacggucagcucc

SEQ ID NO: 9759 - RNA, 432 nt, Artificial Sequence
  derived and/or modified sequence opt1 from anti-HIV_cap256-048-129369_VR-Chain
caggugcagcuggucgagagcggcgggggcguggugcagcccgggcgcucccuccggcugagcugcgccgccuccggcuucaccuucagcaacuacgucaugcacugggugcgccaggcgccggggaagggccuggaguggguggcccucgucuccuucgacggcagcaacaaguacuacgccgacuccgugaaggggcgguucaccaucagccgcgacaacuccaagaacacgguguaccugcagaugaacagccugcggggcgucgacaccgccguguacuacugcgccaaggaccucgggggcggggagguggaggagugggcgaccgacuacuacgacugguccaucgccuaccccgucgagcacccccgcgccguggugggcgucuucgacaucuggggccaggggaccaaggugacggugagcucc

SEQ ID NO: 9760 - RNA, 432 nt, Artificial Sequence
  derived and/or modified sequence opt1 from anti-HIV_cap256-048-128476_VR-Chain
gaggugcagguccuggagagcggcgggggccucgugcagcccgggggcucccugcgccuggccugcgccgcgagcggguucuccuucagcuccuacggcaugcacugggugcggcaggccccgggcaaggggcucgagugggucagcuucauccgcuacgacggcgccaacaaguaccacgccgacuccgugaaggggcgguucaucaucagccgcgacgacuccaagaacaccgugagccugcagaugaacucccugcggcccgaggacaccgccgucuacuacugcgcgaaggaccucggcgccaacaaggacgacgagugggccacggacuacuacgaccugagcaucgccuaccccgugcccgacccgcgcgcgguggucggggccuucgacaucuggggccagggcaccauggugaccguguccagc

SEQ ID NO: 9761 - RNA, 432 nt, Artificial Sequence
  derived and/or modified sequence opt1 from anti-HIV_cap256-048-128270_VR-Chain
caggugcagcuggucgagagcggcgggggcguggugcagcccgggcgcucccuccggcugagcugcaccgccuccggcuucaccuuccgcagcuacgccaugcacuggguccggcaggcgccggggaagggccuggaguggguggcccucaucuccuacgacggcagcaacaaguacuacgccgacuccgugaaggggcgcuucacgaucagccgggacaacuccaagaacacccuguaccugcagaugaacagccucaccuccgaggacaccgccgucuacuacugcgccaaggaccugggcgggagcaagacggacgaguggggcaccgacuacuacgaguucuggaacgcguaccccgugcaggacccccgcguggucgugggggccuucgacaucuggggccacggcaccauggugaccgucuccagc

SEQ ID NO: 9762 - RNA, 432 nt, Artificial Sequence
  derived and/or modified sequence opt1 from anti-HIV_cap256-048-126220_VR-Chain
caggugcagcuggucgagagcggcgggggcguggugcagcccgggcgcucccuccggcugagcugcgccgccuccggcuucaucuucagcccguacgggauccacuggguccgccaggcgcccggcaagggccuggaguggguggcccucaucucccacgacgggagcaagaaguacuacgccgacuccgugaagggccgguucaccaucagccgcgacaacuucaaggacacccuguaccugcagaugaacucccuccgcggggucgacacggccguguacuacugcgccaaggaccugggcgggggcgagguggaggagugggcgaccgacuacuacgacuggagcaccgccuaccccgucgagcacccccgggccguggugggcgucuucgacaucugggggcagggcaccaaggugacgguguccagc

SEQ ID NO: 9763 - RNA, 432 nt, Artificial Sequence
  derived and/or modified sequence opt1 from anti-HIV_cap256-048-125713_VR-Chain
gaggugcagcuggucgagagcggcgggggccucgugcagcccgggggcucccugcgccugagcugcgaggccuccggguucagcuucuccaccuacgagcucaacugggugcggcaggccccgggcaagggccuggagugggucgcggugaucagcuacgacggguccaacuacuacuacgccgacagcgugaagggccgcuucaccaucucccgggacaacagcaagaacacgcuguaccuccagaugaacucccugcgcgccgaggacaccgccgucuacuacugcgccaaggacgugggggcgaacaaggacgacgagugggccaccgacuacuacgaccugagcaucgccuaccccgugcccgacccccgggccgucgugggcgcguucgacaucugggggcagggcaccauggugacggucuccagc

SEQ ID NO: 9764 - RNA, 432 nt, Artificial Sequence
  derived and/or modified sequence opt1 from anti-HIV_cap256-048-123934_VR-Chain
caggugcagcuggucgagagcggcgggggcguggugcagcccgggcgcucccuccggcugagcugcgccgccuccggcuucaccuucagcuccuacgggauggcguggguccgccaggccccgggcaagggccuggagugggugaccgccaucagcuucgccgggacgaacaaguacuacgccgacuccgugaagggccgguucaccaucagccgcgacaacuccaaggacacccucuaccugcagauggacgggcugcggcccgaggacaccgcgcucuacuacugcgccaaggaccugggcgagcgcgagugcgaggagugggccagcgacuacuacgacuucgggcgggacuuccccggccaggaccagcgcgccgucgcgggcguguucgacaugugggggcagggcacgauggugaccgucuccagc

SEQ ID NO: 9765 - RNA, 432 nt, Artificial Sequence
  derived and/or modified sequence opt1 from anti-HIV_cap256-048-122673_VR-Chain
gaggugcaggucguggagagcggcgggggccuggugaagcccgggggcucccuccgccugagcugcgccgccuccggguucaccuucagcucccacgucaugaacugggugcggcaggcgccgggcaagggccuggagugggugagcuccaucagcgggggcuccagcuccaaggacuacgccgacagcgucaaggggcgcuucaccaucucccgggacaacagcaagaacacgcucucccugcagaugaacagccugcgccccgaggacaccgccguguacuacugcgccaaggacgugggcgccaacaaggacgacgagugggcgaccgacuacuacgaccucuccaucgccuaccccguccccgacccgcgggccguggugggggccuucgacaucuggggccagggcaccauggucacggugagcucc

SEQ ID NO: 9766 - RNA, 432 nt, Artificial Sequence
  derived and/or modified sequence opt1 from anti-HIV_cap256-048-122208_VR-Chain
cgcgugcaggucguggagagcggcgggggcguggucaagcccgggggcucccugcggcucagcugcggggccuccggcuucaccuucagcaacgccuggcuguccugggugcgccaggcgccgggcaaggggcuggaguggguggccgucaucagcuccgacggcagcuccaagaacuacgccgacagcgugaaggggcgguucaccaucucccgcgacaacagcaagaacacggugucccuccagaugaacagccugcggcccgaggacaccgccgucuacuacugcgccaaggacgugggcgcgaacaaggacgacgagugggccaccgacuacuacgaccuguccaucgccuaccccgugcccgacccgcgcgccgucgugggggcguucgacaucuggggccagggcaccauggugacggucagcucc

SEQ ID NO: 9767 - RNA, 432 nt, Artificial Sequence
  derived and/or modified sequence opt1 from anti-HIV_cap256-048-121552_VR-Chain
caggugcagcuggucgagagcggcgggggcguggugcagcccgggggcucccuccgccugagcugcgccgccuccggguucaccuucagcuccuacgcgaugcacuggguccggcaggccccgggcaagggccugaaguggguggccgacaucagcuacgacgccuccagcaaguacuacgccgacuccgugaaggggcgcuucaccaucagccgggacaacuccaagaacacgcucuaccuggagaugaacagccugcgccccgaggacaccgcggucuacuacugcgccaaggaccucggcgagcgggagugcgaggagugggccuccgacuacuacgacuucgggcgcgacuuccccugccaggacccccggggcgugguggggaccuucgacaucuggggccagggcaccauggucacggugagcucc

SEQ ID NO: 9768 - RNA, 432 nt, Artificial Sequence
  derived and/or modified sequence opt1 from anti-HIV_cap256-048-120643_VR-Chain
caggugcagcuggucgagagcggcgggggcguggugcagcccgggcgcucccuccggcugagcugcgccgccuccggcuucacccugagcgcguacaccaugcacuggguccgccaggccccggggaagggccucgaguggguguccgugaucagcuucgccggcaacaacaaguacuacgccgacuccgucaaggggcgguucacgaucagccgcgagaacuccaagaacaugcuguaccugcagaugaacagccuccggggcgaggacaccgccguguacuacugcgcgaaggaccugcgcgaguucgagugcgaggagugggccuccgacuacuacgacuucgggcgggacuaccccugccaggacccccgcggcguggucgggaccuucgacguguggggccacggcagccuggugaccgucuccagc

SEQ ID NO: 9769 - RNA, 432 nt, Artificial Sequence
  derived and/or modified sequence opt1 from anti-HIV_cap256-048-118458_VR-Chain
caggugcagcuggucgagagcggcgggggcguggugcagcccgggcggucccuccggcugagcugcgccgccuccggcuucaccuucagcaccuccgggaugcacuggguccgccaggcgccgggcaagggccuggaguggguggccuucaucagcuccgaccggagcaacaaguucuacgccgacuccgugaaggggcgcuucagcaucucccgggacaacagcaaguacacgcucuaccugcagaugaacucccugcgcgccgacgacaccgccgucuacuucugcgcgaaggaccucggcgugaacaagaacgacgagugggccaccgacuacuacgaccugagcguggccuaccccguccaggacccccgcgggguggccggcaucuucgacaucugggggcagggcaccauggugacggucuccagc

SEQ ID NO: 9770 - RNA, 432 nt, Artificial Sequence
  derived and/or modified sequence opt1 from anti-HIV_cap256-048-118112_VR-Chain
caggagcagcugguggagagcggcgggggcgucgugcagcccgggcgcucccuccggcugagcugcgccgccucccaguucaccuucagcaacuacggcaugcacugggugcgccaggcgccggggaagggccuggucuggguggccggcaucuccuucgccgggaccaacaaguacuacgccgccagcgugaagggccgguucacgaucucccgcgacaacagcaagaacacccucuaccugcagaugaacucccugcgggcggaggacaccgcccucuacuacugcgccaaggacaugcgcgaguacgagugcgaggagugggccagcgacuacuacgacuucgggcgggacuaccccugccaggacccccgcggcgucguggggaccuucgacaucuggggccagggcacgauggugaccgucuccagc

SEQ ID NO: 9771 - RNA, 432 nt, Artificial Sequence
  derived and/or modified sequence opt1 from anti-HIV_cap256-048-116469_VR-Chain
caggugcagcuggucgagagcggcgggggcguggugcagcccgggcgcucccuccggcugagcugcgccgccuccggcuucaccuucagcuccuacgcgaugcacuggguccgccaggccccggggaagggccuggaguggguggccaucaucagcuacgacggcuccaacaaguacuacgccgacagcgugaaggggcgguucaccaucucccgcgacaaccccaagaacacgcucuaccugcagaugaacagccugcgggccgaggacaccggccucuacuacugcgcgaaggacaugggggaguccgagaaggaggagugggccagcgacuacuacgacuucggccgcgacuaccccgggcaggagccccgggccauggucggcaccuucgacaucuggggccaggggaccauggugacgguguccagc

SEQ ID NO: 9772 - RNA, 432 nt, Artificial Sequence
  derived and/or modified sequence opt1 from anti-HIV_cap256-048-113917_VR-Chain
gaggugcagcuggucgagagcggcgggggccucgugcagcccgggggcucccugcgccugagcugcgccgccuccgggcucaccgugagcgacaccuacaugaacuggcugcggcaggcgccgggcaagggccuggagugggucgccgugguguccagcgacggguccaacaagaacuacgccgacagcgucaagggccgcuucacgaucucccgggacaacagcaagaacaccguguaccuccagaugaacucccugcgcgccgaggacaccgccguguacuacugcgcgaaggaccugggggccaacaaggacgacgagugggccaccgacuacuacgaccucagcgucgccuaccccgugcccgacccccgggcgguggucggcgccuucgacgugugggggcagggcacgauggugaccgucuccagc

SEQ ID NO: 9773 - RNA, 432 nt, Artificial Sequence
  derived and/or modified sequence opt1 from anti-HIV_cap256-048-112368_VR-Chain
caggugcagcuggucgagagcggcgggggcguggugcagcccgggcgcucccuccggcugagcugcgccgccuccggcuucaccuucagccgcaacgcgaugcacuggguccggcaggccccggggaagggccuggaguggguggccgugaucuccuacgacggcagcaacaaguacuacgccgacuccgucaaggggcgcuucaccaucagccgggacaacuccaagaacacgcucuaccugcagaugaacagccugcgcgccgaggacaccgcgguguacuacugcgccaaggaccucggcgggggcgagguggaggagugggccaccgacuacuacgacugguccaccgccuaccccgucgagcacccccgggcgguggugggggucuucgacaucuggggccagggcacgaaggugaccgugagcucc

SEQ ID NO: 9774 - RNA, 432 nt, Artificial Sequence
  derived and/or modified sequence opt1 from anti-HIV_cap256-048-112047_VR-Chain
gaggugcagcuggucgagagcggcgggggccucgugcagcccgggggcucccugcgccugagcugcgccgccuccgggcucaccgugagcggcuacuacauguccuggguccggcaggcgccgggcaaggggcuggaguggcuggccuucauccacuucgacggcagcaagauccacuacgccggguccgugaagggccgcaucaccgugagccgggacaacuccaagaacacgcucgaccugcagaugaacagccugcgcgccgaggacaccgccgucuacuacugcgcgaaggacgugggggacuccaagagcgacgagugggccaccgacuacuacgaccucuccguggccuaccccguccccgacccccgggccguggugggcgcguucgacaucuggggccaggggaccauggucacggugagcucc

SEQ ID NO: 9775 - RNA, 432 nt, Artificial Sequence
  derived and/or modified sequence opt1 from anti-HIV_cap256-048-112029_VR-Chain
caggugcagcuggucgagagcggcgggggcguggugcagcccgggcgcucccuccggcugagcugcgccgccucccaguucaccuucagcuccuacggcaugcacuggguccgccaggcgccggggaagggccuggaguggguggccggcaucagcuucgccgggaucaagaaguacuacgccgacuccgugaagggccgguucaccaucagccgcgacaacuccaagaacacgcucuaccugcagaugaacagccugcgcggggaggacaccgcccucuacuacugcgcgaaggaccugcgggaguacgagugcgaggagugggccuccgacuacuacgacuucggccgggacuaccccugccaggacccccgcggggucgugggcaucuucgacaucuggggccaggggaccauggugaccgucagcucc

SEQ ID NO: 9776 - RNA, 432 nt, Artificial Sequence
  derived and/or modified sequence opt1 from anti-HIV_cap256-048-110957_VR-Chain
caggugcgccuggucgagagcggcgggggcguggugcgguccgggcgcagccuccggcuguccugcgccgccagcggcuucaccuucuccaacuucgcgcugcacuggguccgccaggcccccgggaagggccucgaguggguggccgugaucagcuacgacggcaacuccaaguucuacgccgacagcgucaaggggcgguucaccaucuccacggacaacagcaagaacacccuguaccugcagaugaacucccucaccgccgaggacaccgcgguguacuacugcgccaaggaccugggcgggaacaaggacgacgaguggggcacggacuacuacgacuucagcguggccuacccgguccaggacccccgcgccguguccgggaucuucgacguguggggccacggcaccauggucaccgugagcucc

SEQ ID NO: 9777 - RNA, 432 nt, Artificial Sequence
  derived and/or modified sequence opt1 from anti-HIV_cap256-048-110526_VR-Chain
caggugcagcuggucgagagcggcgggggcguggugcagcccgggcgcucccuccggcugagcugcgccgccuccggcuucaccuucagcaacuucggguuccacuggguccgccaggcgccgggcaagggccuggaguggguggccgccaucuccuucgccgggaacaacaaguacuacgccgacagcgugaagggccgguucaccaucucccgcgagaacagcaagaacauccucuaccugcagaugaacucccugcgcggggaggacacggcggucuacuacugcgccaaggaccuccgggaguucgagugcgaggagugggccagcgacuacuacgacugguccaccgccuaccccguggagcacccccgggcgguggucggcguguucgacaucugggggcagggcaccaaggugaccgucagcucc

SEQ ID NO: 9778 - RNA, 432 nt, Artificial Sequence
  derived and/or modified sequence opt1 from anti-HIV_cap256-048-109336_VR-Chain
gaggugcagcuggucgagagcggcgggggccucgugcagcccgggggcucccagcgccugagcugcgccgccuccgggcugaccgugaacagcaacuacaugaccuggguccggcaggcgccgggcaagggccucgaguggguggccaucaucuccagcgacggguccggccaguacuacgccgacagcgugaaggggcgcuucacgaucucccgggacaacagcaagaacacccugucccugcagaugaacagccuccgccccgaggacaccgccgucuacuacugcgccaaggaccugggcgcguccaaggacgacgagugggccaccgacuacuacgacuucagcaucgccuaccccgugcaggacccccgggccguggucggggcguucgacaucuggggccagggcacgauggugaccguguccagc

SEQ ID NO: 9779 - RNA, 432 nt, Artificial Sequence
  derived and/or modified sequence opt1 from anti-HIV_cap256-048-108152_VR-Chain
caggcccagcugguggagagcggcgggggcgucgugcagcccgggcgcucccucgugcugagcuccgucgccagcggcuucuccuucagcaccuacgcgaugcacugggugcggcaggccccggggaagggccuggaguggguggccgucaucuccuacgacggcgggaacaaguacuacgccgacagcgugaagggccgcuucuccaucagccgggacaacuccaagaacaccguguaccuccagaucaacagccugcgcgccgaggacacggcggucuacuacugcgccaaggaccugggggccaacaaggacgacgagugggccaccgacuacuacgaccucuccguggcguaccccgugcccgacccccgggccgucgugggcgccuucgacgugugggggcagggcaccauggucaccgugagcucc

SEQ ID NO: 9780 - RNA, 432 nt, Artificial Sequence
  derived and/or modified sequence opt1 from anti-HIV_cap256-048-107799_VR-Chain
gaggugcaggucguggagagcggcgggggcgugguccagcccgggcgcucccugcggcucagcugcgccgccuccggcuucaccuucagcaacuacgcgauggacugggugcgccaggccccggggaagggccuggaguggguggccuucgucuccagcgacggcuccaacaagaacuacgccgacagcgugaaggggcgguucaccaucucccgcgacaacagcaagaacacgcugucccuccagaugaacagccugcgggccgaggacaccgcgguguacuacugcgccaaggaggucggcgagaacaaggacgacgagugggccuccgacuacuacgaccugagcaucgccuaccccauccacgacccccgcgcgguggucgggggcuucgacaucugggggcagggcaccauggugaccguguccagc

SEQ ID NO: 9781 - RNA, 432 nt, Artificial Sequence
  derived and/or modified sequence opt1 from anti-HIV_cap256-048-107384_VR-Chain
gaggugcgccuggucgagagcggcggggcccucgugaagcccggcaccucccugcggcugagcugcgccgcguccggguucaccuucacgcacuacgccauggacugggugcgccaggccccgggcaaggggcucgagugggucgccaucaucagcuccgacggcagcaccaagaacuacgccgacuccgugaagggccgguucaccaucagccgcgacaacuccaagaacacccugagccugcagaugaacucccuccggcccgaggacacggcgguguacuacugcgccaaggacgucggggccaacaaggacgacgagugggccaccgacuacuacgaccugagcaucgcguaccccgugcccgacccgcgcgccguggucggcgccuucgacaucugggggcagggcaccauggugaccguguccagc

SEQ ID NO: 9782 - RNA, 432 nt, Artificial Sequence
  derived and/or modified sequence opt1 from anti-HIV_cap256-048-106530_VR-Chain
gaggugcagcugcucgagagcggcgggggccugguccagcccgggggcucccugcgccucagcugcgccgccuccggguucaccuucagcuccuacgcgauggacugggugcggcaggccccgggcaagggccuggaguggguggccgucaucagcuccgacgggagcaacaagaacuacgccgacuccgugaagggccgcuucaccaucagccgggacaacuccaagaacacgcuguaccuccagaugagcucccugcgccccgaggacaccgccguguacuacugcgcgaaggacgucggggacagcaaguccgacgagugggccaccgacuacuacgacuucagcaucgccuaccccauccaggacccccgggccguggugggcgcguucgacaucugggggcagggcaccauggucacgguguccagc

SEQ ID NO: 9783 - RNA, 432 nt, Artificial Sequence
  derived and/or modified sequence opt1 from anti-HIV_cap256-048-106464_VR-Chain
gaggugcagaugguccagagcggcgggggccuggugcagcccgggggcucccuccgccugagcugcgccgccuucggguucaccuucaccaaccacgcgauggacugggugcggcaggucccgggcaagggccuggaguggguggccuucaucuccagcgacggguccaacaagaacuacgccgacagcgugaagggccgcuucacgaucucccgggacaacagcaagaacaccgucuaccuccagauguccagccugcgccccgaggacaccgccguguacuacugcgccaaggacgugggggacuccaagagcgacgagugggcgaccgacuacuacgaccuguccgucgccuaccccgugcccgacccgcgggccguggucggcgccuucgacaucugggggcagggcacgauggugaccgugagcucc

SEQ ID NO: 9784 - RNA, 432 nt, Artificial Sequence
  derived and/or modified sequence opt1 from anti-HIV_cap256-048-106411_VR-Chain
caggugcagcuggucgagagcggcgggggcguggugcagcccgggcgcucccuccggcugagcugcgccgccuccggcuucaccuucagcuacuccgggaugcacuggguccgccaggcgccgggcaagggcauggaguggguggccgugaucagcuacgacggguccaacaaguacuacgccgacagcgucaagggccgguucaccaucucccgcgacaacagcaagaacacgcuguaccuccagaugaacucccugcggguggaggacaccgccguguaccacugcgccaaggaccucgggggcaccaagagcgacgagugggcgaccgacuacuacgaccuguccaucgccuaccccauccaggaccccggggccgucgugggcguguucgacaucuggggccaggggacgauggucaccgugagcucc

SEQ ID NO: 9785 - RNA, 432 nt, Artificial Sequence
  derived and/or modified sequence opt1 from anti-HIV_cap256-048-106306_VR-Chain
gaggugcagcuggucgagagcggcgggggccucgugcagcccgggggcucccugcgccugagcugcgaggccuccggguucaccuucaacaacuacggcaugguguggguccggcaggccccgggcaaggggcucgaguggguggcgaucaucagcuacgacggcaccgagaaguacuacguggacuccgucaaggggcgcuucacgaucagccgggacaacuccaagaacacccugagccugcagaugaacucccuccgcgccgaggacaccgccguguacuacugcgccaaggaggugggcgagaacaaggacgacgagugggccagcgacuacuacgaccuguccaucgcguaccccauccacgacccccgggccgucgucgggggcuucgacaucuggggccaggggaccauggugacggugagcucc

SEQ ID NO: 9786 - RNA, 432 nt, Artificial Sequence
  derived and/or modified sequence opt1 from anti-HIV_cap256-048-104496_VR-Chain
caggugcagcuggucgagagcggcgggggccucgugaagcccgggggcucccugcgccugagcugcgccgccuccggguucaccuucagcuccuacggcaugcacugggugcggcaggcgccgggcaaggggcucgagugggucgccuucgugagcuccgacggcaacaacaagaacuacgccgacagcgugaaggggcgcuucaccaucucccgggacaacagcaagaacacggucuaccugcagaugaacucccugcgcguggaggacaccgccguguacuacugcgccaaggaccucggcgcgaacaaggacgacgagugggccaccgacuacuacgaccugagcgucgccuaccccgugcccgacccccgggccguggucggggcguucgacguguggggccagggcaccauggugacggucuccagc

SEQ ID NO: 9787 - RNA, 432 nt, Artificial Sequence
  derived and/or modified sequence opt1 from anti-HIV_cap256-048-103074_VR-Chain
caggugcaccuggucgagagcggcgccgggguggugcagcccggcgggucccuccgccugagcugcgccgucuccggcuucaccuucaacagcuacgggaugcacugggugcggcaggcgccgggcaagggccuggaguggguggccgucaucuccuacgacgggagcgacaaguacuacgccgacuccgugaagggccgcuucaccaucagccgggacuccagcaagaacacgcucuaccugcagaugaacucccugcgcguggaggacaccgccgucuacuacugcgccaaggaccucggggcgaacaaggacgacgagugggccaccgacuacuacgaccugagcguggccuaccccgugcccgacccccgggccgucgugggcgcguucgacgugugggggcagggcaccauggucacgguguccagc

SEQ ID NO: 9788 - RNA, 432 nt, Artificial Sequence
  derived and/or modified sequence opt1 from anti-HIV_cap256-048-100832_VR-Chain
caggugcagcuggucgagagcggcgggggcguggugcagcccgggcgcucccuccggcugagcugcgccgccuccggcuucaccuucagcuccuacgggaugcacuggguccgccaggcgccgggcaagggccuggaguggguggccguggucagcuccgacgggaccaacaagaacuacggcgacagcgugaaggggcgguucacgaucucccgcgacaacagccggaacaccguguaccuccagauguccagccugcgccccgaggacaccgccgucuacuacugcgccaaggacgugggcgacaccaaguccgacgagugggccacggacuacuacgacuucagcaucgcguaccccgugcaggacccccgggccgucgugggggccuucgacaucuggggccagggcaccauggugaccgucuccagc

SEQ ID NO: 9789 - RNA, 432 nt, Artificial Sequence
  derived and/or modified sequence opt1 from anti-HIV_cap256-048-100188_VR-Chain
caggugcaccuggucgagagcggcgggggcguggugcagcccgggcgcucccuccggaucuacugcgccgucagcgaguucaccuuccgcaacuacgccaugcacugggugcggcuggcgccgggcaaggggcugcaguggguggccgucaucuccuacaacggcggcaagaaguacuacgccgacagcgugaaggggcgcuucaccaucucccgggacaacagcaagaacgcccucuaccugcagaugaacucccugcgcgccgaggacacgggccucuacuacugcgcgaaggaccugcgggaguucgagugcgaggagugggccagcgacuacuacgacuucgggcgcgaguaccccugccaggacccccggggcguggucgggaccuucgacaucuggggccagggcaccauggugaccguguccagc

SEQ ID NO: 9790 - RNA, 432 nt, Artificial Sequence
  derived and/or modified sequence opt1 from anti-HIV_cap256-048-099645_VR-Chain
caggugcagcuggucgagagcggcgggggcguggugcagcccgggcggucccuccggcugagcugcgccgccuccggcuucaccuucagccgcuacgcgcugcacuggguccggcaggccccggggaagggccucgaguggguggccgugaucuccuacgacggcagcuccaaguacuacgccgacagcgucaaggggcgcuucuccaucagccgggacaacuccaaguacacccuguaccugcagaugaacagccuccgcgccgacgacacggcgguguacuucugcgccaaggaccugggcgugaacaagaacgacgagugggccaccgacuacuacgaccuguccgucgccuaccccgugcaggacccccgcgggguggcgggcaucuucgacaucugggggcagggcaccauggucaccgugagcucc

SEQ ID NO: 9791 - RNA, 432 nt, Artificial Sequence
  derived and/or modified sequence opt1 from anti-HIV_cap256-048-098137_VR-Chain
caggugcagcuggucgagagcggcgggggcguggugcagcccgggcgcucccuccggcugagcugcgccgccuccggcuucacccugcgcaacuacgcgaugcacuggguccggcaggccccggggaagggccucgaguggguggccgugaucagcuccgacggcaacaacaaguacuacgccgacagcgucaaggggcgcuucaccgugucccgggacaacagcaaggacacgcuguaccugcagaugaacucccuccgccccgaggacaccgcccuguacuacugcgcgaaggaccugggcgagcgggagugcgaggagugggccagcaacuacuacgacuucgggcgcgacuaccccugccaggacccccggggcguggucgggaccuucgacaucuggggccagggcaccauggugacgguguccagc

SEQ ID NO: 9792 - RNA, 432 nt, Artificial Sequence
  derived and/or modified sequence opt1 from anti-HIV_cap256-048-097878_VR-Chain
caggugcagcugcucgagagcggcgggggcgucgugcagcccgggaagucccugcggcugagcugcgccgccuccggcuucaccuucaacaccuacgggaugcacugggugcggcaggcgccgggcaagggccuccagugggucgccgugaucagcuacgacgggacgauccagaaguacgccgacuccgugaagggccgcuucaccaucagccgggagaacuccaagaacaugcuguaccugcagaugaacagccuccgcggggaggacaccgccgucuacuacugcgccaaggaccugcgggaguucgagugcgaggagugggcguccgacuacuacgacuucggccgcgacuaccccugccaggacccccgcgggguggugggcaccuucgacgucuggggccacgggagccuggugacgguguccagc

SEQ ID NO: 9793 - RNA, 432 nt, Artificial Sequence
  derived and/or modified sequence opt1 from anti-HIV_cap256-048-097510_VR-Chain
caggugcagcuggucgagagcggcgggggcguggugcagcccgggcgcucccucuggcugagcugcgccgccuccgaguucacccugcggagcuacggcaugcacuggguccgccaggcgccggggaagggccucgaguggguggccuucguggccuucgacgaguccgacaaguacuacgccgacagcgucaagggccgguucaccaucucccgcgacaacagcaagaacacgcugucccugcagaugaacagccuccgggccgaggacaccgcgguguacuacugcgccaaggaggugggggacaacaaggacgacgagugggccuccgacuacuacgaccugagcaucgccuaccccguccacgacccccgcgcgguggugggcggguucgacaucuggggccaggggaccauggucaccguguccagc

SEQ ID NO: 9794 - RNA, 432 nt, Artificial Sequence
  derived and/or modified sequence opt1 from anti-HIV_cap256-048-097313_VR-Chain
caggugcagcuggucgagagcggcgggggccucgugcagcccgggggcgcccugcgccuguccugccucgugagcggguucaccuucgacgacuacgcccugcacuggguccggcaggcgccgggcaagggccccgaguggguggccgugcuguccagcgacggguccuacaaguacuacaccgagagcguccagggccgcuucacgaucucccgggacaacagcaagaacaccguguaccuccagaugaacucccugcgcgggguggacaccgccgucuacuacugcgccaaggaccugggcgggggcgagguggaggagugggccaccgacuacuacgacuggagcaucgcguaccccguggagcacccccgggccgucgugggcguguucgacaucugggggcagggcacgaaggucaccguguccagc

SEQ ID NO: 9795 - RNA, 432 nt, Artificial Sequence
  derived and/or modified sequence opt1 from anti-HIV_cap256-048-096626_VR-Chain
gaggugcagcuggucgagagcggcgggggccucgugcagcccggggagucccugcgccugagcugcgccggcuccggguucaccuucagcuccuacuggaugagcugggugcggcaggccccgggcaagggccucgaguggauggcgcugaucuccuacgacgggagcaacaaguacuacgucgacuccgugaagggccgcuucaccaucagccgggacaacuccaagaacacgcuguaccuccagaugaacagccugcgcgccgaggacaccgccguguacuacugcgccaaggaccucgggggcaacaaggacgacgagugggccaccgacuacuacgaccuguccaucgcguaccccguccaggacccccgggugguggucgggaucuucgacaucuggggccagggcaccauggugacggugagcucc

SEQ ID NO: 9796 - RNA, 432 nt, Artificial Sequence
  derived and/or modified sequence opt1 from anti-HIV_cap256-048-096483_VR-Chain
gaggugcagcuggucgagagcggcgggggccucgugcagcccgggcgcucccugcggcugagcugcgccgccuccggcuucagcuucgaggacuacgcgaugcacugggugcgccaggccccggggaagggccucgagugggucgccggcaucuccuucgccgggaccaagaaguacuacgccgacagcgugaagggccgguucaccaucucccgcgacaacagcaagaacgcgcuguaccugcagaugaacucccuccgggccgaggacacggcccuguacuacugcgccaaggaccugcgcgaguacgagugcgaggagugggcgagcgacuacuacgacuucgggcgggacuaccccugccaggacccccgcggcguggucgggaccuucgacaucuggggccagggcaccauggugaccguguccagc

SEQ ID NO: 9797 - RNA, 432 nt, Artificial Sequence
  derived and/or modified sequence opt1 from anti-HIV_cap256-048-095691_VR-Chain
caggugcagcuggucgagagcggcgggggcguggugcagcccgggcgcucccuccggcugagcugcgccgccuccggcuucaccuucagcuccuacgggauggcguggguccgccaggccccgggcaagggccuggagugggugaccgccaucagcuucgccgggacgaacaaguacuacgccgacuccgugaagggccgguucaccaucagccgcgacaacuccaaggacacccucuaccugcagauggacgggcugcggcccgaggacaccgcgcucuacuacugcgccaaggaccugggcgagcgcgagugcgaggagugggccagcaacuacuacgacuucgggcgggacuaccccugccaggacccccgcggcgucgugggcacguucgacaucugggggcagggcaccauggugaccgucuccagc

SEQ ID NO: 9798 - RNA, 432 nt, Artificial Sequence
  derived and/or modified sequence opt1 from anti-HIV_cap256-048-095525_VR-Chain
caggugcagcugguccagagcggcggguccguggugcagcccggcaagagccuccgccuguccugcgccgccagcggguucaccuucuccagcuucggcaugcacuggguccggcagaccccggggaagggccuggaguggguggcggugaucuccuacgacggcagcgagaaguccuacgccgacagcgucaaggggcgcuucacgaucucccgggacaacagcaagaacacccucuaccugcagaugaacucccugcgcgccgaggacaccgccguguacuacugcgccaaggaccucggcgggaccaaggacgacgagugggcgacggacuacuacgacaucagcaucgccuaccccgugcaggacccccgggccgucgccggcgcguucgacaucugggggcagggcaccauggugaccguguccagc

SEQ ID NO: 9799 - RNA, 432 nt, Artificial Sequence
  derived and/or modified sequence opt1 from anti-HIV_cap256-048-094783_VR-Chain
gaggugcagcuggucgagagcggcgggggccucgugaagcccgggggcucccugcgccugagcugcgccgccuccgggaucaccuucagcaccuacgagaugaacugggugcggcaggcgccgggcaagggcauggagugggucgccgugaucuccuacgacgggagcaacaaguacuacgccgacuccgugaagggccgcuucacgaucagccgggacaacuccaagaacaccgucuaccuccagaugaacagccugcgcgggguggacaccgccguguacuacugcgccaaggaccugggcgggggcgaggucgaggagugggcgaccgacuacuacgacugguccaucgccuaccccguggagcacccccgggccguggucggcguguucgacaucugggggcagggcacgaaggugaccgucagcucc

SEQ ID NO: 9800 - RNA, 432 nt, Artificial Sequence
  derived and/or modified sequence opt1 from anti-HIV_cap256-048-094356_VR-Chain
caggugcagcuggucgagagcggcgggggcguggugcagcccgggcgcucccuccggcugagcugcgccgccuccggcuucaucuucacccacuacgcgauggacuggguccgccaggccccggggaagggccuggaguggguggccgugaucagcuccgacggcagcuccaagaacuacgccgacagcgucaaggggcgguucaccaucucccgcgacaacagcaagaacacggugucccuccagaugaacagccugcggcccgaggacaccgccguguacuacugcgcgaaggacgucggcgacaacaaguccgacgagugggccaccgacuacuacgacuucagcaucgccuaccccgugcccgacccgcgcgccguggucggggcguucgaccuguggggccaggggaccauggugacgguguccagc

SEQ ID NO: 9801 - RNA, 432 nt, Artificial Sequence
  derived and/or modified sequence opt1 from anti-HIV_cap256-048-090756_VR-Chain
caggugcagcuggucgagagcggcgggggcguggugcgccccgggcggucccuccgccugagcugcgccgucuccggcuucaccuucagcaacuacgccauccacugggugcggcaggcgccggggaagggccuggaguggguggccgucaucuccuacgacggcagcgacaaguacuacgccgacuccgugaaggggcgcuucaccaucagccgggagaacuccaagaacaugcucuaccugcagaugaacagccugcgcggcgaggacacggccguguacuacugcgccaaggaccuccgggaguucgagugcgaggagugggcguccgacuacuacgacuucgggcgcgacuaccccugccaggacccccggggcgucguggggaccuucgacguguggggccacggcagccuggucaccguguccagc

SEQ ID NO: 9802 - RNA, 432 nt, Artificial Sequence
  derived and/or modified sequence opt1 from anti-HIV_cap256-048-089065_VR-Chain
caggugcagcuggucgagagcggcgggggcguggugcagcccgggcgcucccuccggcugagcugcgccgccuccggcuucaccuucagcaccuacgcgaugcacuggguccgccaggccccggggaagggccuggaguggguggcccucaucuccuacgacggcacgaacaaguacuacguggacagcgucaaggggcgguucaccaucucccgcgacaacagcaagaacacccuguaccugcagaugaacucccucaccgccgaggacacggccguguacuacugcgcgaaggaccugggcgggaacaaggacgacgaguggggcaccgacuacuacgacuucagcguggccuaccccguccaggacccccgggccguguccgggaucuucgacguguggggccacggcaccauggucaccgugagcucc

SEQ ID NO: 9803 - RNA, 432 nt, Artificial Sequence
  derived and/or modified sequence opt1 from anti-HIV_cap256-048-084986_VR-Chain
caggugcagcuggucgagagcggcgggggcguggugcagcccgggcgcucccuccggcugagcugcgccgccuccggcuucaccuucagcgacuacgcgaugcacuggguccgccaggccccggggaagggccuggaguggguggcccucaucuccuacgacggcagcaacaaguacuacgccgacuccgugaaggggcgguucaccaucagccgcgacaacuccaagaacacgcuguaccugcagaugagcucccucaccgccgaggacaccgcggucuacuacugcgccaaggaccugggcgggaacaagaacgacgagugggccaccgacuacuacgaccugagcaucgccuaccccauccacgacccccgggcggugcucggcgccuucgacgugugggggcagggcacgaugcugaccgucuccagc

SEQ ID NO: 9804 - RNA, 432 nt, Artificial Sequence
  derived and/or modified sequence opt1 from anti-HIV_cap256-048-083355_VR-Chain
caggugcagcuggucgagagcggcgggggcguggugcagcccgggcgcucccuccggcugagcugcgccgucuccggcuucaucuucagcuccuacgccaugcgcugggugcggcaggcgccggggaagggccuggaguggguggccgucaucagcuacgacggcuccaagaccaacuacgccgacagcgugaaggggcgcuucaccaucucccgggacaacagcaagaacacgcucuaccugcagaugaacucccugaccagcgaggacaccgccguguacuacugcgccaaggaccucggcggguccaagaccgacgaguggggcacggacuacuacgaguucuggaacgcguaccccguccaggacccccgcgugguggucggggccuucgacaucuggggccacggcaccauggugaccgugagcucc

SEQ ID NO: 9805 - RNA, 432 nt, Artificial Sequence
  derived and/or modified sequence opt1 from anti-HIV_cap256-048-082462_VR-Chain
caggugcaccuggucgagagcggcgggggcguggugcagcccgggaagucccuccgccugagcugcaccgccucccgguucaucuuccgcaacuacgccauggacuggguccggcaggcgccgggcaaggggcuggaguggguggccgugaucagcuacgacggcgucaaggagcacuacgccgaguccgugaagggccgcuucaccaucagccgggacaacuccaagaacacgguguaccuccagaugaacagccugcgcgucgaggacaccgccguguacuacugcgccaaggaccugggggcgaacaaggacgacgagugggccaccgacuacuacgaccucuccguggccuaccccguccccgacccccgggccguggugggcgcguucgacgucugggggcagggcaccauggugacggugagcucc

SEQ ID NO: 9806 - RNA, 432 nt, Artificial Sequence
  derived and/or modified sequence opt1 from anti-HIV_cap256-048-082246_VR-Chain
caggugcaccuggucgagagcggcgggggcguggugcagcccgggcgcucccuccggaucagcugcgccgccuccggcuucaccuucagcaagaacgcgaugcacuggguccgccaggccccggggaagggccuggaguggguggccuucguggccuucgacgaguccgacaaguacuacgccgacagcgucaagggccgguucaccaucucccgcgacaacagcaagaacauccugucccuccagaugaacagccugcgggcggaggacacggccguguacuacugcgccaaggagguggacgaguacaaggacgacgagugggccuccgacuacuacgaccugagcaucgcguaccccguccgcgacccccgggccguggucgggggcuucgacaucugggggcagggcaccauggugaccguguccgcc

SEQ ID NO: 9807 - RNA, 432 nt, Artificial Sequence
  derived and/or modified sequence opt1 from anti-HIV_cap256-048-080752_VR-Chain
caggugcagcuggucgagagcggcgggggcguggugcagcccgggggcucccuccgccugagcugcgccgccuccggguucaccuucagcaacuacggcaugcacuggguccggcaggcgccgggcaaggggcuggaguggguggccuucauccgcuacgacggcgacaucaccuacuacguggacuccgucaaggggcgguucacgaucagccgcgacaacuccaagaacgcccucuaccugcagaugaacagccugcgggccgaggacaccgcccucuacuacugcgcgaaggaccugcgcgaguacgagugcgaggagugggccuccgacuacuacgacuucggccgggaguaccccugccaggacccccgcgggguggugggcaccuucgacaucuggggccaggggaccauggucacggugagcucc

SEQ ID NO: 9808 - RNA, 435 nt, Artificial Sequence
  derived and/or modified sequence opt1 from anti-HIV_cap256-048-078409_VR-Chain
caggugcagcuggucgagagcggcgggggcguggugcagcccgggcgcucccuccggcugagcugcgccgccuccggcuucaccuucaacaacuacgcgauggacuggguccgccaggccccggggaagggccuggaguggguggcccucaucagcuacgacggcuccaacaaguacuacgccgagagcgugaaggggcgguucaccaucucccgcgacaacagcaagaacacgcuguaccugcagaugaacucccuccgggccgaggacaccgcggucuacuacugcgccaaggacgugggcgagaagcagagcaugaugcgcugggccaccgacuacuacgaccuguccaucgccuaccccgugcccgacccccgggcggucgugggggccuucgaccuguggggccgcgggaccauggugacggucagcucc

SEQ ID NO: 9809 - RNA, 432 nt, Artificial Sequence
  derived and/or modified sequence opt1 from anti-HIV_cap256-048-078273_VR-Chain
gaggugcagcuggucgagagcggcgggggccucgugcagcccgggggcucccugcgccugagcugcgccgccuccggguucaccgugagcuccaacuacaugagcuggguccggcaggcgccgggcaagggccucgaguggguggccgugaucuccagcgacggguccaacaagaacuacgccgacagcgucaagggccgcuucaccaucucccgggacaacagcaagaacacgcuguuccugcagaugaacucccuccgccccgaggacaccgccguguacuucugcgccaaggaccugggggcgaacaaggacgacgagugggccaccgacuacuacgaccugagcaucgccuaccccgugcacgacccccgggccgucgugggcaucuucgaccucugggggcagggcaccauggugacggucuccagc

SEQ ID NO: 9810 - RNA, 432 nt, Artificial Sequence
  derived and/or modified sequence opt1 from anti-HIV_cap256-048-078062_VR-Chain
gacguguaccuggucgagagcggcgggggccucgugcagcccgggggcucccugcgccugagcugcaccgccuccgggaucaccuucagcacguacgagaugaacugggugcggcaggccccgggcaagggccucgagugggucgcguucguggccuucgacggguccgacaaguacuacgccgacagcgugaagggccgcuucgucaucucccgggacaacagcaagaacacccugucccugcagaugaacagccuccgcgccgaggacaccgccguguacuacugcgcgaaggaggugggggaggacaaggacgacgagugggccuccgacuacuacgaccugagcaucgccuaccccguccacgacccccgggccguggugggcggguucgacaucuggggccagggcaccauggucacgguguccagc

SEQ ID NO: 9811 - RNA, 432 nt, Artificial Sequence
  derived and/or modified sequence opt1 from anti-HIV_cap256-048-077798_VR-Chain
caggugcagcuggucgagagcggcgggggcguggugcagcccgggcgcucccuccggcugagcugcgccgccuccggcuucaccuucagcaacuacgggaugcacuggguccgccagaccccgggcaagggccuggaguggguggcggugaucuccuacgacgggagcaacaaguucuacgccgacuccgucaagggccgguucacgaucagccgcgacaacuccaagaacacccucuaccugcagaugaacagccugcggguggaggacaccgccguguaccacugcgccaaggaccucgggggcuccaagagcgacgagugggccaccgacuacuacgacugguccaucgcguaccccguccacgacccccgcgccguggugggggucuucgacaucuggggccagggcacgcuggugaccgugagcucc

SEQ ID NO: 9812 - RNA, 432 nt, Artificial Sequence
  derived and/or modified sequence opt1 from anti-HIV_cap256-048-073853_VR-Chain
gaggugcagcuggucgagagcggcgggggccucgugaagcccgggggcucccugcggcugagcugcgccgccuccggguucaccuucagcgacgcguggaugaacugggugcggcaggccccgggcaagggccucgagugggucgccgggaucuccuucgccggcaccaacaaguacuacgccgacagcgugaaggggcgcuucacgaucucccgggacaacagcaagaacacccuguaccugcagaugaacucccuccgcgcggaggacaccgcccuguacuacugcgccaaggacaugcgggaguacgagugcgaggagugggccagcgacuacuacgacuucggccgcgacuaccccugccaggacccccgcgggguggucggcaccuucgacaucuggggccaggggacgauggugaccguguccagc

SEQ ID NO: 9813 - RNA, 435 nt, Artificial Sequence
  derived and/or modified sequence opt1 from anti-HIV_cap256-048-071661_VR-Chain
caggugcagcuggucgagagcggcgggggcguggugcagcccgggcgcucccucggccugagcugcgaggucuccggguucaccuucagcgacuacuucauguccuggauccggcaggccccgggcaagggccuggaguggguggccgugaucagccacgacgggaacaacaaguacuaccccgacuccguccagggccgcuucaccaucagccgggagaacuccaagaacacgcucuaccugcagaugaacagccugaagcccgaggacaccgcgguguacuucugcgccaaggaccucgggggcgaguccgagguggaggagugggccagcgacuacuacgacuucgggcgcgacauccccggcccggacccccggggcgucguggggacccuggacaucuggggccacgggaccauggugacggucuccagc

SEQ ID NO: 9814 - RNA, 432 nt, Artificial Sequence
  derived and/or modified sequence opt1 from anti-HIV_cap256-048-071360_VR-Chain
caggugcagcuggucgagagcggcgggggcguggugcagcccgggcgcucccuccggcugagcugcgccgccuccggcuucacccugaccaacuacgcgauggacuggguccgccaggccccggggaagggccucgaguggguggccgugaucagcuccgacggcagcaacaagaacuacgaggacuccgucaaggggcgguucacgaucagccgcgacaacuccaagaacacccuguaccugcagaugagcucccuccggcccgaggacaccgccguguacuacugcgccaaggacgugggcgacaacaagagcgacgagugggcgaccgacuacuacgacuucuccaucgccuaccccguccccgacccgcgcgccguggugggggccuucgaccuguggggccaggggacgauggucaccgugagcucc

SEQ ID NO: 9815 - RNA, 432 nt, Artificial Sequence
  derived and/or modified sequence opt1 from anti-HIV_cap256-048-070955_VR-Chain
gaggugcagcuggucgagagcggcgggggccucgugcagcccgggggcuccgugcgccugagcugcgccgucuccggguucaccuucagcuccuacuggaugagcugggugcggcaggccccgggcaagggccuggaguggguggcggucaucuccgacagcggguccaacaaguacuacgccgacagcgugaagggccgcuucaccaucucccgggacaacagcaagaacacgcucuaccugcagaugaacucccugcgcgccgaggacaccgccguguacuucugcgccaaggaccucgggggccgggagaccgaggagugggcgagcgacuacuacgacuucgggcgcgacuuccccggccaggaccagcgggccgucgccggcguguucgacaugugggggcagggcaccauggugacggucuccagc

SEQ ID NO: 9816 - RNA, 432 nt, Artificial Sequence
  derived and/or modified sequence opt1 from anti-HIV_cap256-048-070061_VR-Chain
gaggugcagcugcucgagagcggcgggggccugguccagcccgggggcucccugcgccucagcugcgccgccuccggguucaccuucagcuccuacgcgaugcacugggugcggcaggccccgggcaagggccuggaguggguggccgucaccagcuacgacggguccaacaaguacuacgccgacagcgugaagggccgcuucacgaucucccgggacaacagcaagaacacccuguacaugcagaugaacucccuccgcgccgaggacaccgcgguguacuacugcgccaaggaccagggggagagcgagaaggaggagugggccuccgacuacuacgacuucggccgggacuaccccgggcgcgacccccggcgcgucguggccaccuucgcgaucuggggccagggcacgauggugaccgucagcucc

SEQ ID NO: 9817 - RNA, 432 nt, Artificial Sequence
  derived and/or modified sequence opt1 from anti-HIV_cap256-048-069669_VR-Chain
caggugcagcuggucgagagcggcgggggcguggugcagcccgggcgcucccuccggcugagcugcgccgucuccggcuucaccuucagcaaguucccgaugcacugggugcgccaggcccccgggaagggccuggaguggguggcggucaucuccuacgacggcaacaagaaguacuacguggacagcgccaaggggcgguucaccaucucccgcgacaacagccggaagacgcucuaccugcagaugaccggccugcgccccgaggacaccgccguguacuacugcgccaaggaccucgggggcggggagugcgagaccugggccuccgacuacuacgacuucggcaaggacuaccccugccuggacccgcgggacgucgugggcacguucgacaucugggggcagggcacccuggugaccgucagcucc

SEQ ID NO: 9818 - RNA, 432 nt, Artificial Sequence
  derived and/or modified sequence opt1 from anti-HIV_cap256-048-069205_VR-Chain
caggugcagcuggucgagagcggcgggggcguggugcagcccgggcgcucccuccggcugagcugcgccgccuccggcuucaccuucagcuccuacgcgaugcacuggguccgccaggccccggggaagggccuggagugggugguggucaucagcaacgacggcaacaacaaguacuacgccgacuccgugaaggggcgguucaccaucagccgcgacaacuccaagaacacgguguaccuccagaugaacagccugcgggccgaggacaccgccgucuacuacugcgcgaaggacgugggcgacaccaagaaggacgagugggccaccgacuacuacgaccuguccaucgccuaccccgugcaggacccccaggccgucgugggggcguucgacaucuggggccaggggacgauggugaccgucagcucc

SEQ ID NO: 9819 - RNA, 432 nt, Artificial Sequence
  derived and/or modified sequence opt1 from anti-HIV_cap256-048-068882_VR-Chain
caggugcagcuggucgagagcggcgggggcguggugcagcccgggcgcucccuccggcugagcugcgccgccuccggcuucaccuucagcaccuacgcgaugcacuggguccgccaggccccggggaagggccuggaguggguggcccucaucuccuacgacggcacggacaaguacuacgccgacagcgugaaggggcgguucaccaucucccgcgacaacagcaagaacaccgucuaccugcagaugaacucccugcggggcguggacaccgccguguacuacugcgcgaaggaccucgggggcggggaggucgaggagugggccacggacuacuacgacuggagcaccgccuaccccguggagcacccccgcgccguggucggcguguucgacaucuggggccaggggaccaaggugaccgucuccagc

SEQ ID NO: 9820 - RNA, 432 nt, Artificial Sequence
  derived and/or modified sequence opt1 from anti-HIV_cap256-048-067764_VR-Chain
gaggugcagcugguccagagcggcgggggccucgugaagcccgggggcucccugcgccugagcugcgccgccuccggguucaccuucagcaccuacuccaugaacugggugcggcaggcgccgggcaagggccucgagugggucgccgugaucagcuccgacgggagcuccaagaacuacgccgacagcgugaagggccgcuucacgaucucccgggacaacagcaagaacaccgucucccugcagaugaacagccugcgccccgaggacaccgccguguacuacugcgccaaggacgugggggcgaacaaggacgacgagugggccaccgacuacuacgaccucuccaucgccuaccccguccccgacccgcgggccguggugggcgcguucgacaucugggggcagggcacgauggucaccgugagcucc

SEQ ID NO: 9821 - RNA, 432 nt, Artificial Sequence
  derived and/or modified sequence opt1 from anti-HIV_cap256-048-066845_VR-Chain
caggugcugcucgucgagagcggcgggggcguggugcagcccgggggcucccugacccugagcugcgccgccuccggguucaccuucagcaacuacggcaugcacuggguccgccaggcgccgggcaaggggcucgaguggguggccuucauccgguacgacggcaacaacaaguacuacgccgacuccgugaaggggcgcuucacgaucagccgggacaacuccaaggacacccuguaccugcagauggacggccuccgccccgaggacaccgcccuguacuacugcgccaaggaccugggggagcgggagugcgaggagugggcgagcaacuacuacgacuucggccgcgacuaccccugccaggacccccggggcgucguggggaccuucgacaucuggggccaggggacgauggugaccgucuccagc

SEQ ID NO: 9822 - RNA, 432 nt, Artificial Sequence
  derived and/or modified sequence opt1 from anti-HIV_cap256-048-065226_VR-Chain
gaggugcagcuggucgagagcggcgggggccucgugaagcccgggggcucccugcgccugagcugcguggccuccggguucaccuucagcaacuacggcaugcacuggguccggcaggccccgggcaaggggcucguguggguggcgggcaucuccuucgccgggaccaacaaguacuacgccgccagcgucaagggccgcuucacgaucucccgggacaacagcaagaacacccuguaccugcagaugaacucccuccgcgccgaggacaccgcgcuguacuacugcgccaaggacaugcgggaguacgagugcgaggagugggccagcgacuacuacgacuucgggcgcgacuaccccugccaggacccccggggcguggugggcaccuucgacaucugggggcagggcacgauggucaccguguccagc

SEQ ID NO: 9823 - RNA, 432 nt, Artificial Sequence
  derived and/or modified sequence opt1 from anti-HIV_cap256-048-063717_VR-Chain
caggugcagcuggucgagagcggcgggggcguggugcagcccgggcgcucccuccggcugagcugcgccgccuccggcuucagcuucuccaaccacgcgauggacuggguccgccaggccccggggaagggccuggaguggguggccgugaucagcuccgacggcagcgacaagaucuacgccgaguccgucaaggggcgguucaccaucagccgcgacaacuccaagaacacccucuaccugcagaugaacagccugcggguggaggacacggccguguacuucugcgcgaaggaccucggcgccaacaaggacgacgagugggccaccgacuacuacgaccuguccaucgccuaccccguccccgacccccgcgcgguggugggggccuucgacaucuggggccaggggaccauggucagcguguccagc

SEQ ID NO: 9824 - RNA, 432 nt, Artificial Sequence
  derived and/or modified sequence opt1 from anti-HIV_cap256-048-063150_VR-Chain
gaggugcagcuggucgagagcggcgggggcguggugcagcccgggcgcucccuccggcugagcugcgccgccuccggcuucaccuucagcuccuacgcgaugcacuggguccgccaggccccggggaagggccuggaguggguggcccacauccgguacgacggcagcaacaaguacuacaucgacuccgugcaggggcgcuucaccaucagccgggacaaccccaagaacacgcucuaccugcagaugaacucccugcgcaccgaggacaccgccgucuacuacugcgccaaggaccucggcgggggcgagguggaggagugggcgaccgacuacuacgacuggagcaucgccuaccccguggagcacccccgggccgucguggggguguucgacaucuggggccagggcacgaaggucaccguguccagc

SEQ ID NO: 9825 - RNA, 432 nt, Artificial Sequence
  derived and/or modified sequence opt1 from anti-HIV_cap256-048-062431_VR-Chain
caggugcagcuggucgagagcggcgggggcguggugcagcccgggcgcucccuccggcugagcugcgccgccuccggcuucaccuucagcaacuucgcgauggacuggguccgccaggccccggggaagggccuggaguggguggccgugaucuccagcgacggcuccaagaagaacuacggggacagcgucaagggccgguucaccaucucccgcgacaacagcaagaacacgcuguuccugcagaugaacucccugcggcccgaggacaccgcccucuacuacugcgccaaggaccucgggggcuacaagagcgacgagugggcgaccgacuacuacgaccuguccaucgccuaccccgugcaggacccccgcccguggcucgagcugcuguacaucugggggcagggcgccauggugaccgucagcucc

SEQ ID NO: 9826 - RNA, 432 nt, Artificial Sequence
  derived and/or modified sequence opt1 from anti-HIV_cap256-048-060745_VR-Chain
caggugcagcuggucgagagcggcggguccguggugcagcccggccgcagccuccggcugaccugcaccgccuccggguucacguucagccacuacgccauggacuggguccgccaggcgccgggcaaggggcuggaguggguggccgugaucuccagcgacgccaccaacaagaacuacgccgacuccgucaagggccgguucaccaucagccgcgacaacuccaagaacaccguguaccuccagauggacagccugcgggccgaggacacggcgguguacuacugcgccaaggacgucggcgacuacaaggacgacgagugggccaccgacuacuacgacuucuccaucgccuaccccgugcccgacccccgcgcgguggucggggccuucgacuucuggggccaggggaccauggugaccgugagcucc

SEQ ID NO: 9827 - RNA, 432 nt, Artificial Sequence
  derived and/or modified sequence opt1 from anti-HIV_cap256-048-060420_VR-Chain
caggugcagcuggucgagagcggcgggggcguggugcagcccgggcgcucccuccggcugagcugcgccgccuccggcuucaccuucagcuccuacgggauggcguggguccgccaggccccgggcaagggccuggagugggugaccgugaucagcuucgccggggucaagaaguacuacgccgacuccgugaagggccgguucacgaucagccgcgacaacuccaaggggacccucuaccugcagaugaacagccugcgggccgaggacaccgcgguguacuacugcgccaaggacgucggcgacaccaagaaggacgagugggccacggacuacuacgaccucuccaucgccuaccccgugcaggacccccaggcgguggucggggccuucgacaucuggggccagggcaccauggugaccgugagcucc

SEQ ID NO: 9828 - RNA, 435 nt, Artificial Sequence
  derived and/or modified sequence opt1 from anti-HIV_cap256-048-060014_VR-Chain
caggugcagcuggucgagagcggcgggggcguggugcagcccgggcgcucccugcggcugagcugcgccgccuccggcuucaccuucagcaacuacgggaugcacuggguccgccaggcgccgggcaagggccuggaguggguggcccucaucucccacgacgggagcaacaagaacuucgccgacuccgugaagggccgguucaccaucagccgcgacaacuccaagaacacgcuguaccugcagaugaacagccuccggaccgaggacaccgccaucuacuacugcgccaaggaccucgggggcgaguccgagaucgaggaguggcccagcgacuacuacgacuucgggcgcgacuaccccguccccgacccgcggggcguggugggcaccuucgacuucugggggcagggcacgauggucaccguguccagc

SEQ ID NO: 9829 - RNA, 432 nt, Artificial Sequence
  derived and/or modified sequence opt1 from anti-HIV_cap256-048-059747_VR-Chain
caggugcagcuggucgagagcggcgggggcguggugcagcccgggcgcucccuccggcugagcugcgccgccuccggcuucaccuucacccacuacgcgauggacuggguccgccaggccccggggaagggccuggaguggguggccgugaucagcuccgacggcagcuccaaggacuacgccgacagcgucaaggggcgguucacgaucucccgcgacaacagcaagaacacccucucccugcagaugaacagccugcggcccgaggacaccgccguguacuacugcgcgaaggaccucggcgccuccaaggacgacgagugggccaccgacuacuacgaccugagcaucgccuaccccgugcacgacccccgcgcggucgucgggggcuucgacaucugggggcagggcacgauggugaccguguccagc

SEQ ID NO: 9830 - RNA, 432 nt, Artificial Sequence
  derived and/or modified sequence opt1 from anti-HIV_cap256-048-058393_VR-Chain
caggugcagcuggucgagagcggcgggggcguggugcagcccgggggcucccuccgccugagcugcgccgccuccggguucaccuucaacaccuacggcaugcacuggguccggcaggcgccgggcaaggggcuggagugggugacguucauccgcuacgacggcagcaacgaguacuacgccgacuccgugaaggggcgguucaccaucagccgcgacaacuccaagaacacccucuaccugcagaugaacagccuguccgucgaggacaccgccguguacuacugcgccaaggaccucggcaagaacaaggacgacgagugggccacggacuacuacgacaucagcaucgcguaccccgugcccgacccccgggccgucguggggguguucgacaucuggggccagggcaccgucgugaccguguccagc

SEQ ID NO: 9831 - RNA, 432 nt, Artificial Sequence
  derived and/or modified sequence opt1 from anti-HIV_cap256-048-058159_VR-Chain
caggugcagcuggucgagagcggcgggggcguggugcagcccgggcgcucccuccggcugagcugcgccgccuccggcuucaccuucagcuccuacccgaugcacuggguccgccaggcgcccgggaagggccuggaguggguggccgugaucagcuucgccggcaccaacaaguacuacgcccacuccgucaaggggcgguucacgaucagccgcgacaacuccaagaacacccucuaccugcagaugaacagccugcgggccgaggacaccgcgcucuacuacugcgcccgcgaccugcgggaguccgagugcgaggagugggccagcgacuacuacgacuucggccgcgaguaccccugccaggacccccgcgggguggugggcaccuucgacaucugggggcggggcacgauggucaccguguccagc

SEQ ID NO: 9832 - RNA, 432 nt, Artificial Sequence
  derived and/or modified sequence opt1 from anti-HIV_cap256-048-057127_VR-Chain
gacguguaccuggucgagagcggcgggggccucgugcagcccgggggcucccugcgccugagcugcguggccuccgggaucaccuucagcuccuacggcaugcacuggguccggcaggccccgggcaaggggcucgagugggcggccuucauccgcuacgacggccggaacaaguacuacgccgacagcgugaaggggcgcuucaccaucucccgggacaacagcaagaacacgcugucccugcagaugaacaaccuccgcgccgaggacaccgccguguacuacugcgcgaaggaggucggcgacaacaaggacgacgagugggccagcgacuacuacgaccuguccaucgccuaccccgugcaggacccccgggccguggucgggggcuacgacaucuggggccaggggaccauggugaccgugagcucc

SEQ ID NO: 9833 - RNA, 432 nt, Artificial Sequence
  derived and/or modified sequence opt1 from anti-HIV_cap256-048-056251_VR-Chain
gaggugcagcuggucgagagcggcgggggccucgugcagcccgggcggucccugcggcugagcugcgccggcuccggguucaccuucagcaacuucggcuuccacugggugcgccaggccccgggcaaggggcucgagugggucgcggccaucuccuucgccggcuacaacaaguacuacgccgacagcgugaaggggcgguucaccaucucccgcgagaacagcaacaacaugcuguaccugcagauguccagccuccgggccgaggacacggcgguguacuacugcgccaaggaccugcgcgaguccgagugcgaggagugggccagcgacuacuacgacuucggcaaggacuaccccugccaggacccccgcggggucgugggcaccuucgacguguggggccacgggucccuggucaccgugagcucc

SEQ ID NO: 9834 - RNA, 432 nt, Artificial Sequence
  derived and/or modified sequence opt1 from anti-HIV_cap256-048-055421_VR-Chain
caggugcagcuggucgagagcggcgggggcguggugcagcccgcccgcucccuccggcugagcugcgccgcguccggguucaucuucagcaccuacggcaugcacuggguccgccaggccccggggaagggccuggaguggguggccgugaucuccagcgacggcuccagcaaggacuacgccgacuccgucaaggggcgguucaccaucagccgcgacaacuccaagaacacgcucagccugcagaugaacucccugcggcccgaggacaccgccguguacuacugcgcgaaggaccucggcgccagcaaggacgacgagugggccaccgacuacuacgacuucuccaucgccuaccccgugcaggacccccgcgcggucgugggggccuucgacaucuggggccaggggaccauggugacggucagcucc

SEQ ID NO: 9835 - RNA, 432 nt, Artificial Sequence
  derived and/or modified sequence opt1 from anti-HIV_cap256-048-054989_VR-Chain
caggugcagcuggucgagagcggcgggggcguggugcagcccgggggcucccugcgccugagcugcgccgccuccggguucaccuucagcaccaacggcaugcacuggguccggcaggcgccgggcaaggggcuggaguggguggccuucauccgcuacgacggcuccaacaaguacuacgccgacagcgugaaggggcgguucacgaucucccgcgacaacagcaagaacaccgucuaccuccagaugaacucccugcggggcguggacaccgccguguacuacugcgccaaggaccucgggggcggcgaggucgaggagugggcgaccgacuacuacgacuggagcaucgccuaccccguggagcacccccgcgccguggucgggguguucgacaucuggggccaggggacgaaggugaccgucuccagc

SEQ ID NO: 9836 - RNA, 435 nt, Artificial Sequence
  derived and/or modified sequence opt1 from anti-HIV_cap256-048-054759_VR-Chain
caggugcagcuggucgagagcggcgggggcguggugcagcccgggcgcucccuccggcugagcugcgccgccuccggcuucagcuucuccaagaacgggaugcacuggguccgccaggcgccgggcaagggccuggaguggguggccuucguggccuucgacgagagcgacaaguacuacgccgacuccgucaaggggcgguucaccaucagccgcgacaacuccaagaacacccucagccugcagaugaacucccugcggguggaggacacggccguguacuacugcgcgaaggaggucggcgagaacaaggacgacgagugggccgcccccgacuacuacgacuucagcaucgccuaccccgugcaggacccccgcgcgguggucgggggcuucgacaucugggggcagggcaccauggugaccguguccagc

SEQ ID NO: 9837 - RNA, 432 nt, Artificial Sequence
  derived and/or modified sequence opt1 from anti-HIV_cap256-048-052573_VR-Chain
caggugaagcuggucgagagcggcgggggcguggugcagcccgggcgcucccuccggcugagcugcgccgccuccggcuucagcuucuccaacuacgcgauggacuggguccgccaggccccggggaagggccuggaguggguggccguggucagcuccgacggcagcaacaagaacuacgccgacuccgugaaggggcgguucaccaucagccgcgacaacuccaagaacaccguguaccuccagaugaacagccugcgggccgaggacacggcggucuacuacugcgccaaggaccugggcgccaacaaggacgacgagugggccaccgacuacuacgacugguccaucgcguaccccgugcacgacccccgcgccguggucgggguguucgacaucuggggccaggggacccucgugaccgucagcucc

SEQ ID NO: 9838 - RNA, 432 nt, Artificial Sequence
  derived and/or modified sequence opt1 from anti-HIV_cap256-048-051477_VR-Chain
caggagcagcugguggagagcggcgggggcgucgugcagcccgggcgcucccuccggcugagcugcgccgccuccggcuucaccuucagcaacuacgcgaugcacugggugcgccaggccccggggaagggccuggagugggucgccgccaugucccacgacggcagcgacaaguacuacgccgacuccgugaaggggcgguucaccaucagccgcgacaacuccaagaacacgcucuacaugcagaugaacagccugcgggcggaggacaccgccguguacuacugcgccaaggaccagggcgaguccgagaaggaggagugggccagcgacuacuacgaccuguccaucgcguaccccauccaggacccccgcgccauggucggggccuucgacaucuggggccaggggaccauggugaccgugagcucc

SEQ ID NO: 9839 - RNA, 432 nt, Artificial Sequence
  derived and/or modified sequence opt1 from anti-HIV_cap256-048-051299_VR-Chain
caggugcagcuggucgagagcggcgggggcguggugcagcccgggcgcucccuccggcugagcugcgccgccuccggcuucaccuucagcaccuucgggaugcacuggguccgccaggcgccgggcaagggccuggaguggguggcccucaucucccacgacgggaacaacaaguacuacgccgacagccugaagggccgguucacgaucucccgcgagaacagcaagaacacccuguuccuccagaugaacucccugcgggccgaggacaccagcguguacuacugcgccaaggaccugggggacuccgagugcgaggagugggcgagcgacuacuacgacuucggcaaggacuaccccugccuccacccccgcggggucgugggcaccuucgacuucuggggccacgggacgauggugaccgucuccagc

SEQ ID NO: 9840 - RNA, 432 nt, Artificial Sequence
  derived and/or modified sequence opt1 from anti-HIV_cap256-048-050815_VR-Chain
caggugcagcuggucgagagcggcgggggcguggugcagcccgggggcucccuccgccugagcugcgucguguccggguucaccuucagcuccuacggcaugcacugggugcggcaggccccgggcaaggggcuggagugggucagcuucauccgcuucgacggcaacuacgaguacuacguggacuccgugaaggggcgguucaccaucagccgcgacaacuccaagaacacggucuaccuccagauggacagccugcgggccgaggacaccgcgguguacuacugcgccaaggacgugggcgacuacaaggacgacgagugggccaccgacuacuacgacuucuccaucgccuaccccguccccgacccccgcgccguggugggggcguucgacuucuggggccagggcaccauggucacggugagcucc

SEQ ID NO: 9841 - RNA, 432 nt, Artificial Sequence
  derived and/or modified sequence opt1 from anti-HIV_cap256-048-049884_VR-Chain
caggugcagcuggucgagagcggcgggggcguggugcagcccgggcgcucccuccggcugagcugcgccgccuccggcuucagcuucaacaccuacgcgaugcacuggguccgccaggccccggggaagggccuggaguggauggcccucaucuccuacgacggcagcaacaaguacuacguggacuccgugaaggggcgguucaccaucagccgcgacaacuccaagaacacgcuguaccugcagaugaacagccuccgggccgaggacaccgccgucuacuacugcgcgaaggaccugggcgggaacaaggacgacgagugggccaccgacuacuacgaccuguccaucgccuaccccgugcaggacccccgcguggucgugggcaucuucgacaucugggggcagggcaccauggugacggucagcucc

SEQ ID NO: 9842 - RNA, 432 nt, Artificial Sequence
  derived and/or modified sequence opt1 from anti-HIV_cap256-048-049170_VR-Chain
caggugcagcuggucgagagcggcgggggcguggugcagcccgggcgcucccuccggcugagcugcgccgccuccggcuucaucuucagcuccuacgggaugcacuggguccgccaggcgccgggcaagggccuggaguggguggccgugaucagcggggacggcaccaagaaggacuucgccgacuccgucaaggggcgguucaccaucagcaaggacaacuccaagaacauggugagccuccagaugaacucccugcgcgccgaggacgccgcgguguacuacugcgccaaggaccugggcgagagcgacaacgaggaguggcccuccgacuacuacgacuucgggcgggacuucacgggccagaacccccgcgccgucgugggcaccuucgaccucugggggcagggcaccauggugaccgucagcucc

SEQ ID NO: 9843 - RNA, 435 nt, Artificial Sequence
  derived and/or modified sequence opt1 from anti-HIV_cap256-048-048531_VR-Chain
caggugcagcuggucgagagcggcgggggcguggugcagcccgggcgcucccugcggcugagcugcgccgccuccggcuucaccuucagcuccuacgggcugcacuggguccgccaggcgccgggcaagggccucgaguggguggccuucaucagcuacgacgggaacaacaagcacuacguggacuccgucaagggccgguucaccaucagccgcgacaacuccaagaacacgcuguaccugcagaugaacagccuccgggccgaggacaccgccguguacuacugcgccaaggaccucgggggcgaguccgagaucgaggagugggcgaccgacuacuacgacuucagcaucgccuaccccgugaaggagucccgcggggucgugggcaucuucgacauguggggccaggggaccauggugacggucagcucc

SEQ ID NO: 9844 - RNA, 432 nt, Artificial Sequence
  derived and/or modified sequence opt1 from anti-HIV_cap256-048-048259_VR-Chain
caggugcagcuggucgagagcggcgggggcguggugcagcccgggcgcucccuccggcugagcugcgccgccuccggcuucaccuucagcacgugcgcgaugcacuggguccgccaggccccggggaagggccuggaguggguggccgugaucuccuacgacggcagcaacaaguacuacgucgacuccgugaaggggcgguucaccaucagccgcgacaacuccaagaacacccucuaccugcagaugaacagccugcgggccgaggacaccgccguguacuacugcgcgaaggaggucgacaucaacaaggaggacgagugggccuccgacuacuacgacuucagcaucgccuaccccgugcaggacccccgcgccguggucggcggguucgacaucuggggccaggggaccauggugacgguguccagc

SEQ ID NO: 9845 - RNA, 432 nt, Artificial Sequence
  derived and/or modified sequence opt1 from anti-HIV_cap256-048-047313_VR-Chain
caggugcagcuggucgagagcggcgggggcguggugcagcccgggcgcucccuccggcugagcugcgccgccuccggcuucaccuucagcaccuucgggaugcacuggguccgccaggcgccgggcaagggccuggaguggguggccgugaucucccacgacgggaacaacaaguacuacgccgacagcgucaagggccgguucacgaucucccgcgacaacagcaagaacaccguguaccuccagaugaacucccugcgggccgaggacaccgccguguacuacugcgcgaaggaccugggggccaacaaggacgacgagugggccaccgacuacuacgaccucagcgucgccuaccccgugcccgacccccgcgcgguggucggcgccuucgacgugugggggcagggcacgauggugaccgucuccagc

SEQ ID NO: 9846 - RNA, 432 nt, Artificial Sequence
  derived and/or modified sequence opt1 from anti-HIV_cap256-048-046596_VR-Chain
caggugcagcuggucgagagcggcgggggcguggugcagcccgggggcucccuccgccugagcugcgccgccuccggguucaccuucagcuccuacggcaugcacuggguccggcaggcgccgggcaaggggcuggaguggguggccuucaugcgcuucgacggcagcaaccgguacuacggggacuccgugaagggccgcuucaccaucagccgggacaacuccaagaacacgcucuaccugcagaugaacagccugcgcaccgaggacgccgcccucuacuacugcgccaaggacaugcgggaguucgagugcgaggagugggcguccgacuacuacgacuucgggcgcgacuaccccugccaggacccccggggcgucgugggcaucuucgacaucugggggcagggcaccauggugaccgucagcucc

SEQ ID NO: 9847 - RNA, 432 nt, Artificial Sequence
  derived and/or modified sequence opt1 from anti-HIV_cap256-048-044781_VR-Chain
caggugcagcuggucgagagcggcgggggcguggugcagcccgggcgcucccuccggcugagcugcgccgccuccggcuucaccuucaccagcuacgcgauccacuggguccgccaggccccggggaagggccuggaguggguggccgugaucuccuacgacggcagcaagaagaacuacgccgacuccgucaaggggcgguucacgaucagccgcgacaacuccaagaacacccucuacgugcagaugaacagccugcgggccgaggacaccgcgguguacuacugcgccaaggaggucggcgaggacaaggacgacgagugggccuccgacuacuacgaccugagcaucgccuaccccgugcacgacccccgcgcgguggucgggggcuucgacaucugggggcagggcaccauggugacgguguccagc

SEQ ID NO: 9848 - RNA, 432 nt, Artificial Sequence
  derived and/or modified sequence opt1 from anti-HIV_cap256-048-042599_VR-Chain
caggugcagcuggucgagagcggcgggggcguggugcagcccgggcgcucccuccggcugagcugcgccgccuccggcuucaccuucagcaacuacgggaugcacuggguccgccagaccccgggcaagggccuggaguggguggcggugaucuccuacgacgggagcaacaaguucuacgccgacuccgucaagggccgguucacgaucagccgcgacaacuccaagaacacccucuaccugcagaugagcucccugcgggccgacgacaccgccguguacuacugcgccaaggaggugggggaggacaaggacgacgagugggcgagcgacuacuacgaccucuccaucgccuaccccguccacgacccccgcgccguggugggcggguucgacaucuggggccagggcaccauggucacggugagcucc

SEQ ID NO: 9849 - RNA, 432 nt, Artificial Sequence
  derived and/or modified sequence opt1 from anti-HIV_cap256-048-041276_VR-Chain
caggugcagcuggucgagagcggcgggggcguggugcagcccgggcgcucccuccggcugagcugcgccgccucccgcuucaccuucagcuccuacgcgaugcacuggguccggcaggccccgggcaaggggcuggaguggguggccaucaucagcuacgacggcuccaacaaguacuacgccgacagcgugaagggccgcuucaccaucucccgggacaacagcaagaacacgcuguuccugcagaugaacucccugcgcgccgaggacaccgcgcucuacuacugcgccaaggaccucgggggcuacaagagcgacgagugggccaccgacuacuacgaccuguccaucgccuaccccauccaggacccccgggcggucgugggggccuucgacaucuggggccaggggaccauggugacggucagcucc

SEQ ID NO: 9850 - RNA, 432 nt, Artificial Sequence
  derived and/or modified sequence opt1 from anti-HIV_cap256-048-040200_VR-Chain
caggugcagcuggucgagagcggcgggggcguggugcagcccgggcgcucccugcggcugagcugcgucgccuccggcuucaccuucagcuccuucgggaugcacugggugcgccaggccccgggcaagggccuggaguggguggcggucaucagccacgacgggcacaacaaguacuacgccgacucccucaagggccgguucaccgugagccgcgagaacuccaagaacacgcuguuccugcagaugaacagccuccgggccgaggacaccuccguguacuacugcgccaaggaccucgggggcggggagugcgaggagugggccagcgacuacuacgacuucggccgcgacuaccccugccugacgccccggggcgucguggggaccuucgacaucuggggccacgggaccaccgugaccgucuccagc

SEQ ID NO: 9851 - RNA, 432 nt, Artificial Sequence
  derived and/or modified sequence opt1 from anti-HIV_cap256-048-039061_VR-Chain
gaggugcagcugcucggcagcgggggcgggcugguccagcccggcgggucccugcgccugaccugcgccgugagcggcuucaccuucuccagcuucgccauguccugggugcggcaggcgccgggcaaggggcucgagugggucgcccugaucagcuacgacggcacggacaaguacuacgccgacuccgugaaggggcgcuucaccaucagccgggacaacuccaagaacacccucuaccugcagaugaacagccugcgcguggaggacaccgccaucuaccacugcgccaaggaccucggcgggacgaaguccgacgagugggcgaccgacuacuacgaccugagcaucgccuaccccauccaggaccccggcgccgucgugggcguguucgacaucugggggcagggcaccauggucaccguguccagc

SEQ ID NO: 9852 - RNA, 432 nt, Artificial Sequence
  derived and/or modified sequence opt1 from anti-HIV_cap256-048-038515_VR-Chain
caggugcagcuggucgagagcggcgggggcguggugcagcccgggcgcucccuccggcugagcugcgccgccuccggcuucaccuucagcaccuacgcgaugcacuggguccgccaggccccggggaagggccuggagugggugguggucaucuccuacgacggcagcaacaaguacuacgccgacuccgugaaggggcgguucacgaucagccgcgacaacuccaagaacacccucuuccugcagaugaacagccugcgggccgaggacaccgcccucuacuacugcgcgaaggacgugggcgaguacaaguccgacgagugggccaccgacuacuacgaccugagcaucgccuaccccauccaggacccccgcgccauggucggggcguucgacaucuggggccaggggacgauggugaccguguccagc

SEQ ID NO: 9853 - RNA, 432 nt, Artificial Sequence
  derived and/or modified sequence opt1 from anti-HIV_cap256-048-038255_VR-Chain
caggugcagcuggucgagagcggcgggggcguggugcagcccgggcgcucccuccggcugagcugcgccgccuccggcuucacccugagcuccuacgcgaugcacuggguccgccaggccccggggaagggccucgaguggguggccgugaucagcuacgacggcuccaacaaguacuacgccgacagcgucaaggggcgguucaccaucucccgcgacaacagcaagaacgcccuguaccugcagaugaacucccuccgggcggaggacacggcccuguacuacugcgccaaggaccugcgcgaguacgagugcgaggagugggccagcgacuacuacgacuucggccgggacuaccccugccaggacccccgcgggguggugggcaccuucgacaucugggggcagggcaccauggucaccguguccagc

SEQ ID NO: 9854 - RNA, 432 nt, Artificial Sequence
  derived and/or modified sequence opt1 from anti-HIV_cap256-048-038177_VR-Chain
caggugcagcuggucgagagcggcgggggcguggugcagcccgggcgcucccugcggcugagcugcgccgccuccggcuucaccuucaacaccuacgggauccacuggguccgccaggcgccgggcaagggccuggaguggguggcccucaucagcuacgacgggacggacaaguacuacgccgacuccgugaagggccgguucaccaucagccgcgacaacuccaagaacacccuguaccugcagaugaacagccuccgggucgaggacaccgccaucuaccacugcgccaaggaccucgggggcacgaaguccgacgagugggcgaccgacuacuacgaccugagcaucgccuaccccauccaggaccccggggccguggugggcgucuucgacaucuggggccaggggaccauggugaccguguccagc

SEQ ID NO: 9855 - RNA, 432 nt, Artificial Sequence
  derived and/or modified sequence opt1 from anti-HIV_cap256-048-035513_VR-Chain
caggugcagcuggucgagagcggcgggggcguggugcagcccgggcgcucccuccggcugagcugcgccgccuccggcuucaccuucagcuccuacgggauggcguggguccgccaggccccgggcaagggccuggagugggugaccgugaucagcuucgccggggucaagaaguacuacgccgacuccgugaagggccgguucacgaucagccgcgacaacuccaaggggacccucuaccugcagauggacggccugcggcccgaggacaccgcccucuacuacugcgcgaaggaccugggggagcgcgagugcgaggagugggccagcgacuacuacgacuucggccgggacuuccccugccaggacccccgcggcguggucgggaccuucgacaucuggggccaggggacgauggugaccguguccagc

SEQ ID NO: 9856 - RNA, 432 nt, Artificial Sequence
  derived and/or modified sequence opt1 from anti-HIV_cap256-048-034112_VR-Chain
cagaugcagcugguggagagcggcgggggcgucgugcagcccgggcgcucccugcggcugagcugcgccgccuccggcuucaccuucaacagcuacgcgaugcacugggugcgccaggccccggggaagggccuggagugggucgccgugaucuccuacgacggcagcaacaaguacuacgccgacuccgugaaggggcgguucaccaucagccgcgacaacuccaagaacacggucuaccuccagaugaacagccugcggggcguggacaccgccguguacuacugcgcgaaggaccucgggggcggggaggucgaggagugggccaccgacuacuacgacugguccaucgccuaccccguggagcacccccgcgccguggucggcguguucgacaucuggggccaggggaccaaggugacggucagcucc

SEQ ID NO: 9857 - RNA, 432 nt, Artificial Sequence
  derived and/or modified sequence opt1 from anti-HIV_cap256-048-033983_VR-Chain
caggugcagcuggucgagagcggcgggggcguggugcagcccggggagucccuccgccugagcugcgccgccuccggcuucacccugagcucccacgggauccacuggguccggcaggcgccgggcaagggccucgaguggguggccuucaucagcuccgacgggagcaacaagaacuacggcgacuccgugaaggggcgcuucaccaucagccgggacaacuccaagaacacgcuguuccugcagaugaacagccuccgcgccgaggacaccgcccuguacuacugcgccaaggacgucggcgaguacaaguccgacgagugggcgaccgacuacuacgaccugagcaucgccuaccccauccaggacccccgggccauggugggggccuucgacaucuggggccagggcaccauggugacggucuccagc

SEQ ID NO: 9858 - RNA, 432 nt, Artificial Sequence
  derived and/or modified sequence opt1 from anti-HIV_cap256-048-032688_VR-Chain
caggugcagcuggucgagagcggcgggggcguggugcagcccgggcgcucccuccggcugagcugcgccgccuccggcuucaucuucaacagcuacgggaugcacuggguccgccaggcgccgggcaagggccuggaguggguggccgugguccacggggacggcgggaacaaguacuacgccgacuccgugaagggccgguucaccaucagccgcgacaacuccaagaacacccucuaccuggagaugaacagccugcgggccgaggacacggccgaguacuacugcgcgaaggaccucggggaguccgacaaggaggaguggcccagcgacuacuacgacuucggccgcgacuucaccggccaggugccccgggccgucgugggggccuucgacaucuggggccaggggaccauggugaccgucuccagc

SEQ ID NO: 9859 - RNA, 432 nt, Artificial Sequence
  derived and/or modified sequence opt1 from anti-HIV_cap256-048-031092_VR-Chain
caggugcagcuggucgagagcggcgggggcguggugcagcccgggcgcucccuccggcugagcugcgccgccuccggcuucagcuucuacaacuucgcgauggacuggguccgccaggccccggggaagggccuggaguggguggccgugaucuccagcgacggcgggaacaagaacuacgucgacuccgugaagggccgguucaccaucagccgcgacaacuccaagaacacccucuaccugcagaugaacagccugcgggccgaggacacggccguguacuacugcgcgaaggaccucgggggcaccaaggacgacgagugggccaccgacuacuacgacaucuccaucgccuaccccguccaggacccccgcgccguggcgggggccuucgacaucuggggccagggcaccauggugacggucagcucc

SEQ ID NO: 9860 - RNA, 435 nt, Artificial Sequence
  derived and/or modified sequence opt1 from anti-HIV_cap256-048-030464_VR-Chain
caggugcagcuggucgagagcggcgggggccucgugaagcccgggggcucccugcgccugagcugcgaggccuccggguucagcuucaccaacuacuacauguccuggauccggcaggccccgggcaagggccucgaguggguggcggucaucagcuucaacgggcgcaacaaguacuacgccgacuucgugaagggccgguucaccaucucccgcgacaacagcaagaacacgcugucccugcagaugaacagccuccggguggaggacaccgccgucuacuacugcgccaaggaggugggggagaacaaggacgacgagugggccgcgcccgacuacuacgacuucuccaucgccuaccccgugcaggacccccgcgccgucgugggcggguucgacaucuggggccagggcaccauggugaccgucagcucc

SEQ ID NO: 9861 - RNA, 432 nt, Artificial Sequence
  derived and/or modified sequence opt1 from anti-HIV_cap256-048-030289_VR-Chain
caggugcagcuggucgagagcggcgggggcguggugcagcccgggggcucccuccgccugagcugcgccgccuccggguucaccuucagcuccuacggcaugcacuggguccggcaggcgccgggcaaggggcuggaguggguggccuucauccgcuacgacggcagcaacaaguacuacgccgacuccgugaaggggcgguucaccaucagccgcgacaacuccaagaacacggucuaccuccagaugaacagccugcggguggaggacaccgccguguacuacugcgccaaggaccugggcgcgaacaaggacgacgagugggccaccgacuacuacgaccucuccgucgccuaccccgugcccgacccccgcgccguggucggggcguucgacguguggggccagggcaccauggugacggucagcucc

SEQ ID NO: 9862 - RNA, 432 nt, Artificial Sequence
  derived and/or modified sequence opt1 from anti-HIV_cap256-048-030261_VR-Chain
caggugcagcuggucgagagcggcgggggcguggugcagcccgggggcucccuccgccugagcugcgccgccuccggguucaccuucagcaccuucggcaugcacuggguccggcaggcgccgggcaaggggcuggaguggguggccgugaucucccacgacggcagcaacaaguacuacgccgacucccucaaggggcgcuucacgaucagccgggagaacuccaagaacacccuguaccugcagaugaacagccuccgccuggaggacaccgccgucuaccacugcgccaaggaccugggcggguccaagagcgacgagugggcgaccgacuacuacgaccucuccguggccuaccccgugcaggacccccgggccgucgugggcguguucgacaucuggggccaggggacgauggucaccgugagcucc

SEQ ID NO: 9863 - RNA, 432 nt, Artificial Sequence
  derived and/or modified sequence opt1 from anti-HIV_cap256-048-029362_VR-Chain
caggugcagcuggucgagagcggcgggggcguggugcagcccgggcgcucccuccggcugagcugcgccgccucccaguucaccuucagcuccuacggcaugcacuggguccgccaggcgccggggaagggccuggaguggguggccggcaucagcuucgccgggaccaacaaguacuacgccgacuccgugaagggccgguucacgaucagccgcgacaacuccaagaacacccucuaccugcagaugaacagccugcggaccgaggacgccgcgcucuacuacugcgccaaggacaugcgcgaguucgagugcgaggagugggccuccgacuacuacgacuucgggcgggacuaccccugccaggacccccgcggcgucguggggaucuucgacaucuggggccagggcaccauggugacggucagcucc

SEQ ID NO: 9864 - RNA, 432 nt, Artificial Sequence
  derived and/or modified sequence opt1 from anti-HIV_cap256-048-027638_VR-Chain
caggugcagcuggucgagagcggcgggggcguggugcagcccgggcgcucccuccggcugagcugcgucgccuccggcuucaucuucagcuccuacgggauccacugggugcgccaggccccgggcaagggccuggaguggguggcggucaucagcggggacggcaccaacaaguacugcgccgacuccgugaaggggcgguucaccaucagccgcgacaacuccaagaacacgguguuccuccagaugaacagccugcgggccgaggacaccgccgucuucuacugcgccaaggaccugggcgaguccgacaaggaggaguggcccagcgacuacuacgacuucgggcgcgacuucaccggccaggugccccgggcgguggucggcgccuucgacaucugggggcagggcaccauggugacgguguccagc

SEQ ID NO: 9865 - RNA, 432 nt, Artificial Sequence
  derived and/or modified sequence opt1 from anti-HIV_cap256-048-027613_VR-Chain
gugcagcagcuggucgagagcggcggggacguggugcagcccggcaccucccuccgccugagcugcgaggccuccgggcugauccucagcggcuacgggcugcacuggguccggcaggccccgggcaagggcauggaguggguggcggugaucuccuacgacgggagcaacaaguacuacgccgacuccgucaagggccgcuucaccaucagccgggacaacuccaagaacacgguguaccugcagaugaacagccuccgcgggguggacaccgccgucuacuacugcgccaaggaccugggcgggggcgagguggaggagugggccaccgacuacuacgacugguccaccgcguaccccguggagcacccccgggccgucgugggcguguucgacaucugggggcagggcacgaaggucaccgugagcucc

SEQ ID NO: 9866 - RNA, 432 nt, Artificial Sequence
  derived and/or modified sequence opt1 from anti-HIV_cap256-048-026627_VR-Chain
caggugcagcugcucggcagcgggggcggguccguccagcccggcgggagccugcgccugaccugcgccguguccggcuucaccuucagcuccuucgccaugagcugggugcggcaggcgccgggcaaggggcucgagugggucgccuucaucuccagcgacggcacgaacaagaacuacggggacuccgugaagggccgcuucaccaucagccgggacaacuccaagaacacccuguuccugcagaugaacagccuccgcgccgaggacaccgcccuguacuacugcgccaaggaccucgggggcuacaaguccgacgagugggcgacggacuacuacgaccugagcaucgccuaccccauccaggacccccgggccguggucggcgccuucgacaucugggggcagggcaccauggugaccguguccagc

SEQ ID NO: 9867 - RNA, 432 nt, Artificial Sequence
  derived and/or modified sequence opt1 from anti-HIV_cap256-048-026239_VR-Chain
cagaugcagcugguggagagcggcgggggcgucgugcagcccgggcgcucccuccggcugagcugcgccgccuccggcuucaccuucaacagcuacgcgaugcacugggugcgccaggccccggggaagggccuggagugggucgccgugaucuccuacgacggcagcaacaaguacuacgccgacuccgugaaggggcgguucaccaucagccgcgacaacuccaagaacacgcucuaccugcagaugaacagccugcggaccgaggacgccgcgcucuacuacugcgccaaggacaugcgcgaguucgagugcgaggagugggccuccgacuacuacgacuucggccgggacuaccccugccaggacccccgcggggucgugggcaucuucgacaucugggggcagggcaccauggugaccgucagcucc

SEQ ID NO: 9868 - RNA, 432 nt, Artificial Sequence
  derived and/or modified sequence opt1 from anti-HIV_cap256-048-025518_VR-Chain
caggugcagcuggucgagagcggcgggggcguggugcagcccgggcgcucccuccggcugagcugcgccgucuccggcuucaccuucagccagcacgccaugcacugggugcgccaggcgccggggaagggccuggagugggugacccucaucuccaacgacggcacggagaaguucuacgccgacagcgucaaggggcgguucaccaucucccgcgacaacagcaagaacacccuguaccugcagaugaacucccucagcguggaggacaccgccguguacuacugcgccaaggaccugggcaagaacaaggacgacgagugggccacggacuacuacgacaucuccaucgcguaccccguccccgacccccgggccguggugggggucuucgacaucuggggccaggggaccguggugaccgucagcucc

SEQ ID NO: 9869 - RNA, 432 nt, Artificial Sequence
  derived and/or modified sequence opt1 from anti-HIV_cap256-048-024854_VR-Chain
caggugcagcuggucgagagcggcgggggcguggugcagcccgggcgcucccugacccugagcugcgccgccuccggcuucaccuucaacaacuacgacaugcacuggguccggcaggcgccggggaagggccuggaguggguggccuucacgcgcuacgacggcagcaaccaguacuacgccgacuccgugaccgggcgguucaccaucagccgcgacaacuccaagaacaccgucuaccuccagaugaacagccugcggggcguggacacggccguguacuacugcgccaaggaccucgggggcggggaggucgaggagugggcgaccgacuacuacgacugguccaucgccuaccccguggagcacccccgcgccguggucggcguguucgacaucuggggccaggggaccaaggugaccgucagcucc

SEQ ID NO: 9870 - RNA, 432 nt, Artificial Sequence
  derived and/or modified sequence opt1 from anti-HIV_cap256-048-024537_VR-Chain
caggugcagcuggucgagagcggcggggccguggugcagcccggccgcucccuccggcugagcugcgucgccuccggguucaccuucagcuccuacgcgaugcacugggugcgccaggccccgggcaaggggcuggacuggguggcccucaucagcuacgacggcuccaacaaguacuucgccgacagcgucaagggccgguucgccaucucccgcgacaacagcaagaacacccuguaccugcagaugaacucccuccggcccgaggacacggcgguguacuacugcgccaaggaccucgggggcggggagugcgagaccugggccagcgacuacuacgacuucggcaaggacuaccccugccuggacccccgcgacguggucgggaccuucgacaucugggugcagggcacccuggugacggucuccagc

SEQ ID NO: 9871 - RNA, 432 nt, Artificial Sequence
  derived and/or modified sequence opt1 from anti-HIV_cap256-048-021781_VR-Chain
caggugcaccuggucgagagcggcgggggccucgugaagcccgggggcucccugcgccugagcugcgaggccuccggguucagcuucuccaacuacgccauggacugggugcggcaggcgccgggcaagggccucgagugggucgccuucgugagcuccgacgggagcaacaagaacuacgccgacuccgugaagggccgcuucaccaucagccgggacaacuccaagaacaccgucuaccugcagaugaacagccugcgcguggaggacacggccguguacuacugcgccaaggaccucggggcgaacaaggacgacgagugggccaccgacuacuacgaccuguccgucgccuaccccgugcccgacccccgggccguggucggcgcguucgacgugugggggcagggcaccauggugaccgucagcucc

SEQ ID NO: 9872 - RNA, 432 nt, Artificial Sequence
  derived and/or modified sequence opt1 from anti-HIV_cap256-048-021758_VR-Chain
caggugcagcuggucgagagcggcgggggcguggugcagcccgggcgcucccuccggcugagcugcgccgccuccggcuucaccuucagccgcuacgggaugcacuggguccggcaggcgccgggcaagggccuggaguggguggccgugaucuccuacgacgggagcaaggaguacuacgccgacuccgucaagggccgcuucaccaucagccgggacaacuccaaggacacgcucuaccugcagaugagcucccugcgcguggaggacaccgccguguacuacugcgccaaggacgucggggcgaacaaggacgacgagugggccaccgacuacuacgaccucagcaucgccuaccccgugcccgacccccgggccguggucggcgcguucgacaucugggggcagggcaccauggugacgguguccagc

SEQ ID NO: 9873 - RNA, 432 nt, Artificial Sequence
  derived and/or modified sequence opt1 from anti-HIV_cap256-048-020988_VR-Chain
caggugcagcuggucgagagcggcgggggcguggugcagcccgggcgcucccuccggcugagcugcgaggccuccgccuucaccuucagcuccuacggcaugcacuggguccgccaggcgccggggaagggccuggagugggugaccuucaucagcuacuccggcaacaacaaguacuacgccgacagcgugaaggggcgguucacggucucccgcgacaacagcaagaacacccucuaccugcagaugaacucccugaccagcgaggacaccgccguguacuacugcgccaaggaccucggcggguccaagacggacgaguggggcaccgacuacuacgaguucuggaacgccuaccccgugcaggacccccgggucguggugggggcguucgacaucuggggccacggcaccauggucaccgugagcucc

SEQ ID NO: 9874 - RNA, 435 nt, Artificial Sequence
  derived and/or modified sequence opt1 from anti-HIV_cap256-048-020663_VR-Chain
caggugcagcuggucgagagcggcgggggcguggugcagcccgggaugucccuccgccugagcugcgccgccuccggcuucaccuucagcaacuucgggaugcacuggguccggcaggcgccgggcaagggccuggaguggguggccgugaucucccacgacgggaacaacaaguacuaccccgacagcguccagggccgcuucaccaucucccgggagaacagcaagaacacgcucuaccugcagaugaacucccugaagcccgaggacaccgccguguacuucugcgccaaggaccucgggggcgagagcgagguggaggagugggccuccgacuacuacgacuucgggcgcgacauccccggcccggacccccggggcgucguggggacccuggacaucuggggccacgggaccauggugacggucagcucc

SEQ ID NO: 9875 - RNA, 432 nt, Artificial Sequence
  derived and/or modified sequence opt1 from anti-HIV_cap256-048-020590_VR-Chain
caggugcagcuggucgagagcggcgggggcguggugcagcccgggggcgucccgcgccuggccugcgccgcguccggguucaccuucagcuccuacgccaugcacugggugcggcaggcccccggcaagggccuggagugggugaccgucaucagcuacgacggguccaacaaguacuacgccgacagcgugaagggccgcuucacgaucucccgggacaacagcaagaacacccuguaccuccagaugaacucccugcgcgccgaggacaccgcgguguacuacugcgccaaggaccucgggggcaccaaggacgacgagugggccacggacuacuacgacaucagcaucgccuaccccguccaggacccccgggcgguggccggggccuucgacaucuggggccagggcaccauggugaccgucuccagc

SEQ ID NO: 9876 - RNA, 432 nt, Artificial Sequence
  derived and/or modified sequence opt1 from anti-HIV_cap256-048-019765_VR-Chain
caggugcagcuggucgagagcggcgggggcguggugcagcccgggcgcucccuccggcugagcugcgccgccuccggcuucaucuucaccaacuacgcgauggacuggguccgccaggccccggggaagggccuggaguggguggccgugaucagcuccgacggcagcaacaagaacuacgccgacuccgucaaggggcgguucaccaucagccgcgacaacuccaagaacacggugagccuccagaugaacucccugcgggccgaggacaccgcgguguacuacugcgccaaggaccugggcgacagcaagaaggacgagugggccaccgacuacuacgaccucuccaucgccuaccccguccccgacccccgcgcgguggugggggccuucgacaucuggggccaggggaccauggucacggugagcucc

SEQ ID NO: 9877 - RNA, 432 nt, Artificial Sequence
  derived and/or modified sequence opt1 from anti-HIV_cap256-048-019254_VR-Chain
caggugcagcuggucgagagcggcgggggcguggugcagcccgggcgcucccuccggcugagcugcgccgccuccggcuucaccagcuccaccuacgcgaugcacuggguccgccaggccccggggaagggccuggaguggguggcccucaucagcuacgacggcacggacaaguacuacgccgacuccgugaaggggcgguucaccaucagccgcgacaacuccaagaacacccuguaccugcagaugaacagccuccgggucgaggacaccgccguguaccacugcgcgaaggaccugggcgggaacaagcccgacgagugggccacggacuacuacgaccuguccaucgccuaccccgugcaggacccccgcgccgucgugggcguguucgacaucugggggcagggcaccaucaucaccgucagcucc

SEQ ID NO: 9878 - RNA, 432 nt, Artificial Sequence
  derived and/or modified sequence opt1 from anti-HIV_cap256-048-018073_VR-Chain
caggugcagcuggucgagagcggcgggggcguggugcagcccgggcggucccuccggcugagcugcgccgccuccggcuucagccuguccagcuacgcgauggacuggguccgccaggccccggggaagggccucgaguggguggccgugaucuccagcgacggcaccaacaaguacuacgccgacuccgucaaggggcgguucaccaucacgcgcgacaacagcaagaacacccuguaccugcagaugaacucccuccggguggaggacaccgcccuguacuacugcgcgaaggacaugggcgagagcgagaaggaggagugggccuccgacuacuacgacuucgggcgcgacauccccggccaggacccccgcggggaggugggcagcuucgacaucuggggccaggggaccauggucacgguguccagc

SEQ ID NO: 9879 - RNA, 432 nt, Artificial Sequence
  derived and/or modified sequence opt1 from anti-HIV_cap256-048-016775_VR-Chain
gaggugcagcuggucgaguucggcgggggccucgugcagcccgggcggagccugcggcuguccugcgccgccagcgcguucaccuucucccacuacggcauccacugggugcgccaggccccggggaagggccucgagugggucgccgugaucagccacgacggcuccaccaaggacuacgccgacagcgugaaggggcgguucacgaucucccgcgacaacagcaagaacaccauguaccugcagaugaacucccugcgggccgaggacaccgcggucuacuacugcgcccgcgaccucggcgagagcgagaccgaggagugggccacggacuacuacgacuucuccaucgccuaccccgugcagaacccccgcggggugaucggcguccuggacaucugggggcugggcaccauggugaccgugagcucc

SEQ ID NO: 9880 - RNA, 432 nt, Artificial Sequence
  derived and/or modified sequence opt1 from anti-HIV_cap256-048-016069_VR-Chain
caggugcagcuggucgagagcggcgggggcguggugcagcccgggcgcucccuccggcugagcugcgccgccuccggcuucaccuucagcaaguacgcgaugcacuggguccgccaggccccggggaagggccuggaguggguggccuucguggccuucgacgaguccgccaaguucuacgcggacagcgucaagggccgguucaccaucucccgcgacaacagcaagaacacgcucucccugcagaugaacagccugcgggccgaggacaccgccguguacuacugcgccaaggaggugggggagaacaaggacgacgagugggcguccgacuacuacgaccucagcaucgccuaccccguccacgacccccgcgccguggugggcggguucgacgucuggggccaggggaccauggugaccguguccagc

SEQ ID NO: 9881 - RNA, 432 nt, Artificial Sequence
  derived and/or modified sequence opt1 from anti-HIV_cap256-048-015867_VR-Chain
caggugcagcuggucgagagcggcgggggcguggugcagcccgggcgcucccuccggcugagcugcuccgccagcggcuucuccuucaccaacuacgccauggacuggguccgccaggcgccggggaagggccuggaguggguggccgugaucagcuccgacggcagcaacaagaacuacgccgacuccgucaaggggcgguucaccaucagccgcgacaacuccaagaacacccucuuccugcagaugaacagccugcggcccgaggacacggccguguacuucugcgccaaggaccucggcgcgaacaaggacgacgagugggccaccgacuacuacgaccuguccaucgccuaccccgugcacgacccccgcgccgucguggggaucuucgaccuguggggccaggggaccauggugacggucagcucc

SEQ ID NO: 9882 - RNA, 432 nt, Artificial Sequence
  derived and/or modified sequence opt1 from anti-HIV_cap256-048-015673_VR-Chain
caggugcaccuggucgagagcggcgggggcguggugcagcccgggcgcucccuccggcugagcugcgccgccuccggcuucaccuucagcaacuucgcgaugggguggguccgccaggccccgggcaagggccuggaguggguggccuucaucuccagcgacgggaccaacaagaacuacggcgacuccgugaaggggcgguucacgaucagccgcgacaacuccaagaacacccucuuccugcagaugaacagccugcgggccgaggacaccgcccucuacuacugcgcgaaggaccugggcggguacaaguccgacgagugggccaccgacuacuacgaccugagcaucgccuaccccauccaggacccccgcgccgucgugggcgcguucgacaucuggggccaggggacgauggugaccgucuccagc

SEQ ID NO: 9883 - RNA, 432 nt, Artificial Sequence
  derived and/or modified sequence opt1 from anti-HIV_cap256-048-015156_VR-Chain
caggugcagcuggucgagagcggcgggggcguggugcagcccgggcgcucccuccggcugagcugcgccgccuccggcuucaccuucagcgucuacgcgcugcacugggugcgccagaccccggggaagggccucgaguggguggcccugaucuccuacgacggcacgaacaaguacuacgucgacagcgugaaggggcgguucaccaucucccgcgacaacagcaagaacacccuguaccuccagaugaacucccugaccgccgaggacacggccguguacuacugcgccaaggaccugggcgggagcaagaacgacgagugggcgaccgacuacuacgaccucuccaucgccuaccccauccaggacccccgggccgucgccggcaucuucgacgugugggggcgcggcaccauggugaccgucagcucc

SEQ ID NO: 9884 - RNA, 432 nt, Artificial Sequence
  derived and/or modified sequence opt1 from anti-HIV_cap256-048-014521_VR-Chain
gaggugcagcuggucgagagcggcgggggccucgugcagcccgggcgcucccugcggcugagcugcgccgccuccggcuucaucuucagcuccuacgggauccacugggugcgccagggcccgggcaaggggcucgagugggucgcgcugaucagcggcgacgggaacaacaaguacuacgccgacuccgugcagggccgguucagcaucucccgcgacaacagcaagaacacccuguaccuccagaugaacucccugcgggccgaggacaccgccguguacuacugcgccaaggaccugggggagagcgacaaggaggaguggcccuccgacuacuacgacuucggccgcgacuucacgggccaggacccccgggcggucguggggguguucgacaucuggggccaggggaccaccgucaucgugagcucc

SEQ ID NO: 9885 - RNA, 432 nt, Artificial Sequence
  derived and/or modified sequence opt1 from anti-HIV_cap256-048-014475_VR-Chain
caggugcagcuggucgagagcggcgggggcguggugcagcccgggcgcucccuccggcugagcugcgccgccuccggcuucaccuucaacaccuucgggaugcacuggguccgccaggcgccgggcaagggccuggaguggguggccgugaucagccacgacgggaacaacaaguacuacgccgacucccucaagggccgguucacgaucagccgcgagaacuccaagaacacccuguuccugcagaugaacagccuccgggccgaggacaccuccgucuacuacugcgccaaggaccuggggcacggcgagugcgaggagugggcgagcgacuacuacgacuucgggaaggacuaccccugccugacgccccgcggcguggccggcaccuucgacaucugggggcacggcaccaccgugaccgucuccagc

SEQ ID NO: 9886 - RNA, 432 nt, Artificial Sequence
  derived and/or modified sequence opt1 from anti-HIV_cap256-048-013798_VR-Chain
caggugcagcuggucgagagcggcgggggcguggugcagcccgggcgcucccuccggcugagcugcgccgccuccggcuucaccuucaacaacuacgggacccacuggguccgccaggcgccgggcaagggccuggaguggguggccgugaucagcgacuccgggagcaacaaguacuacgccgacuccgucaagggccgguucacgaucagccgcgacaacuccaagaacacccucuaccugcagaugaacagccugcgggccgaggacaccgccguguacuucugcgcgaaggaccucgggggccgcgagaccgaggagugggccuccgacuacuacgacuucgggcgggacuuccccggccaggaccagcgcgccguggccggcgucuucgacaugugggggcagggcacgauggugaccgugagcucc

SEQ ID NO: 9887 - RNA, 432 nt, Artificial Sequence
  derived and/or modified sequence opt1 from anti-HIV_cap256-048-013271_VR-Chain
gaggugcagcuggucgagagcggcgggggcguggugcgccccgggggcucccuccggcugagcugcgccgccuccggguucaucuucagcuccuacggcauccacuggguccgccaggcgccgggcaaggggcuggaguggguggccgugaucagcggcgacgggaccaacaaguacugcgccgacuccgucaagggccgguucaccaucagccgcgacaacuccaagaacacgcucuaccugcagaucaacagccugcggguggaggacaccgccguguacuacugcgccaaggaccucgggaagaacaaggacgacgagugggcgaccgacuacuacgaccuguccaucgccuaccccguccccgacccccgcgccguggugggcgucuucgacaucuggggccaggggaccguggugacggucagcucc

SEQ ID NO: 9888 - RNA, 432 nt, Artificial Sequence
  derived and/or modified sequence opt1 from anti-HIV_cap256-048-013180_VR-Chain
caggugcagcuggucgagagcggcgggggcguggugcagcccgggcgcucccuccggcugagcugcgccgccuccggcuucaccuucagcaagaacgggaugcacuggguccgccaggcgccgggcaagggccuggaguggguggccuucguggccuucgacggguccgacaaguacuacgccgacagcgucaagggccgguucgugaucucccgcgacaacagcaagaacacccucucccugcagaugaacagccugcgggccgaggacacggcgguguacuacugcgccaaggaggucggggaggacaaggacgacgagugggccuccgacuacuacgaccucagcaucgccuaccccgugcacgacccccgcgcgguggucggcggguucgacaucuggggccagggcaccauggugaccguguccagc

SEQ ID NO: 9889 - RNA, 432 nt, Artificial Sequence
  derived and/or modified sequence opt1 from anti-HIV_cap256-048-012148_VR-Chain
caggugcagcuggucgagagcggcgggggcguggugcagcccgggcgcucccuccggcugagcugcgccgccuccggcuucaccuucacccacuacgcgauggacuggguccgccaggccccggggaagggccuggaguggguggccgugaucagcuccgacggcagcuccaagaacuacgccgacagcguccgggggcgcuucacgaucucccgggacaacagcaagaacacccucucccugcugaugaacggccuccgccccgaggacaccgccguguacuacugcgcgaaggacgugggggacgucaagaacgacgagugggccaccgacuacuacgaccugagcaucgccuaccccgugcaggacccccgggccguggucggcgcguucgacuucugggggcagggcacgauggugaccguguccgcc

SEQ ID NO: 9890 - RNA, 432 nt, Artificial Sequence
  derived and/or modified sequence opt1 from anti-HIV_cap256-048-011870_VR-Chain
caggugcagcuggucgagagcggcgggggcguggugcagcccgggcgcucccuccggcugagcugcgccgucuccggcuucaccuucagcuucuacgggaugcacugggugcgccaggccccgggcaagggccuggaguggguggcggucaucuccuacgacgggaacaacaaguacuacguggacagcgugaagggccgguucaucaucucccgcgacaacagcaagaacacccucuaccugcagaugaacucccugcgggucgaggacacggccguguacuacugcgcccgcgaccucggggagcgggagaacgaggagugggccaccgacuacuacgacuucagcaucgccuaccccaucgagggcccccgcgggguggucggcguguucgacaucuggggccgggggaccauggugaccgucuccagc

SEQ ID NO: 9891 - RNA, 432 nt, Artificial Sequence
  derived and/or modified sequence opt1 from anti-HIV_cap256-048-011530_VR-Chain
caggugcaccuggucgagagcggcgggggcguggugcagcccgggcgcucccuccggcugagcugcgccgccuccggcuucagcuuccgcaacuacgcgauggacuggguccggcaggccccggggaagggccuggaguggguggccgugaucuccagcgacggcuccgacaagcacuacgccgacagcguccgcgggcgguucaccaucucccgcgacaacagcaagaacacccucuaccugcagaugaacucccugcggguggaggacacggccguguacuacugcgcgaaggaccucggcgccaacaagaacgacgagugggccaccgacuacuacgacuucagcaucgccuaccccguccccgacccccgcgcgguggugggggccuucgacaucuggggccaggggaccauggucaccguguccagc

SEQ ID NO: 9892 - RNA, 432 nt, Artificial Sequence
  derived and/or modified sequence opt1 from anti-HIV_cap256-048-010968_VR-Chain
caggugcagcuggucgagagcggcgggggcguggugcagcccgggcgcucccuccggcugagcugcgccgccuccggcuucaucuucagcuccuacgggaugcacuggguccgccaggcgccgggcaagggccuggaguggguggcccucaucagcggggacggcuccaacaaguacuacgccgacagcgugaaggggcgguucaccaucucccgcgacaacagcaagaacacccuguaccugcagaugaacucccuccgggccgaggacagcgcccuguacuucugcgcgaaggaccugggcgaguccgacaaggaggaguggcccagcgacuacuacgacuucgggcgcgacuucacgggccaggucccccgggccguggugggcaucuucgacaugugggggcagggcaccauggucaccguguccagc

SEQ ID NO: 9893 - RNA, 426 nt, Artificial Sequence
  derived and/or modified sequence opt1 from anti-HIV_cap256-048-010224_VR-Chain
gaggugcaccuggucgagagcggcggggaccucgugcagcccggcgggucccugcgccugagcugcguggucuccgaguucaccuucagcuccuacggcaugcacugggugcggcaggccccggggaagggccucgaguggguggccuucauccgcuacgacggcagcaacaaguacuacgcggacuccgucaaggggcgguucaccaucagccgcgacaacuccaagguguaccuggagaugaacagccugcgggccgaggacacggccguguacuacugcgccaaggaggucggcgagaacaaggacgacgagugggccuccgacuacuacgaccucagcaucgcguaccccauccacgacccccgcgccguggucgggggcuucgacaucugggggcagggcaccauggugaccguguccagc

SEQ ID NO: 9894 - RNA, 432 nt, Artificial Sequence
  derived and/or modified sequence opt1 from anti-HIV_cap256-048-009749_VR-Chain
caggugcagcuggucgagagcggcgggggcguggugcagcccgggcgcucccuccggcugagcugcggcgccuccggguucaccuucagcuccuacgccaugcacuggguccgccaggcgccgggccggggccuggaguggguggccuucaccagcuccgacgggagcaacaagaacuacggcgacuccgugaaggggcgcuucacgaucagccgggacaacuccaagaacacccucuuccugcagaugaacagccugcgcgccgaggacaccgcccucuacuacugcgccaaggacgucggcgaguacaaguccgacgagugggcgaccgacuacuacgaccugagcaucgccuaccccauccaggacccccgggccauggugggggccuucgacaucuggggccagggcacgauggugaccgucuccagc

SEQ ID NO: 9895 - RNA, 432 nt, Artificial Sequence
  derived and/or modified sequence opt1 from anti-HIV_cap256-048-009623_VR-Chain
caggugcagcuggucgagagcggcgggggcguggugcagcccgggcgcucccuccggcugagcugcgccgccuccggcuucagcuucuccaaguacgggaugcacuggguccgccaggcgccgggcaagggccuggaguggguggccuucguggccuucgacgagggggacaaguacuacgucgacagcgugaagggccgguucaccaucucccgcgacaacagcaagaacacccucucccugcagaugaacagccugcgggccgaggacacggccguguacuacugcgcgaaggaggucggggagaacaaggacgacgagugggccuccgacuacuacgaccucagcaucgccuaccccauccacgacccccgcgccguggugggcggguucgacaucuggggccagggcaccauggucaccguguccagc

SEQ ID NO: 9896 - RNA, 432 nt, Artificial Sequence
  derived and/or modified sequence opt1 from anti-HIV_cap256-048-008234_VR-Chain
caggugcagcuggucgagagcggcgggggcguggugcagcccgggcgcucccuccggcugagcugcgccgccuccggcuucaccuucaccaacuacgcgauggacuggguccgccaggccccggggaagggccuggaguggguggccgugaucagcuccgacggcagcaacaagaacuacgccgacuccgucaaggggcgguucacgaucagccgcgacaacuccaagaacaccguguaccuccagaugagcucccugcggcccgaggacaccgccguguacuacugcgcgaaggacgucggcgacaccaagagcgacgagugggccacggacuacuacgaccuguccaucgccuaccccgugcaggacccccgcgccguggucggggcguucgacaucuggggccaggggaccauggugaccgugagcucc

SEQ ID NO: 9897 - RNA, 432 nt, Artificial Sequence
  derived and/or modified sequence opt1 from anti-HIV_cap256-048-008149_VR-Chain
caggugcagcuggucgagagcggcgggggcguggugcagcccgggcgcucccuccggcugagcugcgccgccuccggcuucaccuucagcgucuacaccaugcacugggugcgccaggcgccggggaagggccuggaguggguggccgucaucuccuacgacggccggaacaaguacuacgccgacagcgugaaggggcgcuucacgaucucccgggacaacagcaagaacaccguguaccuccagaugaacucccugcgcgucgaggacaccgccguguacuacugcgccaaggaccugggcgcgaacaaggacgacgagugggccaccgacuacuacgaccucagcguggccuaccccguccccgacccccgggccguggugggggcguucgacgucuggggccaggggacgauggugaccguguccagc

SEQ ID NO: 9898 - RNA, 432 nt, Artificial Sequence
  derived and/or modified sequence opt1 from anti-HIV_cap256-048-007301_VR-Chain
caggugcagcuggucgagagcggcgggggcguggugcagcccgggcgcucccuccggcugagcugcgccgccuccggcuucagcuucaacuacuacgcgauggacuggguccgccaggccccggggaagggccuggaguggguggccgugaucuccagcgacggccggaacaagaacuacgccgacuccgucaaggggcgcuucaccaucagccgggacaacuccaagaacacccucuaccugcagaugaacagccuguccguggaggacacggccguguacuacugcgcgaaggaccucggcaagaacaaggacgacgagugggccaccgacuacuacgacaucagcaucgccuaccccguccccgacccccgcgccguggugggggucuucgacaucuggggccaggggaccguggugaccgucuccagc

SEQ ID NO: 9899 - RNA, 432 nt, Artificial Sequence
  derived and/or modified sequence opt1 from anti-HIV_cap256-048-007174_VR-Chain
caggugcagcuggucgagagcggcgggggcguggugcagcccgggcgcucccuccggcugagcugcgccgccuccggcuucaccuucaacagcuacgggauggccuggguccgccaggccccgggcaagggccuggaguggguggcccucaucuccuacgacgggagcaacaaguacuacgccgacuccgugcggggccgcuucaccaucagccgggacaacuccaaggacacgcuguaccugcagauggacgggcuccgccccgaggacaccgcccuguacuacugcgcgaaggaccugggcgagagcgagugcgaggagugggccuccgacuacuacgacuucgggcgggacuaccccugccucgcgccccgcggcgucccgggcaccuucgacaucugggggcagggcaccauggugacggugagcucc

SEQ ID NO: 9900 - RNA, 432 nt, Artificial Sequence
  derived and/or modified sequence opt1 from anti-HIV_cap256-048-007079_VR-Chain
caggugcagcuggccgagagcggcgggggcgucgugcagcccgggcgcucccuccggcugagcugcgccgcguccggcuucaccuucagcaucuacgggaugcacugggugcgccaggccccgggcaagggccuggagugggucgccuucauccucuccgacgggaccgacaaguacagcgccgacuccgugaagggccgguucacgaucagccgcgacaacuccaagaacacccuguaccugcagaugaacagccuccgggccgaggacaccgcgguguacuacugcgccaaggaccuggggaaggccaaggacgacgagugggccaccgacuacuacgacuucuccaucgcguaccccguccacgacccccgcggcguggccgggaucuucgacaucuggggccagggcacgauggugaccgucagcucc

SEQ ID NO: 9901 - RNA, 432 nt, Artificial Sequence
  derived and/or modified sequence opt1 from anti-HIV_cap256-048-007033_VR-Chain
caggugcagcuggucgagagcggcgggggcguggugcagcccgggcgcucccuccggcugagcugcgccgccuccggcuucaccuucagcaacuucggguuccacuggguccgccaggcgccgggcaagggccuggaguggguggccgccaucuccuucgccgggaacaacaaguacuacgccgacagcgugaagggccgguucaccaucucccgcgagaacagcaagaacauccucuaccugcagaugaacucccugcgcggggaggacacggcggucuacuacugcgccaaggaccuccgggaguucgagugcgaggagugggccagcgacuacuacgacuucggccgggacuaccccugccaggacccccgcgggguggugggcaccuucgacgucuggggccacgggucccuggugaccgugagcucc

SEQ ID NO: 9902 - RNA, 432 nt, Artificial Sequence
  derived and/or modified sequence opt1 from anti-HIV_cap256-048-006128_VR-Chain
caggugcagcuggucgagagcggcgggggcguggugcagcccgggcgcucccuccggcugagcugcgccgccuccggcuucaccuucagcaccuacgcgaugcacuggguccgccaggccccggggaagggccuggaguggguggcccucaucuccuacgacggcacggacaaguacuacgccgacagcgugaaggggcgguucaccaucucccgcgacaacagcaagaacacccuguaccugcagaugaacucccuccgggucgaggacaccgccguguaccacugcgcgaaggaccugggcgggagcaaguccgacgagugggccacggacuacuacgacuggagcaucgccuaccccgugcacgacccccgcgccgucgugggcguguucgacaucugggggcagggcacccuggucaccguguccagc

SEQ ID NO: 9903 - RNA, 432 nt, Artificial Sequence
  derived and/or modified sequence opt1 from anti-HIV_cap256-048-005999_VR-Chain
caggugcagcuggucgagagcggcgggggcguggugcagcccgggcgcucccuccggcugagcugcgccgccuccggcuucaccuucacccacuucgcgauggacuggguccgccaggccccggggaagggccuggaguggguggccgugaucagcuccgacggcagcuccaagaacuacgccgacagcgucaaggggcgguucacgaucucccgcgacaacagcaagaacaccgugucccuccagaugaacagccugcggcccgaggacaccgccguguacuacugcgcgaaggaccugggcgccaacaaggacgacgagugggccaccgacuacuacgaccucuccaucgccuaccccguccccgacccgcgcgcgguggugggggccuucgacaucuggggccaggggacgauggucaccgugagcucc

SEQ ID NO: 9904 - RNA, 432 nt, Artificial Sequence
  derived and/or modified sequence opt1 from anti-HIV_cap256-048-005394_VR-Chain
caggugcagcuggucgagagcggcgggggcguggugcagcccgggcgcucccuccggcugagcugcgccgccucccaguucaccuucagcuccuacggcaugcacuggguccgccaggcgccggggaagggccuggaguggguggccgccaucagcuucgccggcaccaacaaguacuacgccgacuccgugaaggggcgguucacgaucagccgcgacaacuccaagaacgcgcucuaccugcagaugaacagccugcgggccgaggacaccgcccucuacuacugcgccaaggaccugcgcgaguucgagugcgaggagugggcguccgacuacuacgacuucggccgggacuaccccugccaggacccccgcggggucgugggcaccuucgacaucugggggcagggcaccauggugacggucagcucc

SEQ ID NO: 9905 - RNA, 432 nt, Artificial Sequence
  derived and/or modified sequence opt1 from anti-HIV_cap256-048-004226_VR-Chain
caggugcagcuggucgagagcggcgggggcguggugcagcccgggcgcucccuccggcugagcugcgccgccuccggcuucaccuucaacaagcacgggaugcacuggguccgccaggcgccgggcaagggccuggaguggguggccuucguggccuucgacgggagcgacaaguacuacgccgacuccgucaagggccgguucaccaucagccgcgacaacuccaagaacacgcucagccugcagaugaacaaccugcgggccgaggacaccgcgguguacuacugcgccaaggaggugggggacaacaaggacgacgagugggccuccgacuacuacgaccucagcaucgccuaccccguccaggacccccgcgcgguggugggcggguacgacaucuggggccagggcaccauggucaccguguccagc

SEQ ID NO: 9906 - RNA, 432 nt, Artificial Sequence
  derived and/or modified sequence opt1 from anti-HIV_cap256-048-004097_VR-Chain
caggugcagcuggucgagagcggcgggggcguggugcagcccgggcgcucccuccggcugagcugcgccgccuccggcuucaccuucagcgcguacaccguccacugggugcgccaggccccggggcggggccuggaguggguguccgucaucagcuacgacgaccgcaacaaguacuacgcccacuccgugaagggccgguucacgaucagccgcgacaacuccaagaacacccucuaccugcagaugaacagccugcggcgcgaggacaccgccguguacuacugcgccaaggaccucggggcgaacaaggacgacgagugggccaccgacuacuacgaccuguccaucgccuaccccguccccgacccccgggccguggugggcgcguucgacaucugggggcagggcacgauggucaccgugagcucc

SEQ ID NO: 9907 - RNA, 432 nt, Artificial Sequence
  derived and/or modified sequence opt1 from anti-HIV_cap256-048-003289_VR-Chain
caggugcagcuggucgagagcggcgggggcguggugcagcccgggcgcucccuccggcugagcugcgccgccuccggcuucaccuucagcaaguacgggaugcacuggguccgccaggcgccgggcaagggccuggaguggguggccuucguggccuucgacggguccagcaagaacuacgccgacuccgucaagggccgguucaccaucagccgcgacaacuccaagaacacggugagccuccagaugaacucccugcggcccgaggacaccgccguguacuacugcgcgaaggaccugggggccaacaaggacgacgagugggccaccgacuacuacgaccucagcaucgccuaccccguccccgacccgcgcgcgguggugggcgccuucgacaucugggggcagggcaccauggucacgguguccagc

SEQ ID NO: 9908 - RNA, 432 nt, Artificial Sequence
  derived and/or modified sequence opt1 from anti-HIV_cap256-048-002601_VR-Chain
caggugcagcuggucgagagcggcgggggcguggugcagcccgggcgcucccuccggcugagcugcgccgccuccggcuucagcuucaacaacuacgcgauggacuggguccgccaggccccggggaagggccuggaguggguggccgugaucuccagcgacggccggaacaagaacuacgccgaguccgucaaggggcgcuucaccaucagccgggacaacuccaagaacaccguguaccuccagaugaacagccugcgcgccgaggacacggcgguguacuacugcgccaaggacgucggcgacaccaagaaggacgagugggccaccgacuacuacgaccuguccaucgccuaccccgugcaggacccccaggcgguggucggggccuucgacaucuggggccaggggaccauggugacggugagcucc

SEQ ID NO: 9909 - RNA, 432 nt, Artificial Sequence
  derived and/or modified sequence opt1 from anti-HIV_cap256-048-002129_VR-Chain
caggugcagcuggucgagagcggcgggggcguggugcagcccgggcgcucccuccggcugagcugcgccgccuccggcuucaccuucagcaccuacgcgaugcacuggguccgccaggccccggggaagggccuggaguggguggcccucaucuccuacgacggcacggacaaguacuacgccgacagcgugaaggggcgguucaucaucucccgcgacaacagccgguccacccuguaccugcagaugaacagccuccgccuggaggacaccgccgucuaccacugcgcgaaggaccugggcggguccaagagcgacgagugggccaccgacuacuacgaccucuccguggccuaccccgugcaggacccccgggccgucgugggcguguucgacaucugggggcagggcacgauggucaccgugagcucc

SEQ ID NO: 9910 - RNA, 432 nt, Artificial Sequence
  derived and/or modified sequence opt1 from anti-HIV_cap256-048-001875_VR-Chain
caggugcagcuggucgagagcggcgggggcguggugcagcccgggggcucccuccggcugagcugcgccaccuccgggcugaccuucagcaacuacggcaugcacuggguccggcaggccccgggccgcgggcucgaguggguggcguucacgcgguacgacggcaccuacaacuacuacgccgacuccgugaaggggcgcuucaccaucagccgggacaacuccaagggcacccuguaccugcagauggacgggcuccgccccgaggacacggcccuguacuacugcgccaaggaccugggcgagcgggagugcgaggagugggccagcgacuacuacgacuucggccgcgacuuccccugccaggacccccgcggggucgugggcaccuucgacaucugggggcagggcaccauggugaccgucuccagc

SEQ ID NO: 9911 - RNA, 432 nt, Artificial Sequence
  derived and/or modified sequence opt1 from anti-HIV_cap256-048-001302_VR-Chain
caggugcagcuggucgagagcggcgggggcguggugcagcccgggcgcucccuccggcugagcugcgccgccuccggcuucaccuucagcuacuccgggaugcacuggguccgccaggcgccgggcaagggcauggaguggguggccgugaucagcuacgacggguccaacaaguacuacgccgacagcgucaagggccgguucaccaucucccgcgacaacagcaagaacacgguguaccugcagaugaacucccuccgcgggguggacaccgccgucuacuacugcgccaaggaccugggcgggggcgagguggaggagugggcgaccgacuacuacgacuggagcaucgccuaccccguggagcacccccgggccgucgugggcguguucgacaucugggggcagggcaccaaggucacgguguccagc

SEQ ID NO: 9912 - RNA, 432 nt, Artificial Sequence
  derived and/or modified sequence opt1 from anti-HIV_cap256-048-001203_VR-Chain
caggugcagcuggucgagagcggcgggggcguggugcagcccgggcgcucccuccggcugagcugcgccgccuccggcuucaccuucagcuccuacgcgaugcacuggguccgccaggccccggggaagggccuggaguggguggccaucaucagcuacgacggcaccaucaaguacuacgccgacuccgugaaggggcgguucacgaucagccgcgacaacuccaagaacaccgucagccuccagaugaacucccugcggcccgaggacaccgccguguacuacugcgcgaaggacgugggcgccaacaaggacgacgagugggccaccgacuacuacgaccugagcaucgccuaccccguccccgacccgcgcgcgguggugggggccuucgacaucuggggccaggggacgauggucaccguguccagc

SEQ ID NO: 9913 - RNA, 432 nt, Artificial Sequence
  derived and/or modified sequence opt1 from anti-HIV_cap256-048-000383_VR-Chain
caggugcagcuggucgagagcggcgggggcguggugcagcccgggcgcucccuccggcugagcugcaccgccuccggcuucaccuucaaccacuacgccauggacuggguccgccaggcgccggggaagggccuggaguggguggccgugaucagcuccgacggcagcgacaagacguacgccgacuccgucaaggggcgguucaccaucagccgcgacaacuccaagaacaccguguaccuccagaugaacagccugcgggccgaggacaccgccguguacuacugcgcgaaggacgucggcggguccaaggacgacgagugggccacggacuacuacgaccugagcaucgccuaccccgugcccgacccccgcgccguggucggcgcguucgacuucugggggccgggcaccauggugaccguguccagc

SEQ ID NO: 9914 - RNA, 432 nt, Artificial Sequence
  derived and/or modified sequence opt1 from anti-HIV_cap256-038-261791_VR-Chain
caggugcagcuggucgaguucggcgggggcguggugcagcccgggggcagccuccgccuguccugcgccgccuucggguucaccaucagcuccuacggcaugcacuggguccggcaggcgccgggcaaggggcugcaguggguggccuucauccgcuacgacgagagcuccaaguucuacgccgacagcgugaagggccgguucaccaucucccgcgacaacagcgagaacacgcucuaccugcagaugaacucccugcgggccgaggacaccgccgucuacuacugcgcgaaggaccucggggagagcgagaacgaggagugggccaccgacuacuacgacuucuccaucgccuaccccggccaggacccccgcgggguggugggcaucuucgacaucuggggccaggggaccauggucacggugagcucc

SEQ ID NO: 9915 - RNA, 432 nt, Artificial Sequence
  derived and/or modified sequence opt1 from anti-HIV_cap256-038-241540_VR-Chain
caggugcagcuggucgagagcggcgggggcguggugcagcccgggcgcucccuccggcugagcugcgccgccuccggcuucaccuucagcaacuccgcgaugcacuggguccgccaggccccggggaagggccuggaguggguggcccucaucagcuacgugggcgggaacaucuacuacgccgacuccgucaagggccgguucaccgugagccgcgacaacuccaagaagacgcuguaccugcagaugaacagccuccggguggaggacaccgccgucuacuacugcgugaaggacgugggggaguccgagaacgaggagugggcgagcgacuacuacgacuucggccgcgacuaccccgggcaggacacccgggccgucgugggcgccuucgacaucuggggccaggggaccauggugacggucuccagc

SEQ ID NO: 9916 - RNA, 432 nt, Artificial Sequence
  derived and/or modified sequence opt1 from anti-HIV_cap256-038-235677_VR-Chain
cuggugcagcucgucgagagcggcgggggcguggugcagcccgggggcucccugcgccugagcugcgccgccuccggguuccgguucagcuccuacggcaugcacuggguccgccaggcgccgggcaaggggcucgaguggguggccuucauccgguacgacggcagcuucaaggacuacgccgacuccgugcgcgggcgguucaccaucagccgcgagaacuccaagaacacccuguaccugcagaugaacagccuccggacggacgacaccgccgucuacuacugcgccaaggaccugggcgaguccgagaccgaggaguggcccagcgacuacuacgacuucgggcgcgacuaccccggccaggacccccggggcgugguggggaccuucgacaucuggggccacgggacgauggucaccguguccagc

SEQ ID NO: 9917 - RNA, 435 nt, Artificial Sequence
  derived and/or modified sequence opt1 from anti-HIV_cap256-038-234314_VR-Chain
gaggugcagcugcucgagagcggcgggggccugguccagcccgggggcucccugcgccucagcugcgccgccuccggguucaccuucagccgguacgcgauguccugggugcgccaggccccgggcaagggccuggaguggguggccgucaucagcuacgacggguccaacaaguacuacgccgacagcgugaagggccgguucaccaucucccgcgacaacagcaagaacacgcuguaccuccagaugaacucccugcgggccguggacaccgcggucuacuacugcgccaaggaccugggggagggcgagaacgaggagugggccaccgacuacuacgacuucagcuacuggcuccccugccccaaguaccacggggccuggcuggagcugcucuacaucuggggccagggcaccauggugacgguguccagc

SEQ ID NO: 9918 - RNA, 432 nt, Artificial Sequence
  derived and/or modified sequence opt1 from anti-HIV_cap256-038-234273_VR-Chain
gaggugcagcuggucgagagcggcgggggccucauccagcccgggggcucccugcgccugagcugcgccgccuccggguucaccgugagcaccaacuucauguccugggugcggcaggcgccgggcaagggccucgagugggucgccgugaucagcuacgacgggaacaacaaguacuacgccgacuccgugaagggccgcuucacgaucagccgggagaacuccaagaacacccuguaccugcagaugaacagccuccgcaccgacgacaccgccgucuacuacugcgccaaggaccugggggaguccgagacggaggaguggcccagcgacuacuacgacuucggccgggacuaccccgggcaggacccccgcggcguggugggcaccuucgacaucugggggcacggcaccauggucaccguguccagc

SEQ ID NO: 9919 - RNA, 432 nt, Artificial Sequence
  derived and/or modified sequence opt1 from anti-HIV_cap256-038-223164_VR-Chain
gaggugcagcuggucgagagcggcgggggccucgugcgccccgggggcucccugcggcugagcugcgccgccuccggguucagccucggcuccuacuggaugaccugggugcgccaggcgccgggcaaggggcuggagugggucgccgugaucagcuacgacggcuccaacaaguacuacgccgacagcgugaaggggcgguucaccaucucccgcgacaacagcaagaacacgcuguaccuccagaugaacucccugcgggccgaggacaccgcccuguacuacugcgcgaaggaccucggcgagagcgagaacgaggagugggccuccgacuacuacgacuucgggcgcgacuaccccggccaggacccccggggcgucguggggaccuucgacaucuggggccaggggaccauggugacggucagcucc

SEQ ID NO: 9920 - RNA, 432 nt, Artificial Sequence
  derived and/or modified sequence opt1 from anti-HIV_cap256-038-220289_VR-Chain
gaggugcagcuggucgagagcggcgggggccucgugcagcccgggggcucccugcgccugagcugcaccgccuccggguucaccuucagcuccuacgagaugaacugggugcggcaggccccgggcaagggccccgagugggucgcggugaucagcuacgacgggaacaacaaguacuacgccgacuccgugaagggccgcuucacgaucagccgggagaacuccaagaacacccucuaccugcagaugaacagccugcgcaccgacgacaccgccgucuacuacugcgccaaggaccucggggaguccgagacggaggaguggcccagcgacuacuacgacuucggccgggacuaccccgggcaggacccgcgcggcguggugggcaccuucgacaucugggggcacggcaccauggucaccguguccagc

SEQ ID NO: 9921 - RNA, 432 nt, Artificial Sequence
  derived and/or modified sequence opt1 from anti-HIV_cap256-038-220020_VR-Chain
caggugcagcuggucgagagcggcgggggcguggugcagcccgggcggucccuccggcugagcugcgccgccuccggcuucaccuucagccgcaacgcgaugcacuggguccggcaggccccggggaagggccuggaguggguggcccucaucuccuacgacggcagcaacaaguacuacguggacuccgucaaggggcgcuucaccaucagccgggacaacuccaagaacacgcuguaccugcagaugaacagccuccgcgccgacgacaccgccguguacuacugcgcgaaggaccugggcgaguccgagaccgaggagugggggaccgacuacuacgacuucagcacgggcuaccccgugcaggacccccgcggggucgugggcgccuucgacaucuggggccaggggaccaugguguccgucagcucc

SEQ ID NO: 9922 - RNA, 432 nt, Artificial Sequence
  derived and/or modified sequence opt1 from anti-HIV_cap256-038-216853_VR-Chain
caggugcagcuggucgagagcggcgggggcguggugcagcccgggcgcucccuccggcugagcugcgccgccuccggcuucaccuucagcuccuacgcgaugcacuggguccgccaggccccggggaagggccuggaguggguggccgugaucagcuacgacggcuccaacaaguacuacgccgacagcgucaaggggcgguucaccaucucccgcgacaacagcaagaacacgcucuacgugcagaugaacucccugcgggccgaggacaccgcgguguacuacugcgcccgcgaccugggcgagagcgagaccgaggaguggcccuccgacuacuacgacuucgggcgggacuaccccggccaggacccccgcggggucgugggcaccuucgacaucuggggccacgggacgauggugaccgucagcucc

SEQ ID NO: 9923 - RNA, 432 nt, Artificial Sequence
  derived and/or modified sequence opt1 from anti-HIV_cap256-038-213466_VR-Chain
gaggugcagcuggucgagagcggcgggggccucgugcagcccgggcgcucccugcgggugagcugcgccgccuccggcuucaccuucgaggacuacgcgaugcacuggguccgccaggccccggggaagggccuggaguggguggccgugaucagcgacgacggcaacaacaaguacuacgccgacuccgucaaggggcgguucaccaucagccgcgacaacuccaagaacacgcucuaccugcagaugaacagccugcggguggaggacaccgccguguacuacugcgucaaggacgugggcgaguccgagaacgaggagugggcgagcgacuacuacgacuucgggcgcgacuaccccggccaggacacccgggccguggucggggccuucgacaucuggggccagggcaccauggugacgguguccagc

SEQ ID NO: 9924 - RNA, 432 nt, Artificial Sequence
  derived and/or modified sequence opt1 from anti-HIV_cap256-038-213212_VR-Chain
caggugcagcuggucgagagcggcgggggcguggugcagcccgggggcucccuccgccugagcugcgccgccuccggguucaucuucagcgacuacggcaugcacuggguccggcaggcgccgggcaaggggcuggaguggguggccuccaucuggcacgacggcagcaagaaguacuacgccgacuccgugaaggggcgcuucaccaucagccgggagaacuccaagaacacccucuaccugcagaugaacagccugcgcgccgaggacacggccgucuaccacugcgcgaaggaccucggcgaguccgagaucgaggaguggaccagcgacuacuacgacuucgggcgggacuaccccggccaggacccccgcggcguguucgggaccuucgacaucuggggccacgggaccauggugacggucuccagc

SEQ ID NO: 9925 - RNA, 432 nt, Artificial Sequence
  derived and/or modified sequence opt1 from anti-HIV_cap256-038-213120_VR-Chain
caggugcaccuggucgagagcggcgggggccucgugaagcccgggggcucccugcgccugagcugcgccgccuccggguucaccuucagcgacuacuacaugaucuggauccggcaggcgccgggcaagggccucgaguggguggccgucaucuccagcgacggguccaacaagaacuacgccgacagcgugaagggccgcuucaccaucucccgggacaacagcaagaacacgcuguaccugcagaugaacucccuccgcgccgaggacaccgccguguacuacugcgcgaaggaccugggggagagcgagaacgaggagugggccaccgacuacuacgacuucgccaccggcuaccccguccaggacccccgggccguggugggggcguucgacaucuggggccagggcacgauggucaccguguccccc

SEQ ID NO: 9926 - RNA, 432 nt, Artificial Sequence
  derived and/or modified sequence opt1 from anti-HIV_cap256-038-212592_VR-Chain
cuggugcagcucgucgagagcggcgggggcguggugcagcccgggaagucccugcgccugagcugcgccgccuccggcuucaccuucagcuccuacgcgaugcacuggauccggcaggccccggggaagggccucgagugggucgccgugaucagcgacgacggcuccaucaagaacuacgccgacagcgugaaggggcgcuucaccaucucccgggacacgagcaagaagcugauguaccugcagaugaacucccucagcgccaacgacaccgcggucuacuacugcgccaaggaccugggcgagcgcgagaacgaggagugggccuccgacuacuacgacuucgggcgggacuaccccggccaggacccccgcgggguggugggcagcaucgacaccuggggccacgggaccauggucacgguguccagc

SEQ ID NO: 9927 - RNA, 432 nt, Artificial Sequence
  derived and/or modified sequence opt1 from anti-HIV_cap256-038-211790_VR-Chain
gagcugcagcucguggagagcggcgggggccugguccagcccgggggcucccugcgccucagcugcgugguguccggguucaccgucagcaccaacuacaucuccugggugcggcaggccccgggcaagggccuggaguggguggccgucaucagcuacgacggguccaacaaguacuacgcggacagcgugaagggccgcuucacgaucucccgggacaacagcaagaacacccuguaccuccagaugaacucccugcgcgccgaggacaccgcccuguacuacugcgccaaggaccucggggagagcgagaacgaggagugggccuccgacuacuacgacuucggccgggacuaccccgggcaggacccccgcggcguggucggcaccuucgacaucugggggcagggcacgauggugaccgugagcucc

SEQ ID NO: 9928 - RNA, 432 nt, Artificial Sequence
  derived and/or modified sequence opt1 from anti-HIV_cap256-038-209916_VR-Chain
caggugcagcuggucgagagcggcgggggcguggugcagcccgggggcucccuccggcugagcugcgccgccuccggguucaccuucagcuccuucggcaugcacuggguccggcaggcgccgggcaaggggcuggagugggugagcuucauccgcaacgacggcgggauccgguacuccgccgacagcgugcgcggccgguucaccaucucccgcgacaacagcaagaacacgcucuaccugcagaugaacucccugcggaccgacgacaccgccgucuacuacugcgccaaggaccucggggagagcgagaccgaggaguggcccuccgacuacuacgacuucggccgcgacuaccccggccaggacccccgcgggguggugggcacguucgacaucugggggcacggcaccauggucaccgugagcucc

SEQ ID NO: 9929 - RNA, 432 nt, Artificial Sequence
  derived and/or modified sequence opt1 from anti-HIV_cap256-038-207938_VR-Chain
caggugcagcuggucgagagcggcgggggcguggugcaccccgggcgcucccuccggcugagcugcgccgccuccggcuucaccuucagcuccuacgggaugcacuggguccgccaggcgccgggcaagggccuggaguggguggccgugaucagccacgacggguccaacaaguacuacgccgacagcgucaagggccgguucaccaucucccgcgacaacagcaagaacacgcucuaccugcagaugaacucccugcgggccgaggacaccgccguguacuacugcgcgaaggaccucggggagagcgagaacgaggagugggccuccgacuacuacgacuucggccgcgacuaccccgggcaggacccccggggcguggucggcguguucgacaucugggggcagggcaccauggugaccgucagcucc

SEQ ID NO: 9930 - RNA, 432 nt, Artificial Sequence
  derived and/or modified sequence opt1 from anti-HIV_cap256-038-202245_VR-Chain
caggugcaccuggucgagagcggcgggggcguggugcagcccgggcgcucccuccggcugagcugcaccgucuccggcuucaccuucgggagcuacgcccugcacugggugcgccaggccccgggcaagggccucgaguggcuguccgugaucagcuacgacgggaacaacaaguacuacgcggacuccgucaagggccgguucacgaucagccgcgagaacuccaagaacacccuguaccuccagaugaacagccugcgggccgaggacaccgccguguaccacugcgccaaggaccugggggaguccgagaaggaggagugggccagcgacuacuacgacuucggccgcgacuaccccgggcaggacccccggggcguggucggcaccuucgacaucugggggcacggcacgauggugaccguguccagc

SEQ ID NO: 9931 - RNA, 432 nt, Artificial Sequence
  derived and/or modified sequence opt1 from anti-HIV_cap256-038-197721_VR-Chain
caggugcagcuggucgagagcggcgggggcguggugcagcccgggaagucccuccgccugagcugcgccggcuccggguucaucuucagcaacuacccgaugcacuggguccggcaggcccccggcaagggccuggaguggauggcggacguguccuacgacgggagcaacaaggacuacgccgacuccgugaagggccgcuucaccaucagccgggacaacuccaagaacacccucuaccugcagaugaacagccugcgcgccgaggacacggccgucuacuacugcgugaaggacgugggggaguccgagaacgaggagugggccagcgacuacuacgacuucggccgggacuaccccgggcaggacacccgcgcggucgugggcgccuucgacaucuggggccaggggaccauggugaccgucuccagc

SEQ ID NO: 9932 - RNA, 432 nt, Artificial Sequence
  derived and/or modified sequence opt1 from anti-HIV_cap256-038-196679_VR-Chain
gaggugcagcugcucgagagcggcgggggccugguccagcccgggggcucccugcgccucagcugcgccgccuccggguucaccuucagcuccuacgcgaugagcugggugcggcaggccccgggcaagggccuggaguggguggccgucaucuccuacgacgggggcaacaaguacuacgccgacagcgugaaggggcgcuucaccaucucccgggacaacagcaagaacacgcuguaccuccagaugaacucccugcgcgccgaggacaccgcgcuguacuacugcgccaaggaccucggcgagagcgagaacgaggagugggccuccgacuacuacgacuucgggcgggacuaccccggccaggacagccgcggcguggucgggaccuucgacguguggggccaggggaccauggugacggucuccagc

SEQ ID NO: 9933 - RNA, 438 nt, Artificial Sequence
  derived and/or modified sequence opt1 from anti-HIV_cap256-038-196118_VR-Chain
caggugcagcuggucgagagcggcgggggcguggugcagcccgggggcucccuccgccugagcugcgccgccuccggguucaccuucagcaccuacggcaugcacuggguccggcaggcgccgggcaaggggcuggagugggugacguucauccgcaacgacggcaccaacaaguacuacgccgacuccgugaaggggcgguucaccaucagccgcgacaacaccaagaacacgcucuaccugcagauguacucccugcgggccgaggacaccgccgucuacuacugcgccaaggaccucggcgagagcgagaacgaggacgaggagugggcguccgacuacuacgacuucgggcgcgacuaccccggccaggacagccggggcgugguggggaccuucgacauguggggccaggggaccauggucacgguguccagc

SEQ ID NO: 9934 - RNA, 429 nt, Artificial Sequence
  derived and/or modified sequence opt1 from anti-HIV_cap256-038-195382_VR-Chain
caggugcaccuggucgagagcggcgggggcguggugcagcccgggcgcucccuccggcugagcugcgccgccuccggcuucaccuucagcaacuacccgguccacugggugcgccaggcgcccgggaagggccuggaguggguggccgucaucuccuucgacggcaucaacaacuacgccgggagcgugaagggccgguucaucaucucccgcgacaacagcaagaacacccucuaccugcagaugaacucccugcgggccgaggacacggccguguacuacugcgucaaggaccucggggagagcgagaaggaggaguggcccuccgacuacuacgacuucggccgcgacuaccccgggcaggacagccggggcguggugggcgucuucgacaucugggggcagggcaccauggugaccguguccagc

SEQ ID NO: 9935 - RNA, 432 nt, Artificial Sequence
  derived and/or modified sequence opt1 from anti-HIV_cap256-038-180001_VR-Chain
gaggugcagcuggucgagagcggcgggggccucgugcagcccgggcgcucccugcggcugagcugcaccgccuccggcuucaccuucggggacuacgccaugagcugguuccgccaggcgccgggcaagggccucgaguggguggccgacaucuccuacgacgggagcaacaaguacuacgccgacuccgucaagggccggcugacgaucagccgcgacaacuccaagaacacccuguaccuccagaugaacagccugcgggccgaggacaccgccguguacuacugcgugaaggaccugggggaguccgagaaggaggaguggcccagcgacuacuacgacuucggccgcgacuaccccgggcaggacucccggggcgucgugggcguguucgacaucugggggcagggcaccauggucacggugagcucc

SEQ ID NO: 9936 - RNA, 432 nt, Artificial Sequence
  derived and/or modified sequence opt1 from anti-HIV_cap256-038-178021_VR-Chain
caggugaagcuggucgagagcggcgggggcguggugcagcccgggggcucccuccgccugagcugcgccgccgcgggguucaucuucuccaacagcggcaugcacuggguccggcaggccccggacaagggccuggaguggguggccuucgugcccuacgacggguccaacaaguacuacgccgacagcgucaagggccgcuucaccaucucccgggacaacagcaagaacacccucucccugcagaugaacagccugcgcacggaggacaccgccguguacuacugcgcgaaggaccucggggaguccgagaccgaggaguggcccagcgacuacuacgacuucggccgggacuaccccgggcaggacccgcgcggcguggucggcaccuucgacaucugggggcacggcacgauggugaccguguccagc

SEQ ID NO: 9937 - RNA, 432 nt, Artificial Sequence
  derived and/or modified sequence opt1 from anti-HIV_cap256-038-177104_VR-Chain
gaggugcagcugcucgagagcggcgggggccugguccagcccgggggcucccugcgccucagcugcgccgccuccggguucaccuucagcuccuacgcgaugaacugggugcggcaggccccgggcaagggccuggaguggguggccgucaucagcuacgacgggggcgacaaguacuacgccgacuccgugaaggggcgcuucaccaucagccgggacaacuccaagaacacgcuguaccuccagaugaacagccugcgcguggaggacaccgccgucuacuacugcgugaaggacgugggcgaguccgagaacgaggagugggcgagcgacuacuacgacuucgggcgggacuaccccggccaggacacccgcgccgucgugggcgccuucgacaucugggggcagggcaccauggugacggucuccagc

SEQ ID NO: 9938 - RNA, 432 nt, Artificial Sequence
  derived and/or modified sequence opt1 from anti-HIV_cap256-038-171261_VR-Chain
caggugcagcuggucgagagcggcgggggcguggugcagcccgggcgcucccuccggcugagcugcgccgccuccggcuucaccuucagcuccuacgcgauguacuggguccgccaggccccggggaagggccuggaguggguggccgugaucagcuccgacggcagcgacaagaacuacgccgacuccgucaaggggcgguucaccaucagccgcgacaacuccaacaacacgcucuaccugcagaugaacagccugcgggccgaggacaccgcgguguacuacugcgcccgcgaccucggcgaguccgagaacgaggaguggcccagcgacuacuacgacuucgggcgggacuaccccggccaggacccccgcggggugaucggcaccuucgacgucuggggccaggggaccauggugacgguguccagc

SEQ ID NO: 9939 - RNA, 432 nt, Artificial Sequence
  derived and/or modified sequence opt1 from anti-HIV_cap256-038-169090_VR-Chain
caggugcagcuggucgagagcggcgggggcguggugcagcccgggcgcucccuccggcugagcugcgccgccucccgcuucaccuucaagaccuacacgaugcacuggguccggcaggcgccgggcaaggggcuggaguggguggcccucaucagcuacgacggcuccaacaaguacuacgccgacagcgugaagggccgccugaccaucucccgggacaacagcaagaacacccuguaccuccagaugaacucccugcgcgccgaggacaccgccgucuacuacugcgugaaggaccugggggagagcgagaaggaggaguggcccuccgacuacuacgacuucggccgggacuaccccgggcaggacagccgcggcguggucgggguguucgacaucuggggccagggcacgauggugaccgucuccagc

SEQ ID NO: 9940 - RNA, 432 nt, Artificial Sequence
  derived and/or modified sequence opt1 from anti-HIV_cap256-038-168705_VR-Chain
gaggugcagcuggucgagagcggcgggggccucgugaagcccgggggcucccugcgccugagcugcgccgccuccggguucaccuucagcuccuacagcaugaacugggugcggcgcgcgccgggcaagggccucgagugggucgcccugaucuccuacgacgagaacaagaaguacuacgccgacagcgugaaggggcgguucaccaucucccgcgagaacagcaagaacacgcuguaccuccagaugaacucccugcgggccgaggacaccgccguguacuacugcgcgaaggaccugggcgagcgcgagaacgaggagugggccagcgacuacuacgacuucgggcgggacuaccccggccaggacccccgcggggucgugggcuccaucgacaccuggggccacgggaccauggugacggucagcucc

SEQ ID NO: 9941 - RNA, 432 nt, Artificial Sequence
  derived and/or modified sequence opt1 from anti-HIV_cap256-038-167685_VR-Chain
caggugcagcuggucgagagcggcgggggcguggugcagcccgggcgcucccuccggcugagcugcgccgccuccggcaucaccuucagcuccuacgcgauccacuggguccgccaggccccggggaagggccuggaguggguggccgugaucagcuacgacggcuccaacaaguacuacgccgacagcgucaaggggcgguucaccaucucccgcgacaacagcaagaacacgcucuaccugcagaugaacucccugcgggccgaggacaccgcgguguacuacugcgccaaggaccucggcgagagcgagaacgaggagugggccaccgacuacuacgacuucuccaucggguaccccggccaggacccccgcgggguggucggcgccuucgacaucuggggccaggggaccauggugacggugagccug

SEQ ID NO: 9942 - RNA, 432 nt, Artificial Sequence
  derived and/or modified sequence opt1 from anti-HIV_cap256-038-158775_VR-Chain
caggugcagcuggucgagagcggcgggggcguggugcagcccgggggcucccuccgccugagcugcgccgccuccggguucaccuucagcaccuacggcaugcacuggguccggcaggcgccgggcaaggggcuggaguggguggccuucauccgcgacaacggcuccaacaaguacuacgccgacagcgugaaggggcgguucacgaucucccgcgacaacagcaagaacacccucuaccugcagaugaacucccugcgggccgaggacaccgcccucuacuacugcgcgaaggaccugggcgagagcgagaacgaggagugggccuccgacuacuacgacuucgggcgcgacuaccccggccaggacagccggggcgucguggggaccuucgacguguggggccaggggacgauggucaccguguccagc

SEQ ID NO: 9943 - RNA, 432 nt, Artificial Sequence
  derived and/or modified sequence opt1 from anti-HIV_cap256-038-157318_VR-Chain
cacgugcagcuggucgagagcggcgggggcguggugcagcccgggcggucccuccggcugagcugcgccgccuccggcaucaccuucagcaccuacgacaugcacuggguccgccaggcgccggggaagggccuggaguggguggccgugaucuccaacgacggcagcaacaaguacuacgccgacuccgucaaggggcgguucacgaucagccgcgacaacuccaagaacacccucuaccugcagaugaacagccugcgggccgaggacaccgcccucuacuacugcgcgaaggaccugggcgaguccgagaaggaggagugggccagcgacuacuacgacuucgggcgcgacuaccccggccaggacccccgcggggugguggccaccuucgacaucuggggccagggcacgauggucaccguguccagc

SEQ ID NO: 9944 - RNA, 432 nt, Artificial Sequence
  derived and/or modified sequence opt1 from anti-HIV_cap256-038-153058_VR-Chain
caggugcagcuggucgagagcggcgggggcguggugcagcccgggcgcucccuccggcugagcugcgccgccuccggcuucaccuucagcaccuacgcgaugcacuggguccgccaggccccggggaagggccuggaguggguggccgugaucuccuacgacggcagccacuccuacuacgccgggagcgucaagggccgguucacgaccucccgcgacaacagcaagaacacccucaaccugcagaugaacucccugcggcccgaggacaccgcccucuacuacugcgcgaaggaccugggggagagcgagaacgaggagugggccuccgacuacuacgacuucggccgcgacuaccccgggcaggacagccggggcguggugggcacguucgacgucugggggcagggcaccauggugaccguguccagc

SEQ ID NO: 9945 - RNA, 432 nt, Artificial Sequence
  derived and/or modified sequence opt1 from anti-HIV_cap256-038-150027_VR-Chain
cuggugcagcucgucgagagcggcgggggcguggugcagcccgggggcucccugcgccugagcugcgccgccuccggguuccgguucagcuccuacggcaugcacuggguccgccaggcgccgggcaaggggcucgaguggguggccuucauccgguacgacggcagcuucaaggacuacgccgacuccgugcgcgggcgguucaccaucagccgcgacaacuccaagaacaccgucuacgugcagaugaacagccugcgggccgaggacacggccguguacuacugcgcgaaggaccugggcgaguccgagaacgaggagugggccaccgacuacuacgacuucgccaccggguaccccguccaggacccccgcgccguggugggcgcguucgacaucuggggccaggggaccauggucacggugagcccc

SEQ ID NO: 9946 - RNA, 432 nt, Artificial Sequence
  derived and/or modified sequence opt1 from anti-HIV_cap256-038-146372_VR-Chain
caggugcagcuggucgagagcggcgggggcguggugcagcccgggcgcucccuccggcugagcugcgccgccuccggcuucaccuucagcuccuucgggaugcacuggguccgccagagcccgggcaagggccuggaguggguggcggugaucuccuacgacgggaacaacaaguacuacgccgacagcgucaagggccgguucaccaucucccgcgagaacagcaagaacacgcucuaccugcagaugaacucccugcggaccgacgacaccgccguguacuacugcgccaaggaccucggggagagcgagaccgaggagugggccacggacuacuacgacuucgcgaccggcuaccccgugcaggacccccgcgccgucgugggggccuucgacaucuggggccagggcaccauggugaccgucuccccc

SEQ ID NO: 9947 - RNA, 432 nt, Artificial Sequence
  derived and/or modified sequence opt1 from anti-HIV_cap256-038-141868_VR-Chain
gagcugcggcucguggagagcggcgggaaccugguccagcccggcgggucccugacccucagcugcguggccuccggcuucaccuucgacagcuacgggauguccugggugcggcaggccccgggcaagggccuggagugggucgcgcugaucagcuacgacgagaacaagaaguacuacgccgacuccgugaaggggcgcuucacgaucagccgggagaacuccaagaacacccucuaccugcagaugaacagccugcgcgccgaggacaccgccguguacuacugcgccaaggaccucggcgagcgggagaacgaggagugggcguccgacuacuacgacuucgggcgcgacuaccccggccaggacccccgcggggucgugggcagcaucgacaccuggggccacgggacgauggugaccgucuccagc

SEQ ID NO: 9948 - RNA, 432 nt, Artificial Sequence
  derived and/or modified sequence opt1 from anti-HIV_cap256-038-141616_VR-Chain
gaggugcagcugcucgagagcggcgggggccugguccagcccgggggcucccugcgccucagcugcgccgccuccggguucaccuucagcuccuacgcgaugagcugggugcggcaggccccgggcaagggccuggaguggguggccgucaucuccaaggacgggagcgacaacuccuacguggacagcgugaagggccgcuucaccaucucccgggacaacagcaagaacacgcuguaccuccagaugaacucccugcgcgccgaggacaccgccgucuacuacugcgcgcgggaccugggggagagcgagaacgaggaguggcccuccgacuacuacgacuucggccgcgacuaccccgggcaggacccccggggcgugaucggcaccuucgacgugugggggcagggcaccauggucacggugagcucc

SEQ ID NO: 9949 - RNA, 432 nt, Artificial Sequence
  derived and/or modified sequence opt1 from anti-HIV_cap256-038-127989_VR-Chain
caggcccagcugguggagagcggcgggggcgucgugcagcccgggcgcucccuccggcugagcugcgccgcguccggcuucaccuucagcaacuucgccaugcacugggugcgccaggccccggggaagggccuggagugggucgccgugauguccgacgacggcagcaacaaguacuacgccgacuccgugaaggggcgguucaccaucagccgcgacaacuccgagaacacgcucuaccugcagaugaacagccugcgggcggaggacaccgccgucuacuacugcgccaaggaccucggcgaguccgagaccgaggagugggccaccgacuacuacgacuucgggacgggcuaccccgggcaggacccccgcgcgaugaucggcaccuucgacaucuggggccgggggaccauggugaccgugagcucc

SEQ ID NO: 9950 - RNA, 432 nt, Artificial Sequence
  derived and/or modified sequence opt1 from anti-HIV_cap256-038-118109_VR-Chain
caggugcagcuggucgagagcggcgggggcguggugcagcccgggggcucccuccgccugagcugcaccgccuccggguucaccuucagcgccuacgacaugcacuggauccggcaggcgccgggcaagggccuggggugggucgccuucaucacgaacgagggcuccagcaagaacuacguggacuccgugaaggggcgcuucaccaucagccgggacaacuccaagaacacccucuaccugcagaugaacagccugcgcgccgaggacaccgccgucuacuacugcgccaaggaccucggcgaguccgagaacgaggagugggcgacggacuacuacgacuucagcaucgccuaccccgggcaggacccccggggcguggugggcaucuucgacaucugggggcagggcaccauggucaccguguccagc

SEQ ID NO: 9951 - RNA, 432 nt, Artificial Sequence
  derived and/or modified sequence opt1 from anti-HIV_cap256-038-112226_VR-Chain
gaggugcagcuggucgagagcggcgggggccucgugcagcccgggggcucccugcgccugagcugcgccgccuccggguucaccuucagcuccuacuggaugaccugggugcggcaggcgccgggcaagggccucgagugggucgccgugaucagcgacgacgggaacaacaaguacuacgccgacuccgugaagggccgcuucacgaucagccgggacaacuccaagaacacccuguaccugcagaugaacagccuccgcgucgaggacaccgccguguacuacugcgugaaggacgucggggaguccgagaacgaggagugggccagcgacuacuacgacuucggccgggacuaccccgggcaggacacccgcgcgguggugggcgccuucgacaucuggggccaggggacgauggucaccguguccagc

SEQ ID NO: 9952 - RNA, 432 nt, Artificial Sequence
  derived and/or modified sequence opt1 from anti-HIV_cap256-038-105918_VR-Chain
gaggugcagcugcucgagagcggcgggggccugguccagcccgggggcucccugcgccucagcugcgccgccuccggguucaccuucaacauccacccgaugcacugggugcggcaggcgcccggcaagggccuggaguggguggccgucaucagcuacgacgggaacaacaaguacuacgccgacuccgugaagggccgcuucaccaucagccgggagaacuccaagaacacgcuguaccuccagaugaacagccugcgcaccgacgacaccgccguguacuacugcgccaaggaccugggggaguccgagaccgaggaguggcccagcgacuacuacgacuucggccgggacuaccccgggcaggacccgcgcggcgucgugggcacguucgacaucugggggcacggcaccauggugaccgucuccagc

SEQ ID NO: 9953 - RNA, 432 nt, Artificial Sequence
  derived and/or modified sequence opt1 from anti-HIV_cap256-038-104487_VR-Chain
cuggugcagcucgucgagagcggcgggggcguggugcagcccgggaagucccugcgccugagcugcgccgccuccggcuucaccuucagcuccuacgcgaugcacuggauccggcaggccccggggaagggccucgagugggucgccgugaucagcgacgacggcuccaucaagaacuacgccgacagcgugaaggggcgcuucaccaucucccgggacaacagcaagaacacgcuguaccugcagaugaacucccuccgcgccgaggacaccgcggucuacuacugcgccaaggaccugggcgagagcgagaacgaggagugggccaccgacuacuacggguucuccaucggcuaccccgggcaggacccccggggcguggugggcaucuucgacaucugggcccaggggaccauggucacggugagcucc

SEQ ID NO: 9954 - RNA, 432 nt, Artificial Sequence
  derived and/or modified sequence opt1 from anti-HIV_cap256-038-102308_VR-Chain
caggugcagcuggucgagagcggcgggggcguggugcagcccgggggcucccuccgccugagcugcgccgcccuggacuucccguucuccagcuucgggaugcacuggguccggcagacccccggccgcggccucgaguggguggcgaucaucugguccgacgggagcaaccgguacuacguggacuccgucaagggccgcuucaccaucagccgggacaacuccaagaacacgcuguaccugcagaugaacagccuccgccccgacgacaccgccguguacuacugcgugaaggaccugggggaguccgagaacgaggagugggccaccgacuacuacgacuucagcgucggcuaccccgggcagggcccgcggggcgugguggggaucuucgacaucuggggccaggggaccauggucacgguguccagc

SEQ ID NO: 9955 - RNA, 432 nt, Artificial Sequence
  derived and/or modified sequence opt1 from anti-HIV_cap256-038-091115_VR-Chain
caggugcagcuggucgagagcggcgggggcguggugcagcccgggcgcucccuccggcugagcugcgccgucuccggcuucaccuucagcuccuacgggcugcacugggugcgccaggccccgggcaagggccucgaguggguggcggucaucagcuacgacggguccaacaaguacuacgccgacagcgugaagggccgguucaccaucucccgcgacaacagcaagaacacgcuguaccugcagaucaacucccuccgggccgaggacaccgccguguacuacugcgccaaggaccugggggagagcgagaacgaggagugggcgaccgacuacuacgacuucuccaucggcuaccccgggcaggacccccgcgccgucgugggcgccuucgacaucuggggccaggggaccauggugacggucagcucc

SEQ ID NO: 9956 - RNA, 432 nt, Artificial Sequence
  derived and/or modified sequence opt1 from anti-HIV_cap256-038-090262_VR-Chain
caggugcagcuggucgagagcggcgggggcguggugcaggccgggggcucccuccgccugagcugcgccgcguccggguucaccuucaacaacuacggcaugcacuggguccggcaggcccccggcaaggggcuggagugggccgccuucauccgcuacgacggcagcaacaaguacuacgccgacuccgugcgggggcgcuucaccaucagccgggacaacuccaagaacacgcucuaccugcagaugaacagccugcgcgcggaggacaccgccguguacuacugcgucaaggacgugggcgaguccgagaacgaggagugggccagcgacuacuacgacuucgggcgggacuacccgggccaggacacccgcgccguggucggcgcguucgacaucugggggcagggcaccauggugacgguguccagc

SEQ ID NO: 9957 - RNA, 432 nt, Artificial Sequence
  derived and/or modified sequence opt1 from anti-HIV_cap256-038-083260_VR-Chain
caggugcagcuggucgagagcggcgggggccucgugaagcccgggggcucccugcgccugagcugcgccgccuccggguucaccuucagcgacuacuacaugaccuggauccggcaggcgccgggcaagggccucgaguggguggccgucaucuccuacgacgggggcaacaaguacuacgccgacagcgugaaggggcgcuucacgaucucccgggacaacagcaagaacacccuguaccugcagaugaacucccuccgcgccgaggacaccgcccuguacuacugcgcgaaggaccugggcgagagcgagaacgaggagugggccuccgacuacuacgacuucgggcgggacuaccccggccaggacagccgcggcguggucgggaccuucgacguguggggccaggggacgauggugaccgucuccagc

SEQ ID NO: 9958 - RNA, 432 nt, Artificial Sequence
  derived and/or modified sequence opt1 from anti-HIV_cap256-038-080981_VR-Chain
caggugcagcuggucgagagcggcgggggcguggugcagcccgggcgcucccuccggcugagcugcgccgccuccggcuucaccuucagcuccuacgggaugcacuggguccgccaggcgccgggcaagggcauggaguggguggccgugaucagcuacgacggguccaacaaguacuacgccgacagcgucaagggccgguucaccaucucccgcgacaacagcaagaacacgcuguaccuccagaugaacucccugcgggccguggacaccgccguguacuacugcgcgaaggaccugggggagggcgagaacgaggagugggccaccgacuacuacgacuucagcaucggguaccccggccaggacccccgcggcgucgugggggccuucgacaucuggggccaggggaccauggugacggucuccagc

SEQ ID NO: 9959 - RNA, 432 nt, Artificial Sequence
  derived and/or modified sequence opt1 from anti-HIV_cap256-038-080873_VR-Chain
cuggugcagcucgucgagagcggcgggggcguggugcagcccgggggcucccugcgccugagcugcgccgccuccggguuccgguucagcuccuacggcaugcacuggguccgccaggcgccgggcaaggggcucgaguggguggccuucauccgguacgacggcagcuucaaggacuacgccgacuccgugcgcgggcgguucaccaucagccgcgacaacuccaagaacaccgucuaccugcagaugaacagccugcgggccgaggacacggccguguacuacugcgugaaggaccucggcgaguccgagaaggaggaguggcccagcgacuacuacgacuucgggcgcgacuaccccggccaggacucccggggcgucguggggguguucgacaucuggggccaggggaccauggucaccgugagcucc

SEQ ID NO: 9960 - RNA, 432 nt, Artificial Sequence
  derived and/or modified sequence opt1 from anti-HIV_cap256-038-074413_VR-Chain
caggugcagcuggucgagagcggcgggggcguggugcagcccgggggcucccuccgccugagcugcgccgccuccggguucaccuucagcaccuacggcaugcacuggguccggcagccgcccggcaaggggcuggaguggguggcguucauccgcuacgacggcuccaacacguacuacgccgacagcgugaaggggcgguucaccaucucccgcgacaacagcaagaacacccucuaccugcagaugaacucccugcgggccgaggacaccgccgucuacuacugcgccaaggaccucggcgagagcgagaacgaggagugggcguccgacuacuacgacuucgggcgcgacuaccccggccaggacccccggggcguggugggggucuucgacaucuggggccaggggacgauggugaccgugagcucc

SEQ ID NO: 9961 - RNA, 432 nt, Artificial Sequence
  derived and/or modified sequence opt1 from anti-HIV_cap256-038-073153_VR-Chain
caggugcagcuggucgagagcggcgggggcguggugcagcccgggcgcucccuccggcugagcugcgccgccuccggcuucaccuucagcuccuacgggaugcacuggguccgccaggcgccgggcaagggccuggaguggguggcccucaucagcuacgacgggaccaacaaguacuacgccgacuccgugaagggccgguucacgaucagccgcgacaacuccaagaacacccuguuccugcagaugaacagccuccgggccgaggacaccgcccuguacuacugcgcgaaggaccugggggaguccgagaacgaggagugggccagcgacuacuacgacuucggccgcgacuaccccgggcaggacccccggggcgucgugggcaccuucgacaucugggggcagggcacgauggugaccgucuccagc

SEQ ID NO: 9962 - RNA, 432 nt, Artificial Sequence
  derived and/or modified sequence opt1 from anti-HIV_cap256-038-064227_VR-Chain
gaggugcaggucguggagagcggcgggggccuggugcagcccgggggcucccuccgccugagcugcgccgccuccggguucaccuucagcaacuacuggauguccuggguccggcaggcgccgggcaagggccuggaguggguggccgugaugagcuucuccgggagcggcuccuacuacgccgacagcgucaaggggcgcuucaccaucuccagcgacgacuccaugaacacgguguaccuccagaugaacagccugcgggccgaggacaccgccguguacuacugcgcgaaggaccugggcgagcgcgagaacgaggagugggccuccgacuacuacgacuucgggcgggacuaccccggccaggacccccgcggcgucguggggagcaucgacaccuggggccacgggaccauggugacggucuccagc

SEQ ID NO: 9963 - RNA, 432 nt, Artificial Sequence
  derived and/or modified sequence opt1 from anti-HIV_cap256-038-061640_VR-Chain
caggugcagcuggucgagagcggcgggggcguggugcagcccgggcgcucccuccggcugagcugcaccgccucccgcuucagcuucaacaacuacgccaugcacuggguccggcaggcgccgggcaaggggcuggaguggguggccaucaucuccaaggacggcagcgacaacuccuacguggacagcgucaagggccgcuucaccaucucccgggacaacagcaagaacacgcucuaccugcagaugaacucccugcgcgccgaggacaccgccguguacuacugcgcccgggaccucggggagagcgagaacgaggaguggcccuccgacuacuacgacuucggccgcgacuaccccgggcaggacccccggggcgugaucgggaccuucgacgucuggggccagggcaccauggugacggugagcucc

SEQ ID NO: 9964 - RNA, 414 nt, Artificial Sequence
  derived and/or modified sequence opt1 from anti-HIV_cap256-038-059482_VR-Chain
cgcggcgugcagugccagguccagcugguggagagcgggggcggggugguccagcccggcuucaccuucuccagcuacgugaugcacugggugcggcaggccccggggaagggccucgagugggucgccgacaucuccuacgacggcagcaacaaguacuacgcggacuccgugaaggggcgccugaccaucagccgggacaacuccaagaacacgcuguaccuccagaugaacagccugcgcgccgaggacaccgccguguacuacugcgucaaggaccugggcgaguccgagaaggaggaguggcccagcgacuacuacgacuucgccaccggguaccccgugcaggacccccgggccguggucggcgcguucgacaucugggggcagggcaccauggugacgguguccccg

SEQ ID NO: 9965 - RNA, 432 nt, Artificial Sequence
  derived and/or modified sequence opt1 from anti-HIV_cap256-038-054000_VR-Chain
gaggugcagcuggucgagagcggcggguccguggugcggcccggcgggagccuccggcuguccugcgccgccagcggcuucaccuucgacgacuccgggaugagcuggguccgccagggcccgggcaaggggcuggaguggguggcggugaucuccuacgacggcgggaacaaguacuacgccgacagcgucaagggccgguucaccaucucccgcgacaacagcaagaacacgcucuaccugcagaugaacucccugcgggccgaggacaccgcccucuacuacugcgccaaggaccugggggagagcgagaacgaggagugggcguccgacuacuacgacuucggccgcgacuaccccggccaggacagccgcgggguggugggcaccuucgacgucugggggcagggcaccauggugacgguguccagc

SEQ ID NO: 9966 - RNA, 432 nt, Artificial Sequence
  derived and/or modified sequence opt1 from anti-HIV_cap256-038-050554_VR-Chain
gaggugcagcugcucgagagcggcggggaccugguccaguccggcgggagccugcgccucuccugcguggccagcggcuucaccuucuccacccacgccaugacgugggugcggcaggcgcccgggaagggccuggagugggucgccgugaucagcuccgacggcagcaacaagaacuucgccgacuccgugaaggggcgcuucaccaucagccgggacaacuccaagaacacccuguaccuccagaugaacagccugcgcccggaggacaccgccgucuacuacugcgccaaggaccugggcgaguccgagaacgaggagugggcgacggacuacuacgacuucagcaccggguaccccgugcaggacccccgggccguggucggcgccuucgacaucugggggcagggcaccauggugaccguguccagc

SEQ ID NO: 9967 - RNA, 432 nt, Artificial Sequence
  derived and/or modified sequence opt1 from anti-HIV_cap256-038-044256_VR-Chain
caggugcagcuggucgagagcggcgggggcguggugcagcccgggcgcucccuccggcugagcugcgccgccuccggcuucaccuucagcuccuacgcgaugcacuggguccgccaggccccggggaagggccuggaguggguggccgugaucagcuacgacggcuccaacaaguaccacgccgggagcgucaagggccgguucaucaucucccgcgacaacagcaagaacacccucuaccugcagaugaacucccugcgggccgaggacacggcgcucuacuacugcgccaaggaccugggggagagcgagaacgaggagugggccuccgacuacuacgacuucggccgcgacuaccccgggcaggacccccggggcguggugggcaccuucgacaucugggggcagggcaccauggucaccgugagcucc

SEQ ID NO: 9968 - RNA, 432 nt, Artificial Sequence
  derived and/or modified sequence opt1 from anti-HIV_cap256-038-040944_VR-Chain
caggugcagcuggucgagagcggcgggggcguggugcagcccgggcgcucccuccggcugagcugcgccgccuccggcuucaccuucagcaacuacgcgauggacuggguccgccaggccccggggaagggccuggaguggguggccgugaucuccuacgacggcagcaacaaguacuacgccgacuccgucaaggggcgguucaccaucagccgcgacaacuccaagaacacgcucuaccugcagaugaacagccugcgggccgaggacaccgcgguguacuacugcgccaaggaccucggcgaguccgagaacgaggagugggccaccgacuacuacgacuucagcaccggguaccccggccaggacccccgcgccguggucggggcguucgacaucuggggccagggcacgauggugaccguguccagc

SEQ ID NO: 9969 - RNA, 432 nt, Artificial Sequence
  derived and/or modified sequence opt1 from anti-HIV_cap256-038-040090_VR-Chain
caggugcagcuggucgagagcggcgggggcguggugcagcccgggcgcucccuccggcugagcugcgccgccuccggcuucagcuucuccaacuacgcgauggacuggguccgccaggccccggggaagggccuggaguggguggccgugaucagcuccgacggcagcaacaagaacuacgccgacuccgucaaggggcgguucaccaucagccgcgacaacuccaagaacacccucuaccugcagauggacagccugcgggccgacgacacggcgguguacuacugcgccaaggaccucggcgaguccgagaacgaggagugggccaccgacuacuacgacuucagcaucggguaccccgugcaggacccccgcggcgucguggggaucuucgacaucuggggccagggcaccauggugaccgucuccagc

SEQ ID NO: 9970 - RNA, 432 nt, Artificial Sequence
  derived and/or modified sequence opt1 from anti-HIV_cap256-038-032874_VR-Chain
caggugcagcuggucgagagcggcgggggcguggugcagcccgggggcucccuccgccugagcugcgccgccuccggguucaccuucagcuccuacggcaugcacuggguccggcaggcgccgggcaaggggcuggaguggguggccuucauccgcuacgacggcaacaacaaguacuacgccgacagcgugaaggggcgguucaccaucucccgcgagaacagcaagaacacgcucuaccugcagaugaacucccugcgggccgaggacaccgccgucuaccacugcgcgaaggaccucggcgagagcgagaaggaggagugggccuccgacuacuacgacuucgggcgcgacuaccccggccaggacccccggggcgugguggggaccuucgacaucuggggccacgggaccauggucacggugagcucc

SEQ ID NO: 9971 - RNA, 432 nt, Artificial Sequence
  derived and/or modified sequence opt1 from anti-HIV_cap256-038-025899_VR-Chain
caggugcagcuggucgagagcggcgggggcguggugcagcccgggcgcucccuccggcugagcugcgucgccuccggcuucaccuucagcaacuacgccauguacugggugcgccaggcgccggggaagggccuggagugggugaccaucaucuccuucgacggcagcaaccaguacuacgccgacuccgucaaggggcgguucacgaucagccgcgagaacuccaagaacacccucuaccugcagaugaacagccugcgggccgaggacaccgccguguacuacugcgccaaggaccucggcgagcgcgagaacgaggagugggcguccgacuacuacgacuucgggcgggacuaccccggccaggacccccgcgggguggucggcagcaucgacaccuggggccacgggacgauggugaccguguccagc

SEQ ID NO: 9972 - RNA, 432 nt, Artificial Sequence
  derived and/or modified sequence opt1 from anti-HIV_cap256-038-024581_VR-Chain
cacauccagcugguggagagcggcgggggcgucgugcagcccgggggcucccuccgccugagcugcgccgccuccggguucccguucagcuccuucggcaugcacugggugcggcagacccccggccgcgggcuggagugggucgcgaucaucuggagcgacggcucccacaaggaguacaccgacagcgugaaggggcgguucacgaucucccgcgacaacagccgguccaccauggaccuccagaugaacaaccugcgccccgaggacaccgccguguacuacugcgccaaggaccugggcgagcgggagaacgaggagugggccagcgacuacuacgacuucgggcgcgacuaccccggccaggacccgcggggcgucgugggguccaucgacaccuggggccacgggacgauggugaccgucagcucc

SEQ ID NO: 9973 - RNA, 432 nt, Artificial Sequence
  derived and/or modified sequence opt1 from anti-HIV_cap256-038-013345_VR-Chain
caggugcagcuggucgagagcggcgggggcguggugcagcccgggcgcucccuccggcugagcugcgccgucuccggcuucaccuucagcuccuacgggaugcacugggugcgccaggccccgggcaagggccuggaguggguggcggccaucagcuacgacggguccaacaaguacuacgucgacagcgugaagggccgguucaccaucucccgcgacaacagcaagaacacgcucuaccugcagaugaacucccugcgggccgaggacaccgccguguacuacugcgcccgcgaccucggggagcgggagaucgaggagugggcgaccgacuacuacgacuucagcaucggcuaccccgggcaggacccccgcggcgucgugggcguguucgacaucugggggcagggcaccauggucacgguguccagc

SEQ ID NO: 9974 - RNA, 438 nt, Artificial Sequence
  derived and/or modified sequence opt1 from anti-HIV_cap256-038-011559_VR-Chain
caggugcagcuggucgagagcggcgggggcguggugcagcccgggcgcucccuccggcugagcugcgaggccuccggcuucaccuucagcuccuacgggauggacuggguccgccaggccccgggcaagggccuggaguggguggcgcucaucagccacgacggguccaacaagcacuacgccgacagcgugaagggccgguucaccaucucccgcgacaacagccggaacacgcuguaccugcagaugaacucccuccgcgccgaggacaccgcccuguacuacugcgccaaggaccugggggagagcgagaacgaggacgaggagugggcguccgacuacuacgacuucggccgggacuaccccgggcaggacagccgcggcgucgugggcaccuucgacaugugggggcagggcaccauggugacggucuccagc

SEQ ID NO: 9975 - RNA, 432 nt, Artificial Sequence
  derived and/or modified sequence opt1 from anti-HIV_cap256-038-009634_VR-Chain
caggugcagcuggucgagagcggcgggggcguggugcagcccgggcgcucccuccggcugagcugcgccgccuccggcuucaccuucaccagcuucgggaugcacuggguccgccaggcgccgggcaagggccuggaguggguggccgugaucuccuacgacgggaacaacaaguacuacgccgacagcgucaagggccgguucacgaucucccgcgagaacagcaagaacacccucuaccugcagaugaacucccugcgggccgaggacaccgccguguaccacugcgcgaaggaccucggggagagcgagaucgaggaguggaccuccgacuacuacgacuucggccgcgacuaccccgggcaggacccccggggcguguucggcacguucgacaucugggggcacggcaccauggucaccgugagcucc

SEQ ID NO: 9976 - RNA, 432 nt, Artificial Sequence
  derived and/or modified sequence opt1 from anti-HIV_cap256-038-006730_VR-Chain
caggugcagcuggucgagagcggcgggggcguggugcagcccgggcgcucccuccggcugagcugcgccgccuccggcuucaccuucagcuccuucgggaugcacuggguccgccaggcgccgggcaagggccuggaguggguggccgugaucagcaaggacggguccgacaacagcuacgucgacuccgugaagggccgguucaccaucagccgcgacaacuccaagaacacgcucuaccugcagaugaacagccugcgggccgaggacaccgccguguacuacugcgcccgcgaccucggggaguccgagaacgaggaguggcccagcgacuacuacgacuucggccgggacuaccccgggcaggacccccgcggcgucaucggcaccuucgacgugugggggcagggcaccauggugacggucuccagc

SEQ ID NO: 9977 - RNA, 432 nt, Artificial Sequence
  derived and/or modified sequence opt1 from anti-HIV_cap256-038-004887_VR-Chain
caggugcagcuggucgagagcggcgggggcguggugcagcccgggcgcucccuccggcugagcugcgccgccuccggcuucagcuucuccaccagcgggaugcacuggguccgccaggcgccgggcaagggcauggaguggguggccgugaucuccuacgacgggagcaacaaguacuacgccgacuccgucaagggccgguucaccaucagccgcgacaacuccaagaacacgcuguaccuccagaugaacagccugcgggccguggacaccgccguguacuacugcgcgaaggaccugggggagggcgagaacgaggagugggccaccgacuacuacgacuucuccaucggguaccccguccagaacccccgcggccucgugggcgccuucgacaucugggggcagggcaccauggugacggucagcucc

SEQ ID NO: 9978 - RNA, 432 nt, Artificial Sequence
  derived and/or modified sequence opt1 from anti-HIV_cap256-038-004840_VR-Chain
caggugcagcuggucgagagcggcgggggcguggugcagcccgggcgcucccuccggcugagcugcgccgccuccggcuucaccuucagcuccuucgggaugcacuggguccgccagagcccgggcaagggccuggaguggguggcggugaucuccuacgacgggaacaacaaguacuacgccgacagcgucaagggccgguucaccaucucccgcgagaacagcaagaacacgcucuaccugcagaugaacucccugcggaccgacgacaccgccguguacuacugcgccaaggaccucggggagagcgagaccgaggaguggcccuccgacuacuacgacuucggccgcgacuaccccgggcaggacccccggggcguggucggcacguucgacaucugggggcacggcaccauggugaccgugagcucc

SEQ ID NO: 9979 - RNA, 432 nt, Artificial Sequence
  derived and/or modified sequence opt1 from anti-HIV_cap256-038-002181_VR-Chain
gaggugcagcuggucgagagcggcgggggccucgugcagcccgggcgcucccugcggcugagcugcgccgccuccggcuucaccuucgaggacuacgcgaugcacugggugcgccaggccccggggaagggccucgagugggucgccgugaucagcuacgacggcuccaacaaguacuacguggacagcgucaaggggcgguucaccaucucccgcgacaacagcaagaacacgcuguaccugcagaugaacucccuccgggccgaggacaccgccguguacuacugcgcgaaggaccugggcgagagcgagaacgaggagugggccaccgacuacuacgacuucuccaucggguaccccggccaggacccccgcgggguggucggcaucuucgacaucuggggccaggggaccauggugacggugagcucc

SEQ ID NO: 9980 - RNA, 432 nt, Artificial Sequence
  derived and/or modified sequence opt1 from anti-HIV_cap256-038-001902_VR-Chain
caggugcagcuggucgagagcggcgggggcguggugcagcccgggcgcucccuccggcugagcugcgccgccuccggcuucaccuucagcuccuucgggaugcacuggguccgccaggcgccgggcaagggccuggaguggguggccgugaucagcuacgacgggaacaacaaguacuacgccgacuccgucaagggccgguucaccaucagccgcgagaacuccgagaacacgcucuaccugcagaugaacagccugcgggccgacgacaccgccguguacuacugcgcgaaggaccucggggaguccgagaacgaggagugggccagcgacuacuacgacuucggccgcgacuaccccgggcaggacacccggggcguggucggcaccuucgacaucugggggcacggcacgauggugaccguguccagc

SEQ ID NO: 9981 - RNA, 432 nt, Artificial Sequence
  derived and/or modified sequence opt1 from anti-HIV_cap256-038-000976_VR-Chain
caggugcagcuggucgagagcggcgggggcguggugcagcccgggcgcucccuccggcugagcugcgccgccuccggcuucaccuucagcuccuucgggaugcacuggguccgccaggcgccgggcaagggccuggaguggguggccgugaucagcgacgacgggaacaacaaguacuacgccgacuccgucaagggccgguucaccaucagccgcgacaacuccaagaacacgcucuaccugcagaugaacagccugcggguggaggacaccgccguguacuacugcgucaaggacgugggggaguccgagaacgaggagugggccagcgacuacuacgacuucggccgcgacuaccccgggcaggacacccgggcgguggucggcgccuucgacaucuggggccaggggaccauggugacgguguccagc

SEQ ID NO: 9982 - RNA, 432 nt, Artificial Sequence
  derived and/or modified sequence opt1 from anti-HIV_cap256-038-000384_VR-Chain
caggugcagcuggucgagagcggcgggggcguggugcagcccgggaagucccuccgccugagcugcgccgccuccggcuucaccuucagcuccuacgucaugcacugggugcggcaggcgccggggaagggccuggaguggguggccgacaucagcuacgacggcuccaacaaguacuacgccgacagcgucaaggggcgccucaccaucucccgggacaacagcaagaacacgcuguaccugcagaugaacucccuccgcgccgaggacaccgccguguacuacugcgugaaggaccugggcgagagcgagaaggaggaguggcccuccgacuacuacgacuucgggcgggacuaccccggccaggacagccgcggggucgugggcguguucgacaucuggggccaggggaccauggucaccguguccagc

SEQ ID NO: 9983 - RNA, 321 nt, Artificial Sequence
  derived and/or modified sequence opt1 from anti-HIV_206-314431_VR-Chain
caguucgugcugacccagcccccgagcgucuccgccgcccccggccagaacgugaccaucagcugcuccgggccgcccagccacaucgagaagaacgacguguccugguaccagcgccuccccggcauggcgcccaagauggucaucuacgagagccggcgccggccccuggggauccccgugcgcuucacggccucccggagcggcuccagcgccacccuggugaucaccgggcuccagaccgccgacgaggccgacuacuacugcggcacgugggacggccgcaugaacuucgggaccggcaccaccgucacggugcug

SEQ ID NO: 9984 - RNA, 321 nt, Artificial Sequence
  derived and/or modified sequence opt1 from anti-HIV_206-247594_VR-Chain
cagagcauccugacccagcccccguccgugagcgccgcccccggccagaacgucaccaucuccugcagcgggccgcccucccacaucgagaagaacgacgugagcugguaccagcgcuuccccggcauggcgcccaagaugaucaucuacgaguccaagcggcgccccuucggggugcccggccgguucagcgccucccgcagcgggaaguccgccacgcucgccaucaccggccugcagaccggcgacgaggccgacuacuacugcgggaccugggacggccggaugaacuucgggacgggcaccaccgucaccgugcug

SEQ ID NO: 9985 - RNA, 321 nt, Artificial Sequence
  derived and/or modified sequence opt1 from anti-HIV_206-116890_VR-Chain
cagagcgugcugacccagcccccguccgucagcgccgcccccggccagaacgugaccaucuccugcagcgggccgcccucccacaucgagaagaacgacgugagcugguaccagcaccuccccggcgaggcgcccaagaugaucaucuacgaguccuggcgccggcccgccgggauccccgcccgcuucagcgccucccggagcggcaaguccgggacgcuggccaucaccggccugcagaccggcgacgaggcggacuacuacugcgggaccuggaacggccgcaugaacuucgggacgggcaccaccgucaccgugcuc

SEQ ID NO: 9986 - RNA, 333 nt, Artificial Sequence
  derived and/or modified sequence opt1 from anti-HIV_206-072383_VR-Chain
cagagcgugcugacccagcccccguccgucagcgccgcccccggccagcgcgugaucaucuccugcagcgggaacaacuccaccaucggcaacaacuucgugagcugguaccagcagguccccgggacggcgcccaagcuccugaucuacgagaccaaccggcgcccguccggcauccccgaccgguucagcggguccaagagcggcaccuccgccacccuggccaucagcggccuccagacgggggacgaggccgacuucuacugcaccguguggggcgugcgcaagggggucgccgcgguguucggcaccgggacccggcugacggugcug

SEQ ID NO: 9987 - RNA, 333 nt, Artificial Sequence
  derived and/or modified sequence opt1 from anti-HIV_206-037527_VR-Chain
cagagcgugcugacccagcccccguccgucagcgccgcccccggccagaaggugaucaucuccugcagcgggaacaacuccaccaucggcaagauccucgugagcugguaccagcagguccccgggacggcgcccaagcuggugaucuacgagaccaaccgccggccguccggcauccccgaccgcuucagcggguccaagagcggcaccuccgccacccuggccaucacgggccuccagaccggggacgaggccgacuacuucugcaagguguggggcguccggaaggggguggccgcgguguucggcaccgggaccaaggucacggugcug

SEQ ID NO: 9988 - RNA, 333 nt, Artificial Sequence
  derived and/or modified sequence opt1 from anti-HIV_206-009095_VR-Chain
cagagcgugcugacccagcccccguccgucagcgccgcccccgcgcagcgcgugaucaucuccugcagcggcgacaacuccaccaucgggaacaacuucgugagcugguaccagcagguccccggcgccgcccccaagcuccugaucuacgagacgaaccggcgcccguccgggauccccgaccgguucagcggcuccaagagcgggaccaccgccacccuggccaucuccggccuccagacgggcgacgaggcggacuaccacugcaccguguggggcgugcgcaagggggucgccgccguguucgggaccggcaccaaggugacgguccug

SEQ ID NO: 9989 - RNA, 321 nt, Artificial Sequence
  derived and/or modified sequence opt1 from anti-HIV_176-503620_VR-Chain
cagagcgugcugacccagcccccguccgucagcaccgcccccggccagacggugaccguguccugcagcgggggcaccuccaacaccgggaacaacuucgucagcugguaccagcaccuccccggcacggcccccaagcugcugaucuacgagaacaacaagcgcccgcucggggugcccgaccgguucuccggcgccaagagcggcaccuccgcgacccuggcccugaccgggcuccagacgggcgacgagggggacuacuacugcgccaccuggagcggcucccugaacaucgggaccggcaccaaggugagcguccug

SEQ ID NO: 9990 - RNA, 321 nt, Artificial Sequence
  derived and/or modified sequence opt1 from anti-HIV_176-478726_VR-Chain
cagagcgugcugacccagcccccguccgucagcgccgcccccggccagaacgugaacaucuccugcagcgggccgcccucccacaucgagcgcaacgacgugagcugguaccagcaccuccccggcgcggcccccaagaugaucaucuacgaguccuggcggcgccccgccgggauccccgaccgguucagcgccucccgcagcggcgccuccgcgacccuggccaucacggggcugcagaccggcgacgaggccgacuacuacugcggcaccuggaacgggcggaugaacuucggcaccgggacgaccgucaccgugcuc

SEQ ID NO: 9991 - RNA, 321 nt, Artificial Sequence
  derived and/or modified sequence opt1 from anti-HIV_176-245056_VR-Chain
cagagcgugcugacccagcccccguccgucagcgccgcccccggccagaacgugaccaucuccugcagcgggccgcccucccacaucgagaagaacggcgugagcugguaccagcaguuccccgggauggcgcccaagauggucaucuacgaguccaagcgccggcccuucggcgugcccgcccgcuucagcgccucccggagcgggaaguccgccacgcucgccaucaccggccugcagaccggcgacgaggcggacuacuacugcgggaccugggacggccgcaugaacuucgggacgggcaccaccgugaccguccug

SEQ ID NO: 9992 - RNA, 321 nt, Artificial Sequence
  derived and/or modified sequence opt1 from anti-HIV_176-164413_VR-Chain
cagagcgugcugacccagcccccguccgucagcgccgcccccggccagaaggugaccaucuccugcagcgggggcacguccaacaucgggaacaacuacgugagcugguaccagcgccuccccggcaccgcgcccaagcugcugaucuacgagaacaacaagcggccguccgggauccccgaccgcuucagcggccccaaguccggcaccagcgccacccucgccaucacggggcugcagcccggcgacgaggccgacuacuacugcgccaccugguccgggagccugaacuucggcaccgggaccaaggucacggugcuc

SEQ ID NO: 9993 - RNA, 333 nt, Artificial Sequence
  derived and/or modified sequence opt1 from anti-HIV_176-094308_VR-Chain
cagagcgugcugacccagcccccguccgucagcgccgcccccggccagaaggugaucaucuccugcagcgggaacaacuccaccaucggcaacaacuucgugagcugguaccagcagguccccgggacggcgcccaagcuccugguguacgagaccuaccgccggccguccggcauccccgaccgcagcuccgggagcaaguccggcaccaccgccacgcaggccaucagcggccugcagaccggggacgaggccgacuaccacugcaccguguggggcguccggaaggggguggccgcgguguucggcaccgggacgaaggucaccgugcuc

SEQ ID NO: 9994 - RNA, 333 nt, Artificial Sequence
  derived and/or modified sequence opt1 from anti-HIV_176-065321_VR-Chain
cagagcgugcugacccagcccccguccgucagcgccgcccccggccgccgggugaucaucuccugcagcgggaacaacuccaccaucggcaacaacuucgugagcugguaccagcagguccccgggacggcgcccaagcuccugguguacgagaccaaccgccggccguccggcauccccgaccgcuucagcggguccaagagcggcaccuccgccacccuggccaucagcggccuccagacgggggacgaggccgacuacuacugcaccguguggggcguccggaaggggguggccgcgguguucggcaccgggaccaaggucacggugcug

SEQ ID NO: 9995 - RNA, 324 nt, Artificial Sequence
  derived and/or modified sequence opt1 from anti-HIV_119-099719_VR-Chain
cagagcgugcugacccagcccccguccgucagcgccgcccccggccagaaggugaccaucuccugcagcggguccaacagcuacaucggcaacaaguacaucuccugguaccagcaguuccccgggacggcgcccaagcuccugaucuacgagaacaacaagcgcccgagcggcgugcccgaccgguucuccgccagcaaguccgccaccagcgccacccuggccaucaccgggcuccacacgggcgacgaggcggacuacuacugcgagaccugcgacggcuccgggggcgucuucgggaccggcaccaaggugacggugcug

SEQ ID NO: 9996 - RNA, 327 nt, Artificial Sequence
  derived and/or modified sequence opt1 from anti-HIV_119-099536_VR-Chain
gagcugacccagcccccgagcguguccgccgccagcggccagaacgucaacaucuccugcagcgggggcuccagcaacaucggguccaacuacgugagcugguaccagcaguuccccggcaccgcgcccaagcuccugaucuacgagacgaacaagcgccccuccgggaucccggaccgguucagcggcuccaagagcggcgccuccgccacccuggccaucaccgggcuccagaccggcgacgaggccgacuacuacugcgcgacgugggccgacagccugaacuccgcccgcguguucgggaccggcaccaaggucaccgugcug

SEQ ID NO: 9997 - RNA, 333 nt, Artificial Sequence
  derived and/or modified sequence opt1 from anti-HIV_119-098907_VR-Chain
cagagcgugcugacccagcccccguccgucagcgccacccccggccagaaggugacgaucuccugcagcggguccaacagcaacaucggcgacaaguacguguccugguaccagcacuuccccgggaccgcccccaagcuccuggucuacgagaccuaccgccggccgagcggcauccccgaccgcuucuccgggagcaaguccggcaccagcgcgacgcuggccaucaccggccuccagaccggggacgaggccgacuacuacugcaccaucuggggcgugcggaagggggugggcgccgucuucgggacgggcaccaaggugaucgugcug

SEQ ID NO: 9998 - RNA, 324 nt, Artificial Sequence
  derived and/or modified sequence opt1 from anti-HIV_119-098555_VR-Chain
cagagcgugcugacccagcccccguccgucagcgccgcccccggccagaacgugaccaucuccugcagcggguccgcgagcaacaucggcaagaacuucguguccugguaccagcagcuccccgggacggcccccaagcugcugaucuacggcagcaacaaccgcccguccgggguccccgaccgguucagcggcuccaagagcggcaccuccgccagccucgccaucaccgggcugcagaccggcgacgaggccgacuacuacugcgagacgugggacggguccggcgcgguguucgggaccggcaccaaggugaccguccug

SEQ ID NO: 9999 - RNA, 324 nt, Artificial Sequence
  derived and/or modified sequence opt1 from anti-HIV_119-097828_VR-Chain
cagagcgugcugacccagcccccguccgucagcgccgcccccggccagaaggugaccaucuccugcagcggguccagcuccaacaucggcaagaacuacgugagcugguaccagcuccugcccgggacggcgccccgccuggucaucuacgagaacgacgagcggccguccggcacccccgaccgcuucagcggguccaagagcggcaccuccgccacccucgccaucacgggccugcacaccggggacgaggccgacuacuacugcgagaccugggacggcagcgggggcguguucgggaccggcacgaaggugaccguccug

SEQ ID NO: 10000 - RNA, 324 nt, Artificial Sequence
  derived and/or modified sequence opt1 from anti-HIV_119-096480_VR-Chain
cagagcgugcugacccagcccccguccgucagcggcgcccccgggcagcgcaucaccaucuccugcagcggcuccacgagcaacaucgggcagaacuacguguccugguaccagcagcuccccggcaccgcccccaagcugcugaucagcgacaacaaccggcgcccguccuggacccccgaccgguucagcggguccaagagcggcaccuccgcgacgcucgccaucaccggccugcagaccggggacgaggccgacuacuacugcgagaccugggacggcagcgggggcguguucgggcccggcacgcgcgucaccgugcug

SEQ ID NO: 10001 - RNA, 324 nt, Artificial Sequence
  derived and/or modified sequence opt1 from anti-HIV_119-095664_VR-Chain
cagagcgugcugacccagcccccguccgucagcgccgcccccggccagaaggugaccaucuccugcagcgggggcgcggccaacaucgggaagaacuccgugagcugguaccagcagcuccccggcacggcccccaagcugcugaucuacgacaacaaccgccggccguccgggacccccgaccgcuucagcggcuccaagagcggcaccuccgccacccucgccaucagcgggcugcagacgggcgacgaggcggacuacuacugcgagaccuggcacggguccggcggggucuucggcaccggcaccaaggugacggugcug

SEQ ID NO: 10002 - RNA, 321 nt, Artificial Sequence
  derived and/or modified sequence opt1 from anti-HIV_119-095212_VR-Chain
cagagcgugcugacccagcccccguccgucagcgccgcccccggccagaaggugaccaucuccugcagcggguccacgagcaacaucggcaaguccgacguguucugguaccagcagcuccccgggaccgcgcccaagcugcugaucagcgagaccucccgccggccgagcggcauccccgaccgcuucuccggggccaagagcggcaccuccgccacgcucgccaucaccggccugcagaccggggacgaggccgacuacuucugcagcaccugguccggcagccugaacuucgggacgggcacccgggucaccgugcuc

SEQ ID NO: 10003 - RNA, 333 nt, Artificial Sequence
  derived and/or modified sequence opt1 from anti-HIV_119-094773_VR-Chain
cagagcgugcugacccagucccccaccgucagcgccgccccgggccagacggugaccaucuccugcagcgggggcaccuccaacguggggaagaacuucgucagcugguaccagcaguucccccgcaccgcgcccaagcuccugaucuacgagaacaacaagcggcccuccggcaucccggaccgcuucagcggguccaagagcggcacguccgccacccuggugaucaccggccuccagaccggggacgaggccgacuucuacugcggcacgugggacgggagccugcggaccggcggggugaucggcaccggcacccgcgucacggugcug

SEQ ID NO: 10004 - RNA, 324 nt, Artificial Sequence
  derived and/or modified sequence opt1 from anti-HIV_119-094508_VR-Chain
cagagcgugcugacccagcccccguccgucagcgccacccccggccagcgcgugacgguguccugcagcggguccagcuccaacaucggcaaccacuacgucagcugguaccagcagguccccgggaccgcccccaagcuccugaucuccgagaacagccggcgcccguccggcacccccgaccgguucagcggguccaagagcggcaccuccgcgacgcuggccaucaccggccuccagaccggggacgaggccgacuacuacugcgagaccugggacggcagcgggggcguguucgggacgggcaccaaggugaccgugcug

SEQ ID NO: 10005 - RNA, 324 nt, Artificial Sequence
  derived and/or modified sequence opt1 from anti-HIV_119-093795_VR-Chain
cagagcgugcugacccagcccccguccgucagcgccgcccccggccagaaggugaccaucuccugcagcggguccagcuccaacaucggcaacaacuacgugagcugguaccaguaccuccccgggacggcgcccaagcugcugaucuccgagaacaaccgccggccgagcggcacccccgaccgcuucuccgggagcaaguccggcaccagcgccacccucgccaucacgggccugcagaccggggacgaggccgacuacuacugcgagaccugggacggcuccgggggcgucuucgggaccggcacgaaggugaccgugcug

SEQ ID NO: 10006 - RNA, 321 nt, Artificial Sequence
  derived and/or modified sequence opt1 from anti-HIV_119-093732_VR-Chain
cagagcgugcugacccagcccccguccgucagcgccgccgcgggccagaacgugaacaucuccugcagcgggcgcaaguccaacgugggcgggaacuacgucagcugguaccagcaguuccccggcaccgcccccaagcuccugaucuacgaggacaacaagcggcccuccuggaucccggaccgcuucacggccagccgguccgggaccagcgccacccugggcaucaccggccuccagacgggggacgaggccgacuacuucugcuccaccuggagcggcucccugaacuucgggaccggcacccgcgugacggugcug

SEQ ID NO: 10007 - RNA, 333 nt, Artificial Sequence
  derived and/or modified sequence opt1 from anti-HIV_119-092903_VR-Chain
cagagcgugcugacccagcccccguccgucagcgccgcgccccgccagaaggugaccaucuccugcagcggcuccagcuccaacaucgggaaccacuacgugagcugguaccagcagcuccccggcacggcccccaagcugcugaucuacgagaacaacaagcggccguccgggauccccgaccgcuucagcggcuccaagagcgggaccuccgccacccucgccaucaccggccugcagacgggcgacgaggccgacuacuacugcgccaccugggcgccccggcugaacagcgcccgcgucuucgggaacggcaccauggugaccgugcuc

SEQ ID NO: 10008 - RNA, 333 nt, Artificial Sequence
  derived and/or modified sequence opt1 from anti-HIV_119-092284_VR-Chain
cagagcgugcugacccagcccccguccgucagcggcgcccccgggcagcgcgugaccaucuccugcacgggcagcuccagcaacaucgggggcuacgacgugcacugguaccagcagguccccgggaccgcccccaagcuccugcuguacgagaacgaccggcgcccguccggcauccccgaccgguucagcggcuccaagagcgggaccuccgcgacccucgugaucacgggccugcagaccggggacgaggccgacuucuacugcggcaccugggacgggagccugcgcaccggcggcgugaucgggacgggcacccgggucaccgugcuc

SEQ ID NO: 10009 - RNA, 333 nt, Artificial Sequence
  derived and/or modified sequence opt1 from anti-HIV_119-091586_VR-Chain
cagagcgugcugacccagcccccguccaugagcgccgcccccggccagcgggucaccaucuccugcagcgggacguccagcgacaucggccggaacuacguguccugguaccagcaguuccccggggcggcccccaaggugcucaucuacgagaacagcaaccgcccguccggcauccccgaccgguucagcggguccaagagcggcaccuccgccacccuggccaucagcggccugcagaccggggacgaggccgacuacugcugcgcggucuggggcgugcgccgcggggccggcgccguguucggggccggcacgaaggucaccgugcuc

SEQ ID NO: 10010 - RNA, 333 nt, Artificial Sequence
  derived and/or modified sequence opt1 from anti-HIV_119-091023_VR-Chain
cagagcgugcugacccagcccccguccgucagcgccgcccccggccagcgcgugaccaucuccugcagcggguccacgagcaacaucggcaacaacuucguguccugguaccaccacguccccgggaccgcgcccaagcuccugaucuacgacaacgugaagcggccgaccaacgugcccgaccgcuucagcggcuccaagagcgggaccuccgccacgcuggccaucagcggccuccagaccggcgacgaggccgacuacuggugcgccgucuggggcgugcggcgcggggcgggggccguguucggcgccgggaccaaggucaccgugcug

SEQ ID NO: 10011 - RNA, 333 nt, Artificial Sequence
  derived and/or modified sequence opt1 from anti-HIV_119-090334_VR-Chain
cagagcgugcugacccagcccccguccgucagcggcgcccccgggcagcgcgugaccaucuccugcacgggcagcgccuccaacaucggggacagcgacgugcacugguaccagcagcuccccggcaccgcgcccaagcugcugaucuucgacaacgacaagcggccguccgggauccccgaccgcuucagcggcuccaagagcggcaccuccgccacccucgccaucacggggcugcagagcggcgacgaggccgacuacuacugcgccgucuggggcgugcggcagggggcgggggccguguucggcaccggcaccaaggucaccgugcug

SEQ ID NO: 10012 - RNA, 333 nt, Artificial Sequence
  derived and/or modified sequence opt1 from anti-HIV_119-088694_VR-Chain
cagagcgugcugacccagcccccguccgucagcgccgcccccggccagaaggugaccaucuccugcagcggguccagcuccaacauccccaucaacggcgugagcugguaccagcaguuccccgggacggcgccgaagcuccuggucuacgagaccuaccgccggcccuccggcauccccgaccgcuucagcggguccaagagcggcaccuccgccacccuggccaucacgggccuccagaccggggacgaggccgacuacuacugcaccguguggggcgugcggaagggggucggcgccguguucgggaccggcacgaaggugaccguccug

SEQ ID NO: 10013 - RNA, 333 nt, Artificial Sequence
  derived and/or modified sequence opt1 from anti-HIV_119-088499_VR-Chain
cagagcgugcugacccagcccccguccgucagcgccgcccccggccagaaggugaccaucuccugcagcggguccaacagcuacaucggcaacaaguacguguccugguaccagcaguuccccgggacggcgcccaagcuccugaucuacgagaccaacaagcgcccgagcggcauccccgaccgguucuccgggagcaaguccggcaccagcgccacccuggccaucacgggccuccagaccggggacgaggccgacuacuacugcgccaccugggcgccccgccugaacuccgcccgggucuucggcaacgggaccauggugacggugcug

SEQ ID NO: 10014 - RNA, 333 nt, Artificial Sequence
  derived and/or modified sequence opt1 from anti-HIV_119-088298_VR-Chain
cagagcgugcugacccagcccccguccgucagcgccgcccccaaggagaaggugaccaucuccugcagcggcgggacguccaacaucggccgcaacuacgugagcugguaccagcagguccccgggaccgcgcccaagcuccugaucuacgagaacaacaagcggccguccggcauccccgaccgcuucagcggguccaagagcggcaccuccgccacccuggugaucacgggccuccagaccggggacgaggccgacuucuacugcggcaccuggggcgggagccugcggaccgggggcgugcugggcacggggacccgcgucaccgugcuc

SEQ ID NO: 10015 - RNA, 324 nt, Artificial Sequence
  derived and/or modified sequence opt1 from anti-HIV_119-087488_VR-Chain
cagagcgugcugacccagcccccguccgucagcgccgcccccggccagaaggugaccaucuucugcuccgggcgcuacagcaacaucgaguccaacuacgugagcugguaccagcagcuccccggcacggcgcccaagcugcugauccacgagaacaaccggcgcccguccgggacccccgaccgguucagcggcuccaagagcgggaccuccgccacccucgccaucacgggccugcacaccggcgacgaggccgacuacuacugcgagaccugggacgggagcggcggggucuucggcaccgggacgaaggugaccgugcug

SEQ ID NO: 10016 - RNA, 333 nt, Artificial Sequence
  derived and/or modified sequence opt1 from anti-HIV_119-087423_VR-Chain
cagagcgugcugacccagcccccguccgucagcgccgcccccggccagaaggugaccaucuccugcagcgcguccagcuccaacaucgggaacaacuacgugagcugguaccagcagcuccccgccacggcccccaagcugcugaucuacgacaccgacaagcgcccguccggcauccccgaccgguucagcggguccaagagcggcaccuccgccacccucgccaucacggggcugcagaccggcgacgaggcggacuacuacugcaccgucuggggcgugcgcaagggggugggcgccgucuucgggaccggcacgaaggugaccgugcug

SEQ ID NO: 10017 - RNA, 324 nt, Artificial Sequence
  derived and/or modified sequence opt1 from anti-HIV_119-087371_VR-Chain
cagagcgugcugacccagcccccgucccucagcgccgcccccggccagcgcgucaccaucuccugcagcgggggcgcguccaacaucgggaagaacagcguguccugguacgugcagguccccggcacggcccccaagcugcugaucuacgagaacaaccagcggccgagcgggaucuccgaccgcuucagcggcuccaagagcggcuccagcgccacccucgggaucaccggccugcagaccgccgacgaggccgacuacuacugcgagacgugggacggguccggcgggguguucggcaccggcaccaaggugaccguccug

SEQ ID NO: 10018 - RNA, 321 nt, Artificial Sequence
  derived and/or modified sequence opt1 from anti-HIV_119-087279_VR-Chain
cagagcgugcugacccagcccccguccgucagcgccgcccccggccagaaggugaccaucuccugcagcggguccagcuccaacaucggcaagaacuacgugagcugguaccagcaguuccccgggacggcgcccaagcuccugauguacgagaacaacaagcgcccguccggcguccccgaccgguucagcggguccaagagcggcaccuccgccacccuggacaucagcggccuccagaccggggacgaggccgacuacuacugcuccacguggagcggcucccugaacuucgggaccggcacccgcgugaccgugcug

SEQ ID NO: 10019 - RNA, 324 nt, Artificial Sequence
  derived and/or modified sequence opt1 from anti-HIV_119-087146_VR-Chain
cagagcgugcugacccagcccccguccgucagcgccgcccccggccagaaggugaccaucuccugcagcggguccagcuccaacaucggcaagaacagcguguccugguaccagcaguuccccgggacggcgcccaagcuccugaucuacgagaacaacaagcgcccgagcggcauccccgaccgguucuccgggagcaaguccggcaccagcgccacccuggccaucaccggccuccacacgggggacgaggccgacuacuacugcgagaccugggacggcuccgggggcgucuucgggaccggcaccaaggugacggugcug

SEQ ID NO: 10020 - RNA, 324 nt, Artificial Sequence
  derived and/or modified sequence opt1 from anti-HIV_119-087048_VR-Chain
caguucgugcugacccagcccccgagcgucuccgccgcgccccgccagaaggugaucaucagcugcuccggcagcuccagcaacaucgggaagaacuacguguccugguaccagcagcuccccggcaccgcccccaagcugcugaucuacgacaacgacaagcggccgagcgggaucuccgaccgcuucagcgccuccaagagcggcacguccgccacccucgccaucaccgggcugcacaccggcgacgaggccgacuacuacugcgagacgugggacggcagcgggggcgucuucgggaccggcaccaaggugaccgugcug

SEQ ID NO: 10021 - RNA, 321 nt, Artificial Sequence
  derived and/or modified sequence opt1 from anti-HIV_119-085802_VR-Chain
cagagcauccugacccagcccccguccgugagcgccgcccccggccagcgcgucaccauccccugcuucgggggccacuccaacaucgggagcaacuacguguccugguaccagcaccuccccggcacggcgccgaagcugcugaucuucgagaacaacaagcggcccagcgggauccccgaccgcuucuccggcgccaagagcggcaccuccgccacccucgccaucaccgggcugcagacgggcgacgaggccgacuacuucugcgcgaccuggagcgggggccugaacuucgggaccggcaccaaggugacgguccuc

SEQ ID NO: 10022 - RNA, 324 nt, Artificial Sequence
  derived and/or modified sequence opt1 from anti-HIV_119-085784_VR-Chain
cagagcuuccugacccagcccccguccgugagcgccgcccccggccagaaggucaccaucuccugcagcggguccaacagcaacaucggcaacaacuacguguccugguaccaguaccuccccgggacggcgcccaagcugcugaucuacgagaacgaccgccggccgagcggcacccccgaccgcuucuccgggagcaaguccggcaccagcgccacccucgccaucacgggccugcagaccggggacgaggccgacuacuacugcgagaccugggacggcuccgggggcguguucgggaccggcacgaaggucaccgugcug

SEQ ID NO: 10023 - RNA, 333 nt, Artificial Sequence
  derived and/or modified sequence opt1 from anti-HIV_119-085370_VR-Chain
cagagcgugcugacccagcccccguccgucagcgccgcccccggccagaccgugacgaucuccugcagcggguccagcuccaacaucggcaacaccuacgugagcugguaccagcaccuccccgggaccgcgcccaagcugcugaucuacgacaacaacauccgcccguccggcauccccgaccgguucagcgccuccaagagcgggaccuccgccacgcucgccaucaccggccugcagaccggcgacgaggccgacuacuacugcgcgaccugggcccccagccugaacuccgcccgcgucuucgggagcggcacgcggguggccgugcuc

SEQ ID NO: 10024 - RNA, 321 nt, Artificial Sequence
  derived and/or modified sequence opt1 from anti-HIV_119-085276_VR-Chain
cagagcauccugacccagcccccguccgugagcgccgcccccggccagcgcgucaccaucuccugcagcggguccagcuccaacaucggcaacaacuacgugagcugguaccagcacgugcccgggacggcgcccaagcuccugaucuacgagaacaaccggcgcccguccggcacccccgaccgguucagcggggccaaguccggcaccagcgccacccuggccaucacgggccuccagaccggggacgaggccgacuacuucugcuccaccuggagcggcucccugaacuucgggaccggcacgaaggucaccgugcug

SEQ ID NO: 10025 - RNA, 333 nt, Artificial Sequence
  derived and/or modified sequence opt1 from anti-HIV_119-084885_VR-Chain
cagagcgugcugacccagcccccguccgucagcgccgcccccggcgagaaggugaccaucuccugcagcggguccagcuccaagaucggcaacaacuucgugagcugguaccagcagguccccgggacggcgcccaagcuccugguguacgaguccuaccgccggccgagcggcauccccgaccgcuucuccgggagcaaguccggcaccagcgccacccuggccaucaccggccuccagacgggggacgaggccgacuacuacugcaccguguggggcguccggaagggggugggcgccguguucgggaccggcaccaaggucacggugcug

SEQ ID NO: 10026 - RNA, 333 nt, Artificial Sequence
  derived and/or modified sequence opt1 from anti-HIV_119-084874_VR-Chain
cagagcgugcugacccagcccccguccgucagcggcgcgccccgccagcgggugaccaucuccugcagcggguccgccagcaacaucggcaagaacuccgugagcugguaccagcagguccccgggacggcccccaagcuccugaucuacgagaacaacaagcgcccguccggcauccccgaccgguucagcggguccaagagcggcaccuccgccacccuggugaucaccggccuccagacgggggacgaggccgacuucuacugcggcaccugggacgggagccugcgcaccggcggggugaucggcaccggcacgcgggucaccgugcug

SEQ ID NO: 10027 - RNA, 333 nt, Artificial Sequence
  derived and/or modified sequence opt1 from anti-HIV_119-084691_VR-Chain
cagagcgugcugacccagcccccguccgucagcgccgcccccggccagaagguggugaucuccugcagcggguccagcuccaucaucgagaagaacagcaucuccugguaccagcagggccccggggcggcccccaagcuccugaucuacgagaacgacaagcggccgagcggcauccccgaccgguucuccgggagcaaguccgccaccagcgccacgcuggccaucgucggccuccagaccggcgacgaggcggacuacugcugcgccguguggggcgugcgccgcggggccggggccgucuucggcgcggggaccaaggugaccgugcug

SEQ ID NO: 10028 - RNA, 324 nt, Artificial Sequence
  derived and/or modified sequence opt1 from anti-HIV_119-083793_VR-Chain
cagagcgugcugacccagcccccguccgucagcgccgcccccggccagaaggugaccaucuccugcagcggguccagcuccaacaucggcaagaacagcguguccugguaccagcagcuccccgcgacggcccccaagcugcugaucuacgagagcaacaagcgcccguccgggauccccgaccgguucagcggcuccaagagcgggaccuccgccacccucgccaucaccggccugcagacgggcgacgaggccgacuacuacugcgcgaccugggacgggcgcgucagcgugaucggcaccgggaccaaggugacgguccug

SEQ ID NO: 10029 - RNA, 324 nt, Artificial Sequence
  derived and/or modified sequence opt1 from anti-HIV_119-083163_VR-Chain
cagagcgugcugacccagcccccguccgucagcggcgcccccgggcagcgcgugaucaucuccugcaccggcagcuccagcaacaucuggggguacgacgugcagugguaccagcagcuccccggcacggcccccaagcugcugcucuacgagaacgaccggcgcccguccgggacccccgaccgguucagcggcuccaagagcggcaccuccgcgacccuggccaucacggggcugcacaccggcgacgaggccgacuacuacugcgagaccugggacgggagcggcggggucuucggcaccggcacgaaggugaccgugcuc

SEQ ID NO: 10030 - RNA, 333 nt, Artificial Sequence
  derived and/or modified sequence opt1 from anti-HIV_119-082331_VR-Chain
cagagcgugcugacccagcccccguccaucagcgccgcccccggccagaaggucaccaucuccugcagcgggggcuccagcaacaucggggcgaacuacguguccugguaccagcaccuccccggcacggcccccaagcugcugaucuacgagaccaacaagcgcccgagcgggauccccgaccgguucuccggcagccaguccggcaccagcgccacccucgugaucacggggcugcagaccggcgacgaggccgacuucuacugcgggaccuggggcgggucccugcgcgccggcggcgucaucgggaccggcacgcgggugaccgugcuc

SEQ ID NO: 10031 - RNA, 324 nt, Artificial Sequence
  derived and/or modified sequence opt1 from anti-HIV_119-082070_VR-Chain
cagagcgugcugacccagcccccguccgucagcgccgcccccggccagaagguggugaucuccugcagcggguccagcuccaucaucgagaagaacagcaucuccugguaccagcagggccccggggcggcccccaagcuccugaucuacgagaacgaccgccggccgagcggcacccccgaccgcuucuccgggagcaaguccggcacgagcgccacccuggccaucaccggccuccagaccggggacgaggccgacuacuacugcgagacgugggacggcuccgggggcgucuucgggaccggcaccaaggugaccgugcug

SEQ ID NO: 10032 - RNA, 333 nt, Artificial Sequence
  derived and/or modified sequence opt1 from anti-HIV_119-081512_VR-Chain
cagagcgugcugacccagcccccguccgucagcgccgcccccggccagaacgugaccuucuccugcagcggguccaacagcaacaucggcgacaacuacguguccugguaccagcagauccccgggacggcgcccaagcucgucaucuacgacaacaacaagcgcccgagcggcauccccgaccgguucuccgggagcaaguccggcaccagcgccacccuggugaucaccggccugcagacgggggacgaggccgacuucuacugcggcaccugggacgggucccuccgcaccggcggggugaucggcaccggcacgcgggucaccgugcug

SEQ ID NO: 10033 - RNA, 333 nt, Artificial Sequence
  derived and/or modified sequence opt1 from anti-HIV_119-080816_VR-Chain
cagcuggugcucacccagcccccgagcgccuccggcacccccgggcagcgcgucacgaucagcugcuccggcagcuccagcaacaucggguccaacuucgugagcugguaccagcagcggcccggcaccgcccccaagcugcugaucuacgagaccaacaagcgcccguccgggauccccgaccgguucagcggcuccaagagcggcaccuccgcgacgcucgccaucaccgggcugcagaccggcgacgaggccgacuacuacugcgccaccugggcgccccgccugaacagcgcccggguguucgggaacggcacgauggucaccgugcuc

SEQ ID NO: 10034 - RNA, 333 nt, Artificial Sequence
  derived and/or modified sequence opt1 from anti-HIV_119-079302_VR-Chain
cagagcgugcugacccagcccccguccgucagcgccgcccccggccagaaggugaccaucuccugcagcggguccagcuccuacaucggcaacaaguacgugagcugguaccagcaguuccccgggacggcgcccaagcuccugaucuacgagaacaacaagcgccuguccggcaucccggaccgguucagcgccuccaagagcgccaccuccgccacccucgccaucagcgggcugcagaccggcgacgaggcggacuucuacugcggcacgugggacgggucccugcgcaccggcggggucaucggcaccgggacccgggugacggugcuc

SEQ ID NO: 10035 - RNA, 327 nt, Artificial Sequence
  derived and/or modified sequence opt1 from anti-HIV_119-079292_VR-Chain
cagagcgugcugacccagcccccguccgucagcgccgcccccggccagaaggugaccaucuccugcagcggguccaacagcaacaucggcaacaacuacguguccugguaccagcagcuccccgggacggcgcccaagcugcugaucuacgacaacaacaagcgcccgagcggcauccccgaccgguucuccgggagcaaguccggcaccagcgccacccucggcaucaccgggcugcagacgggcgacgaggccaacuacuacugcgggaccugggacaccucccugagcggcgucuucgggaccggcacggaggugaucgugcuc

SEQ ID NO: 10036 - RNA, 321 nt, Artificial Sequence
  derived and/or modified sequence opt1 from anti-HIV_119-079289_VR-Chain
cagagcgcccugacccagcccccguccgugagcgccgcgcccggccagcgcgucaccaucuccugcagcgggaacaacuccaacaucggcaacaacuucgugagcugguaccagcuccugcccgggacggcccccaagcugcucaucuacgagaacaacaagcgguccagcggcaucccggaccgcuucuccgggagcaaguccggcaccagcgccacccugggcaucaccgggcugcagacgggcgacgaggccgacuacuucugcuccaccuggagcgggucccucaacuucggcaccgggacccgggugacgguccug

SEQ ID NO: 10037 - RNA, 324 nt, Artificial Sequence
  derived and/or modified sequence opt1 from anti-HIV_119-078935_VR-Chain
cagagcgugcugacccagcccccguccgucagcgccgcccccggccagcgcgugaccaucuccugcagcgggacguccgcgaacaucgagaacuacuacgugagcugguaccagcagcuccccggcaccgcccccaagcugaucaucuacgacgacaacaagcggccguccgggaucccccagcgcuucagcggcuccaagagcgggaccuccgccacccugggcaucacgggccuccagaccggggacgaggccgaguacuacugcgagaccugggacggcagcgggggcgucuucgggaccggcacgaaggugaccgugcug

SEQ ID NO: 10038 - RNA, 324 nt, Artificial Sequence
  derived and/or modified sequence opt1 from anti-HIV_119-078702_VR-Chain
cagagcgugcugacccagcccccguccgucagcgccgcccccggccagaaggugaccaucuccugcagcggguccagcuccguguucggcaagaacuacgucagcugguaccagcaccuccccgggacggcgcccaagcugcugaucuacgagaacaccaagcgcccguccggcauccccgaccgguucagcggguccaagagcggcaccuccgccacccucgccaucacgggccugcagaccggggacgaggccgacuacuacugcgagaccugggacggcagcgggggcguguucggguccggcaccaaggugacgguccug

SEQ ID NO: 10039 - RNA, 324 nt, Artificial Sequence
  derived and/or modified sequence opt1 from anti-HIV_119-078593_VR-Chain
cagagcuuccugacccagcccccguccgugagcgccgcccccggccagaaggucaccaucuccugcagcggguccaacagcaacaucggcaacaacuacguguccugguaccagcagguccccgggacggcgcccaagcuccugaucuacgagaacaacaagcgcccgagcggcauccccgaccgguucuccgggagcaaguccggcaccagcgccacccuggugaucaccggccuccacacgggggacgaggccgacuacuacugcgagaccugggacggcuccgggggcguguucgggaccggcagcaacgugacccugcug

SEQ ID NO: 10040 - RNA, 333 nt, Artificial Sequence
  derived and/or modified sequence opt1 from anti-HIV_119-077708_VR-Chain
cagagcgugcugacccagcccccgucccucagcgccgcccccggccagaaggucaccaucuccugcagcgggacgaccuccaacaucggcaacaacuacgugagcugguaccagcaccuccccgggaccgcgcccaagcugcugaucuacgagaacaccaagcgcccguccggcauccccgaccgguucagcggguccaagagcggcacguccgccacccugggcaucaccgggcugcagaccggcgacgaggccgacuacuacugcacgguguggggcguccgcaagggggugggggccguguucggcaccggcaccaaggucaccgugcuc

SEQ ID NO: 10041 - RNA, 321 nt, Artificial Sequence
  derived and/or modified sequence opt1 from anti-HIV_119-076904_VR-Chain
cagagcgugcugacccagcccccguccgucagcgccgcccccggccagaaggugaccaucuccugcagccgcuccagcucccacaucgagaacagcuacguguccugguaccagcaccuccccgggacggcgcccaagcugcugaucuacgagaacaacaagcggccgagcggcauccccgaccgcuucuccgggagcaaguccggcaccagcgccacccucgggaucuccggccugcagaccggcgacgaggccgacuacuucugcagcacgugguccgggagccugaacuucggcaccgggacccgggucaccgugcuc

SEQ ID NO: 10042 - RNA, 324 nt, Artificial Sequence
  derived and/or modified sequence opt1 from anti-HIV_119-075862_VR-Chain
cagagcgugcugacccagcccccguccaucagcgccgcccccggccagaaggucaccaucuccugcagcggguccgcgagcaacaucggcaagaacuccgugagcugguaccagcaguuccccgggacggcccccaagcuccugaucuacgagaacaaccgccggccguccggcacccccgaccgcuucagcggguccaagagcggcaccuccgccacccuggccaucacgggccuccagaccggggacgaggccgacuacuacugcgagaccugggacggcagcgggggcguguucgggaccggcacgaaggucaccgugcug

SEQ ID NO: 10043 - RNA, 333 nt, Artificial Sequence
  derived and/or modified sequence opt1 from anti-HIV_119-075465_VR-Chain
cagagcgugcugacccagcccccguccgucagcgccgcccccggccagaagguggugaucuccugcagcggguccagcuccaucaucggcaacaacuacgucagcugguaccagcagcuccccgggaccgcgcccaagcugcugaucuacgagaacaaccgccggccguccggcauccccgaccgcuucagcggguccaagagcggcacguccgccacccucgccaucagcggccugcagaccggggacgaggccgacuacugcugcgccguguggggcgugcggcgcggggcgggcgccgucuucggggccggcaccaaggugacggugcug

SEQ ID NO: 10044 - RNA, 330 nt, Artificial Sequence
  derived and/or modified sequence opt1 from anti-HIV_119-074822_VR-Chain
agcgugcugacccagcccccguccgucagcgccgcccccggccagaacaucaccaucuccugcagcgggggcuccagcaacaucgcgaagaacuacaucuccugguaccagcaccuccccgggacggcccccaagaucgugaucuacgacaacgacaagcggccgcugggcauccccgaccgguucagcgccuccaagagcgggaccuccgccacccugggcaucaccggccuccagacgggggacgaggccgacuacuacugcgcgguguggggcguccgccgcggggugggcgccguguucggggccggcaccaaggucaucgugcug

SEQ ID NO: 10045 - RNA, 333 nt, Artificial Sequence
  derived and/or modified sequence opt1 from anti-HIV_119-074629_VR-Chain
cagagcgugcugacccagcccccguccgagagcgccgcccccggccagaaggucaccaucuccugcagcgggggcacguccaacaucgggaacaacuacgugagcugguaccgccggcuccccggcaccgcgcccaagcugcugaucuacgagaacaaccgccggccguccgggauccccgaccgcuucagcggcuccaagagcggcaccuccgccacccucgccaucagcgggcugcagacgggcgacgaggccgacuacugcugcgccguguggggcguccggcgcggggcgggggccguguucggcgccggcaccaaggugaccguccug

SEQ ID NO: 10046 - RNA, 324 nt, Artificial Sequence
  derived and/or modified sequence opt1 from anti-HIV_119-074500_VR-Chain
cagagcgugcugacccagcccccguccgucagcgccgcccccggccagaaggugaccauguccugcagcggguccagcuccaacaucggcaacaacuacgugagcugguaccaguaccuccccgggacggcgcccaagcugcugaucuacgagaacgaccgccggccguccggcauccccgaccgcuucagcgccuccaagagcgggaccuccgccacccucgccaucaccggccugcagacgggcgacgaggccgacuacuacugcgagaccugggacgggagcggcggggucuucggcaccgggaccaaggugacggugcug

SEQ ID NO: 10047 - RNA, 333 nt, Artificial Sequence
  derived and/or modified sequence opt1 from anti-HIV_119-073911_VR-Chain
cagagcgugcugacccagcccccguccgucagcgccgcccccggccagcgcgugaccaucuccugcagcggguccagcuccaacaucgagaacaacuacgugagcugguaccagcaccuccccggcacggcgcccaagcugcuggucuacgacgacaacaagcggccguccgggaucccccaccgcuucagcgccuccaagagcggcaccuccgccacccucgccaucaccgggcugcagacgggcgacgaggccgacuacuacugcacccuguggggcgugcggaagggggugggcgcggucuucgggaccggcaccaaggugacggugcuc

SEQ ID NO: 10048 - RNA, 324 nt, Artificial Sequence
  derived and/or modified sequence opt1 from anti-HIV_119-072765_VR-Chain
cagagcgugcugacccagcccccguccgucagcgccgcccccggccagaaggugaccaucuccugcagcgggaacuccagcaacaucggcaacaacuucguguccugguaccagcagguccccgggacggcgcccaagcuccugguguacgagaccuaccgccggccgagcggcacccccgaccgcuucuccgggagcaaguccggcaccagcgccacgcuggccaucuccggccuccagaccggggacgaggccgacuacuacugcggcaccugggacgggagcggcgggguguucggcaccggcacgaaggucaccgugcug

SEQ ID NO: 10049 - RNA, 333 nt, Artificial Sequence
  derived and/or modified sequence opt1 from anti-HIV_119-072313_VR-Chain
caguucgugcugacccagcccccgagcgucuccgccgcccccggccagaaggugaccaucagcugcuccgcgagcuccagcaucaucgggaagaacuacguguccugguaccagcaguuccccggcacggcccccaagcuccugaucuacgaggacaacaagcgcccgagcgggauccccgaccgguucuccggcagcaaguccgggaccagcgccacccuggccaucaccggccuccagacgggcgacgaggccgacuacuacugcaccgucuggggcgugcgcaagggggugggggcggucuucggcaccgggaccaaggugacggugcug

SEQ ID NO: 10050 - RNA, 333 nt, Artificial Sequence
  derived and/or modified sequence opt1 from anti-HIV_119-072280_VR-Chain
cagagcgugcugacccagcccccguccgucagcgccgcccccggccagaagguguccaucagcugcuccgggagcgacuccaaccucggcgacaacuacgugagcugguaccagcaguuccccgggaccgcgcccaagcugcugauccacgacaacaacaagcgcccguccggcacgcccgaccgguucagcggguccaagagcggcaccuccgccacccucgccaucaccggccugcagacgggggacgaggccgacuacuacugcgccaccugggcgccccgccugaacagcgcccgggucuucggcaacgggaccauggugaccgugcuc

SEQ ID NO: 10051 - RNA, 333 nt, Artificial Sequence
  derived and/or modified sequence opt1 from anti-HIV_119-071693_VR-Chain
cagagcgugcugacccagcccccguccgucagcgccgcccccggccagaagguggugaucuccugcagcggguccagcuccaucaucgagaagaacagcaucuccugguaccagcagggccccggggcggcccccaagcuccugaucuacgagaacgacaagcgcccgagcggcauccccgaccgguucuccgggagcaaguccggcaccagcgccacgcuggccaucaccggccuccagaccggggacgaggccgacuacuacugcaccaucuggggcguccgcaagggggugggcgcgguguucgggacgggcaccaaggucaccgugcug

SEQ ID NO: 10052 - RNA, 321 nt, Artificial Sequence
  derived and/or modified sequence opt1 from anti-HIV_119-071353_VR-Chain
cagagcgugcugacccagcccccguccgccagcgccgcgcccggccagaaggucaccaucuccugcagcggguccaacagcaacaucggcaacaacuucguguccugguaccagcuguuccccgggacggcccccaagcuccugaucuucgagaacaacaagcgcccgagcggcauccccgaccgguucuccggggccaagagcggcaccuccgccacccucgccaucaccggccugcagacgggggacgaggcggacuacuucugcagcaccugguccggcagccugaacuucgggaccggcacccgcgugacgguccuc

SEQ ID NO: 10053 - RNA, 324 nt, Artificial Sequence
  derived and/or modified sequence opt1 from anti-HIV_119-069711_VR-Chain
cagagcgugcugacccagcccccguccgucagcgccgcccccggccagaaggugaccaucuccugcagcggguccagcuccaacaucggcaacaacuacgugagcugguaccagcagcuccccgggacggcgcccaagcugcugaucuacgacaacaacaaccgcccguccggcguccccgaccgguucagcggguccaagagcggcaccuccgccacccucgccaucaccggccugcagacgggggacgaggccgacuacuacugcgagaccugggacgacagcggcgggguguucggcaccgggaccaaggugacgguccug

SEQ ID NO: 10054 - RNA, 333 nt, Artificial Sequence
  derived and/or modified sequence opt1 from anti-HIV_119-069061_VR-Chain
cagagcgugcugacccagcccccguccgucagcgccgcccccggccagaaggugaccaucuccugcagcggguccagcuccaacaucggcagcaacuacguguccugguaccagcagcuccccgggacggcgcccaagcugcuggucuacgacaacaacgagcgcccgagcggcauccccgaccgguucuccgggagcaaguccggcaccagcgccacccucgccaucaccggccugcagacgggggacgaggccgacuacuacugcgccaccugggcgccccgccugaacuccgcccggguguucggcaacgggaccauggugaccguccuc

SEQ ID NO: 10055 - RNA, 324 nt, Artificial Sequence
  derived and/or modified sequence opt1 from anti-HIV_119-068202_VR-Chain
cagagcgugcugacccaggagcccuccgucagcggcgccccggggcagcgcgugaccaucuccugcacgggcagcaacuccaacaucgggggccacgacgugcacugguaccagcagcuccccgggaccgcccccaagcugcugaucuacgacaacgacaagcggcccagcggcaucccggaccgcuucuccggcagcaaguccgacaccagcgcgucccucgggaucaccggccugcagacgggggacgaggccgacuacuacugcgagaccugggacggcagcgggggcgucuucggcaccgggaccaaggugacggugcug

SEQ ID NO: 10056 - RNA, 324 nt, Artificial Sequence
  derived and/or modified sequence opt1 from anti-HIV_119-068063_VR-Chain
cagagcgcccugacccagcccccguccgccagcggcucccucgggcagagcgugaccaucuccugcacgggcacccgcagcgacgucgggaacuacuacguguccugguaccagcagcugcccggcaccgcgcccaagcugcucaucagcgagaacaaccggcgccccuccgggaccccggaccgguucagcggcuccaagagcggcacguccgccacccuggccaucagcgggcugcagaccggcgacgaggccgacuacuacugcgggaccugggacggcuccgggggcguguucggcacggggaccaaggucaccgugcuc

SEQ ID NO: 10057 - RNA, 333 nt, Artificial Sequence
  derived and/or modified sequence opt1 from anti-HIV_119-067980_VR-Chain
cagagcgugcugacccagcccccguccgucagcgccgcccccggccagaaggugaccaucuccugcagcgggaacuccagcaacaucggcaacaacuucguguccugguaccagcagguccccgggacggcgcccaagcuccugguguacgagaccuaccgccggccgagcggcauccccgaccgcuucuccgggagcaaguccggcaccagcgccacccuggccaucacgggccuccagaccggggacgaggccgacuaccacugcgccaucuggggcgugcggaagggggucggcgcgguguucgggaccggcaccaaggugacggucgug

SEQ ID NO: 10058 - RNA, 324 nt, Artificial Sequence
  derived and/or modified sequence opt1 from anti-HIV_119-067866_VR-Chain
cagagcgugcugacccagcccccguccgucagcgccgcccccggccagaaggugaccaucuccugcagcggguccacgagcaccaucggcaacaacuacguguccugguaccagcaccuccccgggaccgcgcccaagcugcugaucuacgacaacaacaagcgcccggccggcauccccgaccgguucaccgccagcaaguccgggacgagcgccacccucgccaucaccggccugcacaccggcgacgaggcggacuacuacugcgagacgugggacggguccggcggggucuucggcaccgggaccaaggugaccgugcug

SEQ ID NO: 10059 - RNA, 321 nt, Artificial Sequence
  derived and/or modified sequence opt1 from anti-HIV_119-067756_VR-Chain
cagagcgugcugacccagcccccguccgucagcgccgcccccggccagaagguggugaucuccugcagcggguccaccagcaacaucggcaagaacuucgucuccugguaccagcagcuccccgggacggcgcccaagcugcugaucuacgagaacagccgccggccguccggcauccccgaccgcuucagcggggccaaguccggcaccagcgccacccucgccaucaccggccugcagacgggggacgaggccgacuacuucugcuccaccuggagcggcucccugaacuucgggaccggcacccgggugacggugcuc

SEQ ID NO: 10060 - RNA, 321 nt, Artificial Sequence
  derived and/or modified sequence opt1 from anti-HIV_119-066859_VR-Chain
cagagcgugcugacccagcccccguccgucagcgccgcccccggccagaaggugaccaucacgugcuccgggagcgcguccaacaucgagaacaacuacgugagcugguaccagcaguuccccggccccgccccgaagcuccugaucuacgagaacgacaagcgccccuccgggauccccgaccgguucagcggcuccgccagcgggaccuccgccacccuggccaucaccggccuccagacgggcgacgaggcggacuacuucugcagcaccugguccgggagccugaacuucggcaccgggacccgcgucacggugcug

SEQ ID NO: 10061 - RNA, 333 nt, Artificial Sequence
  derived and/or modified sequence opt1 from anti-HIV_119-065821_VR-Chain
cagagcgugcugacccagcccccguccgucagcgccacccccggccagcgcgugacgguguccugcagcggguccagcuccaacaucggcaaccacuacgucagcugguaccagcagguccccgggaccgcccccaagcuccugaucuacgacaacuccaaccggccgagcggcauccccgaccgcuucuccgggagcaaguccggcaccagcgcgacccugggcaucacggggcuccagaccggcgacgaggccgacuacuacugcaccguguggggcgugcggaagggggugggggccguguucggcaccggcacgaaggucaccgugcug

SEQ ID NO: 10062 - RNA, 333 nt, Artificial Sequence
  derived and/or modified sequence opt1 from anti-HIV_119-065191_VR-Chain
cagagcgugcugacccagcccccguccgucagcgccgcccccggccagaaggugaccaucuccugcagcgggaacaacuccaacaucggcaacaacuacgugagcugguaccagcagcuccccgggacggcgcccaagcugcugaucuucgagaaccacaagcgcccguccggcauccccgaccgguucagcggguccaagagcggcaccuccgccacccucggcaucaccgggcugcagagcggcgacgaggccgacuacuacugcgccacgugggcgccccgccugaacuccgcccgggucuucgggaccggcaccaaggugaccgugcuc

SEQ ID NO: 10063 - RNA, 333 nt, Artificial Sequence
  derived and/or modified sequence opt1 from anti-HIV_119-064667_VR-Chain
cagagcgugcugacccagcccccguccgucagcgccgcccccggccagaaggugaccaucuccugcagcggguccaacagcuacaucggcaacaaguacguguccugguaccagcagguccccgggacggcgcccaagcuccugaucuacgagaacaacaagcgcccgagcggcauccccgaccgguucuccgggagcaaguccggcaccagcgccacccuggugaucaccggccuccagacgggggacgaggccgacuucuacugcggcaccugggacgggucccugcgcaccggcggggugaucggcaccggcacgcgggucaccgugcug

SEQ ID NO: 10064 - RNA, 324 nt, Artificial Sequence
  derived and/or modified sequence opt1 from anti-HIV_119-063791_VR-Chain
cagagcgugcugacccagcccccguccgucagcgccgcccccggccagaaggugcccaucuccugcagcgggaacuccagcaacaucggcaacaacuacguguccugguaccagcagcuccccgggaccgcgccgaagcugcugaucuacgagaacaacaagcgccccagcggcauccccgaccgguucuccgggagcaaguccggcacgagcgccacccucgccaucaccggccugcacaccggggacgaggccgacuacuacugcgagacgugggacggcuccgggggcgucuucgggaccggcaccaaggugaccgugcug

SEQ ID NO: 10065 - RNA, 333 nt, Artificial Sequence
  derived and/or modified sequence opt1 from anti-HIV_119-062989_VR-Chain
cagagcgugcugacccagcccccguccgucagcgccgcccccggccagcgggugaccaucuccugcagcggguccagcuccaacaucggcaacaacuucgugagcugguaccagcaguuccccgggacgguccccaagcuccugaucuacgagaacaaccggcgcccguccggcauccccgaccgguucagcggguccaagagcggcaccuccgcgacccuggccaucaccggccuccagacgggggacgaggccgacuacuacugcgccguguggggcgugcgccgcggggucggcgccguguucggggcgggcaccaaggugaucguccug

SEQ ID NO: 10066 - RNA, 321 nt, Artificial Sequence
  derived and/or modified sequence opt1 from anti-HIV_119-062286_VR-Chain
cagagcgugcugacccagcccccguccgucagcgccgcccccggccagaaggugaccaucuccugcagcggguccgcgagcaacaucggcaagaacuucguguccugguaccagcagcuccccgggacggcccccaagcugcugaucagcgagaacaaccgccggccguccggcacccccgaccgcuucagcggguccaagagcggcgccuccgccacccucgucaucagcggccugcagaccggggacgaggccgacuacuacugcgcgacgugguccggcagccuguccaucgggaccggcaccaaggugaccgugcuc

SEQ ID NO: 10067 - RNA, 321 nt, Artificial Sequence
  derived and/or modified sequence opt1 from anti-HIV_119-061416_VR-Chain
cagagcgugcugacccagcccccguccgucagcgccgcccccggccagaagguggugaucuccugcagcggguccagcuccaucuucgagaagaacagcaucuccugguaccagcagggccccggggcggcccccaagcuccugaucuacgagaacgacaagcgccggagcggcaucccggaccgcuucuccgggagcaaguccgccaccagcacgacccuggccaucgucggccuccagaccggcgacgaggccgacuacuucugcuccaccuggagcgggucccugaacuucggcacggggacccgggugaccgugcug

SEQ ID NO: 10068 - RNA, 321 nt, Artificial Sequence
  derived and/or modified sequence opt1 from anti-HIV_119-061344_VR-Chain
cagagcgugcugacccagcccccguccgucagcgccgcccccggccagaaggugaccaucuccugcagcggguccagcuccguguucggcaagaacuacgucagcugguaccagcaccuccccgggacggcgcccaagcugcugaucuacgagaacaacaagcgcccguccggcauccccgaccgguucagcggggccaaguccggcaccgccgccacccucgccaucaccggccugcagacgggggacgaggcggacuacuacugcgccaccuggagcggcucccugaacuucgggaccggcaccaaggugacggugcuc

SEQ ID NO: 10069 - RNA, 324 nt, Artificial Sequence
  derived and/or modified sequence opt1 from anti-HIV_119-060240_VR-Chain
cagagcgugcugacccagcccccguccgaguacggcgcccccgggcacaacgucaccgugagcugcuccggcacgaccagcaacaucgagaacaacuucguguccugguaccucaucguccccgggaccgcccccaagcugcugaucuucgacaacgacaagcgcccgagcggcauccccgaccgguucuccgggagcaaguccggcaccagcgcgacgcucgccaucaccggccugcagaccggggacgaggccgacuacuacugcgccaccugggacggccgcguguccgugaucgggacgggcaccaaggucaccgugcug

SEQ ID NO: 10070 - RNA, 333 nt, Artificial Sequence
  derived and/or modified sequence opt1 from anti-HIV_119-060184_VR-Chain
cagagcgugcugacccagcccccguccgucagcggcgcccccgggcagcgcgugaccaucuccugcagcggcuccagcuccaacaucgggagcaacacggugaacugguaccagcagcuccccggcaccgcccccaagcugcugaucuacgacaacaacaagcggccguccgggauccccgaccgcuucagcggcuccaagagcggcaccuccgcgacccucgucaucacggggcugcagaccggcgacgaggccgacuucuacugcgggaccugggacggcagccugcggaccgggggcgugaucggcacggggacccgcgugaccguccuc

SEQ ID NO: 10071 - RNA, 321 nt, Artificial Sequence
  derived and/or modified sequence opt1 from anti-HIV_119-058035_VR-Chain
cagagcgugcugacccagcccccguccgucagcgccgcccccggccagaaggugaccaucuccugcagcggguccgcgagcaacaucggcaagaacuucguguccugguaccagcagcuccccgggacggcccccaagcugcugaucuacgagaacaaccgccggccgagcggcacccccgaccgcuucuccggggccaagagcggcaccuccgccacccucgccaucacgggccugcagaccggggacgaggcggacuacuucugcagcaccugguccggcagccugaacuucgggaccggcacgcgggucaccgugcuc

SEQ ID NO: 10072 - RNA, 321 nt, Artificial Sequence
  derived and/or modified sequence opt1 from anti-HIV_119-057858_VR-Chain
cagagcgugcugacccagcccccguccgucagcgccgcccccggccagaacgugaacaucuccugcagcgggggcuccagcaacaucggguccaacuacgugagcugguaccagcaguuccccggcaccgcgcccaagcuccugaucuacgagaacaacaagcgcccguccgggauccccgaccgguucagcggcgccaaguccggcacgagcgccacccuggccaucaccgggcuccagaccggcgacgaggccgacuacuucugcuccacguggagcgggucccugaacuucggcaccgggacccgcgucaccgugcug

SEQ ID NO: 10073 - RNA, 324 nt, Artificial Sequence
  derived and/or modified sequence opt1 from anti-HIV_119-057473_VR-Chain
cagagcgugcugacccagcccccguccgucagcgccgcccccggccagaaggugaccaucuccugcagcggguccagcuccaacaucggcaacaacuacgugagcugguaccagcaccuccccgggacggcgcccaagcugcugaucuacgacaccuacucccgcccgagcggcauccccgaccgguucuccgggagcaaguccggcaccagcgccacccucgccaucacgggccugcagaccggggacgaggccgacuacuacugcggcaccugggacggguccggcggggucuucggcaccggcacgaaggugaccgugcug

SEQ ID NO: 10074 - RNA, 321 nt, Artificial Sequence
  derived and/or modified sequence opt1 from anti-HIV_119-057090_VR-Chain
cagagcgugcugacccagcccccguccgucagcgccgcccccggccagaccgugacgaucuccugcagcggguccaccagcaacaucggcaagaacgacguguccugguaccagcagcuccccgggaccgcgcccaagcugcugaucagcgagaacaaccgccggccguccggcacccccgaccgcuucagcgccuccaagagcgggacguccgccacccucgccaucaccggccugcagaccggcgacgaggccgacuacuucugcagcacgugguccgggagccugaacuucggcaccgggacccgggucaccgugcuc

SEQ ID NO: 10075 - RNA, 333 nt, Artificial Sequence
  derived and/or modified sequence opt1 from anti-HIV_119-055754_VR-Chain
cagagcgugcugacccagcccccguccgucagcgccgcccccggccagaaggugaccaucuccugcagcgggaacuccagcuccaucggcaacaacuucgugagcugguaccagcagcuccccgggacggcgcccaagcugcuggucuacgagaacuaccgccggccguccggcauccccgaccgcuucagcggguccaagagcggcaccuccgccacccucgccaucgacggccugcagaccugggacgaggccgacuaccacugcgccaucuggggcgugcggaagggggugggggcggucuucggcacggggaccaaggugaccgugguc

SEQ ID NO: 10076 - RNA, 324 nt, Artificial Sequence
  derived and/or modified sequence opt1 from anti-HIV_119-054899_VR-Chain
cagagcgugcugacccagcccccguccgucagcgccgcccccggccagaaggugaccaucuccugcagcggguccaacagcuacaucggcaacaaguacguguccugguaccagcaguuccccgggacggcgcccaagcuccugauccacgagaacaaccgccggccgagcggcacccccgaccgcuucuccgggagcaaguccggcaccagcgccacccuggccaucuccggccuccagacgggggacgaggccgacuacuacugcgagaccugggacggcagcgggggcgucuucgggaccggcaccaaggugacggugcug

SEQ ID NO: 10077 - RNA, 324 nt, Artificial Sequence
  derived and/or modified sequence opt1 from anti-HIV_119-054501_VR-Chain
cagagcgugcugacccagcccccguccgucagcgccgcccccggccagaaggugaccaucuccugcagcgggacguccagcaacaucggcaacaacuacguguccugguaccagcaccuccccgggaccgcgcccaagcugcugaucuucgagaccaacaagcgcccgagcggcauccccgaccgguucuccgccagcaaguccgggaccagcgccacgcucgccaucaccggccugcagaccggcgacgaggccgacuacuacugcgagaccugggacggguccggcggggucuucggccccgggacgcgcgugaccgugcug

SEQ ID NO: 10078 - RNA, 324 nt, Artificial Sequence
  derived and/or modified sequence opt1 from anti-HIV_119-051867_VR-Chain
cagagcgugcugacccagcccccguccgucagcgccgcccccggccagaaggugaccaucuccugcagcgggaacuccagcaacaucggcaacaacuucaucuccugguaccagcagcuccccgggacggcgcccaagcugcugaucuacgagaacgaccgccggccgagcggcacccccgaccgcuucuccgggagcaaguccggcaccagcgccacccucgccaucacgggccugcagaccggggacgaggccgacuacuacugcgagaccugggacggcuccgggggcguguucgggaccggcacgaaggucaccgugcug

SEQ ID NO: 10079 - RNA, 324 nt, Artificial Sequence
  derived and/or modified sequence opt1 from anti-HIV_119-051814_VR-Chain
cagagcgugcugacccagcccccguccgucagcgccgcccccggccagaaggugaccaucuccugcagcggguccaacagcaacaucggcaacaaggacguguccugguaccagcagauccccgcgacggcccccaagcuccugaucuacgagaacaacaagcgcccgagcgggauccccgaccgguucuccggcagcaaguccgggaccagcgccacccuggccaucaccggccuccagacgggcgacgaggccgacuacuacugcgcgaccugggacgggcgcgucuccgugaucggcaccgggaccaacgugaucguccug

SEQ ID NO: 10080 - RNA, 321 nt, Artificial Sequence
  derived and/or modified sequence opt1 from anti-HIV_119-051567_VR-Chain
cagagcgugcugacccagcccccguccgucagcgccgcccccggccagaaggugaccaucuacugcuccgggagccgcuccaacaucggccggaacuacgcgagcugguaccagcagcuccccgggacggcccccaagcugcugaucuucgacaacaaccgccggccguccggcauccccgaccgcuucagcggggccaaguccggcaccagcgccacccucgccaucaccggccugcagacgggggacgaggcggacuacuucugcuccaccuggagcggcucccugaacuucgggaccggcacccgggugacgguccuc

SEQ ID NO: 10081 - RNA, 324 nt, Artificial Sequence
  derived and/or modified sequence opt1 from anti-HIV_119-051483_VR-Chain
cagagcgugcugacccagcccccguccgucagcgccgcccccggccagaagcucaccaucuccugcagcgggacguccagcaacaucggcaacaacuacguguccugguaccagcaccuccccgggaccgcgcccaagcugcugaucuacgagaacaaccgccggccgagcggcauccccgagcgcuucuccgccagcaaguccgggaccagcgccacccugggcaucacgggccugcagaccggggacgaggccgacuacuacugcgagaccugggacgacuccggcgggguguucggcaccgggacgaaggucaccgugcuc

SEQ ID NO: 10082 - RNA, 333 nt, Artificial Sequence
  derived and/or modified sequence opt1 from anti-HIV_119-050913_VR-Chain
cagagcgugcugacccagcccccguccgucagcgccgcccccggccagaaggugaccaucuccugcagcgggggcacguccaacaucgggaacaacuacgugagcugguaccagcagcuccccggcaccgcgccccgccugcugaucuacgagaccaacaagcggccguccgggauccccgaccgcuucuucggcagcaaguccggcaccagcgccacgcucgccaucuccgggcugcagaccggcgacgaggccgacuacuacugcaccgucuggggcgugcggaagggggugggggccgucuucggcaccggcacgaaggugaccgugcug

SEQ ID NO: 10083 - RNA, 333 nt, Artificial Sequence
  derived and/or modified sequence opt1 from anti-HIV_119-050187_VR-Chain
cagagcgugcugacccagcccccguccgucagcgccgcccccggccagaaggugaccaucuccugcagcggguccagcuccaacaucggcaagaacagcguguccugguaccagcaguuccccgggacggcgcccaagcuccugaucuacgagaacaacaagcgcccgagcggcauccccgaccgguucuccgacagccaguccgggaccagcgccacccuggccaucaccggccuccagacgggcgacgaggccgacuacuccugcgccaccugggcggccagccugaacuccgcccgcgucuucgggaccggcacccgggugacggugcug

SEQ ID NO: 10084 - RNA, 324 nt, Artificial Sequence
  derived and/or modified sequence opt1 from anti-HIV_119-049069_VR-Chain
cagagcgugcugacccagcccccguccgucagcgccgcccccggccagaaggugaccaucuccugcagcggguccacgagcaacaucggcaaguccgacguguucugguaccagcagcuccccgggaccgcgcccaagcugcugaucagcgagaccucccgccggccgagcggcacccccgaccgcuucuccgggagcaaguccggcacgagcgccacccucaccaucaccggccugcagacgggggacgaggccgacuacuacugcgaggccugggacggcuccgggggcgucuucgggaccggcaccaaggugaccgugcug

SEQ ID NO: 10085 - RNA, 333 nt, Artificial Sequence
  derived and/or modified sequence opt1 from anti-HIV_119-048517_VR-Chain
cagagcgugcugacccagcccccguccgucagcgccgcccccggccagaaggugaccaucuccugcagcggguccaaguucaacaucggcaacaaggacgugagcugguaccagcacucccccgggacggcgcccaagcuccugaucuacgagaacaacaagcggccgagcggcauccccgaccgguucuccgggagcaaguccggcaccagcgccacccugggcaucuccgggcuccagaccggcgacgaggccgacuacugcugcgccgucuggggcgugcgccgcggggccggggcgguguucggcgccggcacgaaggucaccgugcug

SEQ ID NO: 10086 - RNA, 333 nt, Artificial Sequence
  derived and/or modified sequence opt1 from anti-HIV_119-048470_VR-Chain
cagagcgugcugacccagcccccguccgucagcgccgcccccggccagaaggugaccaucuccugcagcggguccacgagcaacaucggcaagaaccucguguccugguaccagcaguuccccgggaccgcgcccaagcugcugaucuacgagaacaaccgccggccgagcggcauccccgaccgcuucuccgggagcaaguccggcaccagcgccacccucgucaucacgggccugcagaccggggacgaggccgacuucuacugcggcaccuggggcgggucccugcgggccgggggcgugaucggcaccgggacgcgcgugaccguccuc

SEQ ID NO: 10087 - RNA, 282 nt, Artificial Sequence
  derived and/or modified sequence opt1 from anti-HIV_119-048303_VR-Chain
agcgugcugacccagcccccguccgucagcgccgcccccggccagaacaucaccaucuccugcagcggguccaucagcaacaucgcguccaacuucaucagcugguaccagcagcuccccggcacggcccccaagaucaucaucuacgacaacgaccagcgcccgcuggggauccccgcccgguucuccggcagcaaguccggggccagcgccacccuggugaucaccggccuccagaccggcgacgaggcggacuacuacugcgggacgugggacggcucc

SEQ ID NO: 10088 - RNA, 333 nt, Artificial Sequence
  derived and/or modified sequence opt1 from anti-HIV_119-048021_VR-Chain
cagagcgugcugacccagcccccguccgucagcgccgcccccggccagaaggugaccaucuccugcagcggguccagcuccaacaucggcaacaacuacgugagcugguaccagcagcuccccgggacggcgcccaagcugcugaucuacgacaacaacaagcgcccguccggcauccccgaccgguucagcggguccaagagcggcaccuccgccacccucgucaucaccggccugcagacgggggacgaggccgacuucuacugcggcaccugggacgggagccuguccggcgggggcgugaucggcaccgggacccgcgugacgguccuc

SEQ ID NO: 10089 - RNA, 324 nt, Artificial Sequence
  derived and/or modified sequence opt1 from anti-HIV_119-047928_VR-Chain
cagagcgugcugacccagcccccguccgucagcgccgcccccggccagaaggugaccaucuccugcagcggguccaacagcaacaucggcaacaacugcguguccugguaccagcagguccccgggacggcgcccaagcuccugaucuacgagaacaaccgccggccgagcggcauccccgaccgcuucuccgggagcaaguccggcaccagcgccacccuggccaucuccggccuccagaccggggacgaggccgacuacuacugcggcacgugggacgggagcggcgggguguucggcaccgccaccaaggugaccguccug

SEQ ID NO: 10090 - RNA, 324 nt, Artificial Sequence
  derived and/or modified sequence opt1 from anti-HIV_119-047384_VR-Chain
cagagcgugcugacccagcccccguccgucagcgccgcccccggccagaaggugaccaucuccugcagcggguccaacagcaacaucggcaacaaggacguguccugguaccgccaggucccgcccacggcgcccaagcuccugaucuacgagaacaacaagcggcccagcgggauccccgaccgcuucuccggcagcaaguccgggaccagcgccacccuggccaucaccggccuccagacgggcgacgaggccgacuacuacugcgccaccugggacgggcggguguccguguucggcaccgggaccaaggucgcggugcug

SEQ ID NO: 10091 - RNA, 333 nt, Artificial Sequence
  derived and/or modified sequence opt1 from anti-HIV_119-047145_VR-Chain
cagagcgugcugacccagcccccguccgucagcgccgcccccggccagaccgugaacaucuccugcagcggguccaacagcaacaucggcuccaaguacgugagcugguaccagcacuuccccgggacggcgcccaagcuccugaucuacgagaacaacaagcgcuccagcggcaucccggaccgguucuccgggagcaaguccgccaccagcgccacccuggccaucaccggccuccagacgggcgacgaggccgacuacuacugcgcgaccugggcccccucccugaacagcgcccgcgucuucgggaccggcaccaaggugacggugcug

SEQ ID NO: 10092 - RNA, 333 nt, Artificial Sequence
  derived and/or modified sequence opt1 from anti-HIV_119-046752_VR-Chain
cagagcgugcugacccagcccccguccgucagcgccgcccccggccagaaggugaccaucuccugcagcgggaacuccagcuccaucggcaacaacuucgugagcugguaccagcagcuccccgggacggcgcccaagcugcuggucuacgagaacuaccgccggccguccggcaucagcgaccgcuucuccgggagcaaguccggcaccagcgccacccucgccaucaccggccugcagacgggggacgaggccgacuacuacugcaccguguggggcgugcggaagggggucggcgccguguucgggaccggcaccaaggugacgguccug

SEQ ID NO: 10093 - RNA, 324 nt, Artificial Sequence
  derived and/or modified sequence opt1 from anti-HIV_119-046660_VR-Chain
cagagcgugcugacccagcccccguccgucagcgccgcccccggccagaaggugaccaucuccugcagcggguccagcuccaacaucggcaaccacuacgugagcugguaccagcagcuccccgggacggcgcccaagcugcugaucuacgacaacaacaagcgcccguccggcauccccgaccgguucagcgccuccaagagcgggaccuccgccacccucggcaucaccggccugcagacgggggacgaggccgacuacuacugcgccaccugggacggccgcgucagcgugaucgggaccggcaccaaggugacggucgug

SEQ ID NO: 10094 - RNA, 333 nt, Artificial Sequence
  derived and/or modified sequence opt1 from anti-HIV_119-046202_VR-Chain
cagagcgugcugacccagcccccguccgucagcgccgcccccggccagaaggugaccaucuccugcagcggguccagcuccaacaucggcaacaacuacgugagcugguaccagcagcuccccgggacggcgcccaagcugcuggucuacgagaacuaccgccggccguccggcauccccgaccgcuucagcggguccaagagcggcaccuccgccacccucgccaucaccggccugcagacgggggacgaggccgacuaccacugcgccaucuggggcgugcggaagggggugggcgcggucuucgggaccggcaccaaggugaccgugguc

SEQ ID NO: 10095 - RNA, 333 nt, Artificial Sequence
  derived and/or modified sequence opt1 from anti-HIV_119-045790_VR-Chain
cagagcgugcugacccagcccccguccgucagcgccgcccccggccagaaggugaccaucuccugcagcggguccagcuccaacaucggcaacaacuacgugagcugguaccaguaccuccccgggacggcgcccaagcugcuguucuacgaggacaaccgccggccguccggcacccccgaccgcuucagcggguccaagagcggcaccuccgccacccucgccaucagcggccugcagacgggggacgaggccgacuacuacugcaccaucuggggcguccggaagggggugggcgccguguucgggaccggcaccaaggucacggugcug

SEQ ID NO: 10096 - RNA, 333 nt, Artificial Sequence
  derived and/or modified sequence opt1 from anti-HIV_119-044670_VR-Chain
cagagcgugcugacccagcccccguccgucagcggcgcccccggggagcgcgugaccaucuccugcacgggcaacaccagcaacaucgggaccuacgacgugcagugguaccagcaccuccccggcaccgcgccccggcugcugaucuaccacaacgucaaccucccguccggggugcccgaccgcuucagcgccuccaagagcggcacguccgccacccuggccaucaccggccugcagaccggggacgaggccgacuacuacugcacgaucuggggcgugcggaagggggucggcgccguguucgggaccggcaccaaggugaccguccuc

SEQ ID NO: 10097 - RNA, 321 nt, Artificial Sequence
  derived and/or modified sequence opt1 from anti-HIV_119-044140_VR-Chain
cagagcgugcugacccagcccccguccgucagcgccgcccccggccagaaggugaccaucuccugcagcgggggcacguccaacaucgggaaccacuucgugagcugguaccgccaccuccccggcaccgcgcccaagcugcugaucuacgagaacaacaaccggccguccgggauccccgaccgcuucagcggcgccaaguccggcaccagcgccacccucgccaucacggggcugcagaccggcgacgagggggacuacuacugcgccaccugguccggcagccugaacaucgggaccggcacgaaggucaccgugcuc

SEQ ID NO: 10098 - RNA, 333 nt, Artificial Sequence
  derived and/or modified sequence opt1 from anti-HIV_119-042776_VR-Chain
cagagcgugcugacccagcccccguccgucagcgccgcccccggccagaaggugaccaucuccugcagcggguccagcuccaacaucggcaacaacuacgugagcugguaccagcaccuccccgggacggcgcccaagcugcugaucuacgaguccgcccgccggccgagcggcacccccgaccgcuucuccgggagcaaguccggcaccagcgccacccucgccaucacgggccugcagaccggggacgaggccgacuacuacugcacccuguggggcguccggaagggggugggcgcgguguucgggaccggcacgcgcgucaccgugcuc

SEQ ID NO: 10099 - RNA, 333 nt, Artificial Sequence
  derived and/or modified sequence opt1 from anti-HIV_119-042581_VR-Chain
cagagcgugcugacccagcccccguccgucagcgccgcccccggccagaaggugaccaucuccugcagcggguccagcuccaacaucggcaacaacuucgugagcugguaccagcagcuccccgggacggcgcccaagcugcugaucuucgagacccaccgccggccguccggcauccccgaccgcuucagcggguccaagagcggcaccuccgccacccucgccaucacgggccugcagagcggggacgaggccgacuacuacugcgccgucuggggcgugcggcagggggcgggcgccguguucgggaccggcaccaaggucaccgugcug

SEQ ID NO: 10100 - RNA, 333 nt, Artificial Sequence
  derived and/or modified sequence opt1 from anti-HIV_119-040905_VR-Chain
cagagcgugcugacccagcccccguccgucagcgccgcccccggccagaaggugaccaucuccugcagcgggaacuccagcaacaucggcgacaacuucguguccugguaccagcagcuccccgggaucgcgcccaagcugcuggucuacgagacgaacaagcgcccgagcggcauccccgaccgguucgccggguccaagagcggcaccuccgccacccucgugaucaccggccugcagacgggggacgaggccgacuucuacugcggcaccugggacgggagccugcgcaccggcggggugaucggcaccggcacgcgggucaccgugcuc

SEQ ID NO: 10101 - RNA, 321 nt, Artificial Sequence
  derived and/or modified sequence opt1 from anti-HIV_119-040322_VR-Chain
cagagcgugcugacccagcccccguccgucagcgccgcccccggccagaagguggugaucuccugcagcggguccagcuccaucaucgagaagaacagcaucuccugguaccagcagggccccggggcggcccccaagcuccugaucuacgagaacgacaagcgcccgagcggcauccccgaccgguucuccgggagcaaguccggcaccacgggcacccuggccaucaccgggcuccagaccggcgacgaggccgacuacuucugcgccacguggagcgggcgccugaacaucggcaccgggaccaaggucaccgugcug

SEQ ID NO: 10102 - RNA, 324 nt, Artificial Sequence
  derived and/or modified sequence opt1 from anti-HIV_119-039892_VR-Chain
cagagcgugcugacccagcccccguccgucagcgccgcccccggccagaaggugaccaucuccugcagcggguccaacgcgaacaucggcaacaaggacgugagcugguaccagcagcuccccgccacggcccccaagcugcugaucuacgaguccaacaagcgcccgagcgggauccccgaccgguucuccggcagcaaguccgggaccagcgccacccucgccaucaccggccugcagacgggcgacgaggcggacuacuacugcgccaccugggacgggcgcgucuccggcaucgggaccggcaccaaggugacggugcug

SEQ ID NO: 10103 - RNA, 324 nt, Artificial Sequence
  derived and/or modified sequence opt1 from anti-HIV_119-039764_VR-Chain
cagagcgugcugacccagcccccguccgucagcgccgcccccggccagaaggugaccaucuccugcagcggguccgcgagcaacaucggcaagaacuucguguccugguaccagcagguccccgggacggcccccaagcuccugaucuacgagaacaaccgccggccgagcggcacccccgaccgcuucuccgggagcaaguccggcaccagcggcacccuggccaucuccgggcuccagacgggcgacgaggccgacuacuacugcgagaccugggacgggagcggcgggguguucggcaccggcaccaaggugacgguccug

SEQ ID NO: 10104 - RNA, 333 nt, Artificial Sequence
  derived and/or modified sequence opt1 from anti-HIV_119-039188_VR-Chain
cagagcgugcugacccagcccccgucccucagcggcgcccccgggcagaccgucacgaucuccugcagcggcuccagcuccaacaucgggaacaacuacgugagcugguaccagcagcugcccggcaccgcccccaagcugcucaucuacgacuccaaccgccggccgagcgggauccccgaccgcuucuccggcagcaaguccggcaccagcgcgacccuggccaucuccgggcugcagacgggcgacgaggccgacuacugcugcgccguguggggcguccggcgcggggccggggcgguguucggcgccggcaccaaggugaccguccuc

SEQ ID NO: 10105 - RNA, 321 nt, Artificial Sequence
  derived and/or modified sequence opt1 from anti-HIV_119-039058_VR-Chain
cagagcgugcugacccagcccccguccgucagcggcgcccccgggcagcgcgugaccaucuccugcacgggcagcuccagcaacaucgggaacaacuacguguccugguaccggcgccuccccggcaccgcccccaagcugcugaucuacgagaacaacaagcggccgagcgggauccccgaccgcuucuccggcgccaagagcggcaccuccgcgacccucgccaucacggggcugcagaccggcgacgaggccgacuacuucugcagcaccugguccgggagccugaacuucggcaccgggacgcgggucaccgugcuc

SEQ ID NO: 10106 - RNA, 321 nt, Artificial Sequence
  derived and/or modified sequence opt1 from anti-HIV_119-038837_VR-Chain
cagagcgugcugacccagcccccguccgucagcgccgcccccggccagaaggugaccaucuccugcagcgggggcacguccaacaucgggaacaacuucgugagcugguaccagcaccuccccggcaccgcgcccaagcugcugaucuucgagaacaacaagcgcccguccgggguccccgaccgguucagcggcgccaaguccggcaccagcgccacccucgccaucacggggcugcagaccggcgacgagggggacuacuacugcgccaccugguccggcagccugaacaucgggaccggcacgaaggugaccgugcuc

SEQ ID NO: 10107 - RNA, 321 nt, Artificial Sequence
  derived and/or modified sequence opt1 from anti-HIV_119-038396_VR-Chain
cagagcgugcugacccagcccccguccgucagcgccacccccggccagaaggugacgaucuccugcagcggguccaacagcaacaucggcaacaaguacguguccugguaccagcuguuccccgggaccgcccccaagcuccugaucagcgagaacaaccgccggccguccggcacccccgaccgcuucagcggguccaagagcggcaccuccgcgacgcucgccaucaccggccugcagaccggggacgaggccgacuacuacugcgccaccuggagcggcucccugaacaucgggacgggcaccaaggucaccgugcuc

SEQ ID NO: 10108 - RNA, 321 nt, Artificial Sequence
  derived and/or modified sequence opt1 from anti-HIV_119-036918_VR-Chain
cagagcgugcugacccagcccccguccgucagcgccgcccccggccagaaggugaccaucuccugcagcggggccacguccaacaucugggaccacuacgugagcugguaccuccagguccccggcaccgcgccccgccugcugaucuacgacaacgacaagcggccguccgggauccccgaccgcuucagcggcuccaagagcgggaccuccgccacccucgccaucacgggccugcagaccggcgacgagggggacuacuacugcgccaccuggagcggcucccugaacaucgggaccggcacgaaggugaccgugcuc

SEQ ID NO: 10109 - RNA, 324 nt, Artificial Sequence
  derived and/or modified sequence opt1 from anti-HIV_119-036592_VR-Chain
cagagcgugcugacccagcccccguccgucagcgccgcccccggccagaaggugaccaucuccugcagcggguccaacagcaacacgggcaacaaggacguguccugguaccagcagguccccgcgaccgcccccaagcuccugaucuacgagagcaacaagcgcccguccgggauccccgaccgguucagcggcuccaagagcgggaccuccgccacccuggccaucacgggccuccagaccggcgacgaggccgacuacuacugcgcgaucugggacgggcgcgugagcgugaucggcaccgggaccaaggucacggugcug

SEQ ID NO: 10110 - RNA, 324 nt, Artificial Sequence
  derived and/or modified sequence opt1 from anti-HIV_119-036310_VR-Chain
cagagcgugcugacccagcccccguccgucagcgccgcccccggccagaaggugaccaucuccugcagcggguccacgagcaacaucggccagaacuacguguccugguaccagcagcuccccgggaccgcgcccaagcugcugaucuacgagaacaaccgccggccgagcggcucccccgaccgcuucagcggguccaagagcggcaccuccgccacccucgccaucacgggccugcagaccggggacgaggccgacuacuacugcgagaccugggacggcagcgggggcgucuucgggaccggcacgaaggugaccgugcug

SEQ ID NO: 10111 - RNA, 333 nt, Artificial Sequence
  derived and/or modified sequence opt1 from anti-HIV_119-035618_VR-Chain
cagagcgugcugacccagcccccguccgucagcgccgcccccggccagaaggugaccaucuccugcagcggguccagcuucacgaucggcaacaaccacguguccugguaccagcagcuccccgggaccgcgcccaagcugcugaucuucgagagccacaagcgcccguccggcguccccgaccgguucagcggguccaagagcggcaccuccgccacccucgccaucacgggccugcagaccggggacgaggccgacuacuacugcaccguguggggcgugcgcaagggggucggcgccguguucgggaccggcacgaaggugaccguccug

SEQ ID NO: 10112 - RNA, 321 nt, Artificial Sequence
  derived and/or modified sequence opt1 from anti-HIV_119-035569_VR-Chain
cagagcgugcugacccagcccccguccgucagcggcgcccccgggcagaccgugacgaucuccugcaccggcagcuccagcaacaucgggggcuacgacgugcacugguaccagcagcuccccgggaccgcccccaagcugcugaucuacgagaacaaccgccggccguccggcacccccgaccgcuucagcggcgcgaaguccgggacgagcgccacccucgccaucaccggccugcagaccggggacgagggcgacuacuacugcgccacgugguccgggagccugaacaucggcaccggcaccaaggucaccgugcuc

SEQ ID NO: 10113 - RNA, 324 nt, Artificial Sequence
  derived and/or modified sequence opt1 from anti-HIV_119-035466_VR-Chain
cagagcgugcugacccagcccccguccgucagcgccgccgcgggccagaacgugaacaucuccugcagcgggaagaaguccaacaucggcaacaacuacgugagcugguaccagcaguuccccgggaccgcccccaagcuccugaucuacggcaacacgaaccgccccuccgggaucccggaccgguucagcggcuccaagagcggcaccuccgccacccuggccaucaccgggcuccagacgggcgacgacgccgacuacuacugcgagaccugggacgggagcggcggggucuucggcaccggcaccaaggugacggugcug

SEQ ID NO: 10114 - RNA, 333 nt, Artificial Sequence
  derived and/or modified sequence opt1 from anti-HIV_119-035157_VR-Chain
cagagcgugcugacccagcccccguccgucagcgccgcccccggccagaaggugaccaucuccugcagcggguccagcuccaacaucggcaacaacuucgugagcugguaccagcagcgccccgggacggcgcccaagcuccugaucuacgagaccaacaagcggccguccggcauccccgaccgcuucagcggguccaagagcggcaccuccgccacccuggccaucacgggccuccagaccggggacgaggccgacuacuacugcgccaccugggcgccccggcugaacagcgcccgcgucuucggcaacgggaccauggugacggugcug

SEQ ID NO: 10115 - RNA, 333 nt, Artificial Sequence
  derived and/or modified sequence opt1 from anti-HIV_119-035121_VR-Chain
cagagcgugcugacccagcccccguccgucagcgccgcccccggccagaaggugaccaucuccugcagcggguccacgagcuacaucggcaacaaguacguguccugguaccagcaguuccccggggcggcccccaagcuccugaucuacgagaacaacaagcggccgagcggcauccccgaccgguucuccgccagcaaguccgccaccagcgccacccuggcgaucaccgggcuccagacgggcgacgaggccgacuacugcugcgccgucuggggcgugcgccgcggggccggcgcgguguucggggccggcaccaaggucaccgugcug

SEQ ID NO: 10116 - RNA, 324 nt, Artificial Sequence
  derived and/or modified sequence opt1 from anti-HIV_119-035046_VR-Chain
cagagcgcccugacccagcccgccuccgugagcggcuccccggggcagagcaucaccaucuccugcacgggcaccagcuccgacgucggguacgacuacgugagcugguaccgccaggugcccgcgaccacccccaagcuccugaucuacgagaacaacaagcggcccuccggcaucccggaccgcuucagcggguccaagagcggcacguccgccacccuggccaucaccggccuccagaccggggacgaggccgacuacuacugcgccacgugggacggccgggucagcgugaucgggaccggcaccaaggugaccgucgug

SEQ ID NO: 10117 - RNA, 324 nt, Artificial Sequence
  derived and/or modified sequence opt1 from anti-HIV_119-034754_VR-Chain
cagagcgugcugacccagcccccguccgucagcgccgcccccggcgagaaggugaccaucuccugcagcggguccagcuccaacaucggcaacaacuacgugagcugguaccagcagcuccccgggacgguccccaagcugcugaucuacgacaacaacaagcgcccguccggcacccccgaccgguucagcggguccaagagcggcaccuccgcgacccucgccaucacgggccugcagaccggggacgaggccgacuacuacugcgagaccugggacggcagcgggggcguguucgggaccggcacgaaggugaccguccug

SEQ ID NO: 10118 - RNA, 324 nt, Artificial Sequence
  derived and/or modified sequence opt1 from anti-HIV_119-034318_VR-Chain
cagagcgugcugacccagcccccguccgucagcgccgcccccggccagaagaucaccaucuccugcagcggguccagcuccaacaucggcaacaacgacgugagcugguaccagcagcuccccgggacggcgcccaagcugcugaucuacgagaacgaccgccggccguccggcacccccgaccgcuucagcggguccaagagcggcaccuccgccacccucgccaucacgggccugcagaccggggacgaggccgacuacuacugcgagaccugggacggcagcgggggcguguucgggaccggcacgaaggucaccgugcug

SEQ ID NO: 10119 - RNA, 333 nt, Artificial Sequence
  derived and/or modified sequence opt1 from anti-HIV_119-033780_VR-Chain
cagagcgugcugacccagcccccguccgucagcgccgcccccggccagcgcgugaccaucuccugcagcgggacguccagcaacaucggcgagaacuacguguccugguaccagcagauccccgggaccgcgcccaagcuccugaucuacgagaacaacaagcggccgagcggcauccccgaccgcuucuccgggagcaaguccggcaccagcgccacccuggucaucacgggccuccagaccggggacgaggccgacuucuacugcggcaccuggggcgggucccugcggaccgggggcgugcugggcacggggacccgcgugaccguccuc

SEQ ID NO: 10120 - RNA, 333 nt, Artificial Sequence
  derived and/or modified sequence opt1 from anti-HIV_119-033632_VR-Chain
cagagcgugcugacccagcccccguccgucagcgccgcccccggccagcgcgugaccaucuccugcagcgggggcuccagcaacaucggguccaacuacgugagcugguaccagcagcuccccggcacggcgcccaagcugcugaucuaccagaacaacaagcggccguccgggauccccgaccgcuucagcggcuccaagagcggcaccuccgccacccucgggaucaccggccugcagacgggggacgaggccgacuacuacugcaccgucuggggcgugcggaagggggugggcgccgucuucggcaccgggaccaaggugacggugcug

SEQ ID NO: 10121 - RNA, 333 nt, Artificial Sequence
  derived and/or modified sequence opt1 from anti-HIV_119-033183_VR-Chain
cagagcgugcugacccagcccccguccgucagcgccgcccccggccagauggugaccaucuccugcagcgggggcgcguccaaccucgggaagaacagcguguccugguaccagcagcugcccggcacggcccccaagcugcucaucuacgaggacaaccgccggccgagcgggacccccgaccgcuucuccggcagccgguccggcaccagcgccacccuggccaucacggggcugcagaccggcgacgaggccgacuacuacugcaccaucuggggcguccgcaagggggugggggcgguguucggcaccggcacgaaggucaccgugcuc

SEQ ID NO: 10122 - RNA, 333 nt, Artificial Sequence
  derived and/or modified sequence opt1 from anti-HIV_119-030696_VR-Chain
cagagcgugcugacccagcccccguccgucagcggcgcccccgggcagaucgugacccucuccugcacgggcgccaugaccaacaucgggaacaacgacgugcacugguaccagcaccuccccggcaccgggcccaagcugcugaucuacgagaacaacaagcgcccgagcggcauccccgaccgguucuccggcagcaaguccgggaccagcgcgacgcuggucaucaccggccugcagaccggggacgaggccgacuucuacugcggcaccugggacgggucccuccgcacgggcggcgugaucgggaccggcacccgggugaccguccug

SEQ ID NO: 10123 - RNA, 324 nt, Artificial Sequence
  derived and/or modified sequence opt1 from anti-HIV_119-030059_VR-Chain
cagagcgugcugacccagcccccguccgucagcgccgcccccggccagaagguggugaucuccugcagcggguccagcuccaucaucgagaagaacagcaucuccugguaccagcagggccccggggcggcccccaagcuccugaucuacgagaacgacaagcgcccgagcggcaucuccgaccgguucagcggguccaagagcgccaccuccgccacgcuggccaucaccggccuccacaccggcgacgaggcggacuacuacugcgagaccugggacgggagcggcggggucuucggcacggggaccaaggugaccgugcug

SEQ ID NO: 10124 - RNA, 333 nt, Artificial Sequence
  derived and/or modified sequence opt1 from anti-HIV_119-029589_VR-Chain
cagagcgugcugacccagcccccguccgucagcgccgcccccggccagaaggugaccaucuccugcagcgggacguccagcaacaucggcaacaacuucguguccugguaccagcuccugcccgggaccgcgccccgccugcucaucuacgacaacaacaagcggccgagcggcacccccgaccgcuucuccgggagcaaguccggcaccagcgccacgcugggcaucaccgggcugcagaccggcgacgaggccgacuucuacugcgggaccugggacggcucccuccggaccgggggcgucaucggcacggggacccgcgugaccgugcug

SEQ ID NO: 10125 - RNA, 324 nt, Artificial Sequence
  derived and/or modified sequence opt1 from anti-HIV_119-029448_VR-Chain
cagagcgugcugacccagcccccguccgucagcgccgcccccggccagaaggugaccaucuccugcagcgggaacuccagcaacaucggcaagaacuccgugagcugguaccaccagcuccccgggacggcgcccaagcugcugaucuacgagaacgaccgccggccguccggcacccccgaccgcuucagcggguccaagagcggcaccuccgccacccucgccaucacgggccugcagaccggggacgaggccgacuacuacugcgagaccugggacggcagcgggggcgucuucgggaccggcacgaaggugaccgugcug

SEQ ID NO: 10126 - RNA, 333 nt, Artificial Sequence
  derived and/or modified sequence opt1 from anti-HIV_119-029220_VR-Chain
cagagcgugcugacccagcccccguccgucagcgccgcccccggccagaaggugaccaucuccugcagcggguccacgagcaacaucggccagaacuacguguccugguaccagcagcuccccgggaccgcgcccaagcugcugaucuacgagaacgaccgccggccgagcggcauccccgaccgcuucuccgggagcaaguccggcaccagcgccacccucgccaucuccggccugcagacgggggacgaggccgacuacugcugcgccgucuggggcgugcggcgcggggcgggcgccguguucgggcccggcaccaaggucaccgugcug

SEQ ID NO: 10127 - RNA, 333 nt, Artificial Sequence
  derived and/or modified sequence opt1 from anti-HIV_119-028317_VR-Chain
cagagcgugcugacccagcccccguccgucagcgccgcccccggccagaaggugaccaucuccugcagcggguccagcuccaacaucggcaacgacuacgugagcugguaccagcagcuccccgggacggcgcccaagcugcugaucuacgagaacaacaagcgcccguccggcauccccgaccgguucagcggguccaagagcggcaccuccgccacccucgccaucaccggccugcagacgggggacgaggccgacuacuacugcaccaucuggggcguccgcaagggggugggcgccguguucgggaccggcaccaaggucacggugcug

SEQ ID NO: 10128 - RNA, 324 nt, Artificial Sequence
  derived and/or modified sequence opt1 from anti-HIV_119-028165_VR-Chain
cagagcgugcugacccagcccccguccgucagcgccgcccccggccagaccgugacgaucuccugcagcgggaucaccuccaacaucggcaagaacgacgugagcugguaccagcagcuccccgggaccgcgcccaagcugcugaucuccgagaacaaccgccggccgagcggcauccccgaccgcuucuccgggagcaaguccggcaccagcgccacgcucgccaucaccggccugcagaccggggacgaggccgacuacuacugcgccaucugggacggccgggucuccgugaucgggaccggcacgaaggugaccguccug

SEQ ID NO: 10129 - RNA, 324 nt, Artificial Sequence
  derived and/or modified sequence opt1 from anti-HIV_119-027147_VR-Chain
cagagcgugcugacccagcccccguccgucagcgccgcccccggccagaccgugacgaucuccugcagcggguccaccagcgacaucggcaagaacgacguguccugguaccagcagcuccccgggaucgcgcccaagcugcugaucagcgagaacaaccgccggccguccggcacccccgaccgcuucagcggguccaagagcggcaccuccgccacgcucgccaucaccggccugcagaccggggacgaggccgacuacuacugcgagaccugggacggcagcggggccgucuucggcacggggaccaaggugaccgugcug

SEQ ID NO: 10130 - RNA, 333 nt, Artificial Sequence
  derived and/or modified sequence opt1 from anti-HIV_119-026743_VR-Chain
cagagcgugcugacccagcccccguccgucagcgccgcccccggccagaacgugaccaucuccugcagcggguccagcuccaacaucggcaacaacuucgugagcugguaccagcagcgccccgggacgggccccaagcuccugaucuacgagaccaaccggcgcccguccgggauccccgaccgguucagcggcuccaagagcggcaccuccgcgacccuggccaucacggggcuccagaccggcgacgaggccgacuacuacugcgccaccugggcccccagccugaacuccgcgcgcgucuucgggaccggcacgaaggugaccgugcug

SEQ ID NO: 10131 - RNA, 333 nt, Artificial Sequence
  derived and/or modified sequence opt1 from anti-HIV_119-026508_VR-Chain
cagagcgugcugacccagcccccguccgucagcgccgcccccggccagaaggugaccaucuccugcagcggguccagcuccacgaucggcaacaacuacaucagcugguaccaggugcuccccgggaccgcgcccaagcuggucaucuucaagaacaacgagcgcccgucccgggugcccgaccgcuucagcggcuccaagagcgggaccuccgccacccugggcaucacgggccuccagcugggggacgagggcgacuacuacugcgggaccugggagaccagccuguccggcgggggcguguucggcaccgggacgaaggucaccgugcuc

SEQ ID NO: 10132 - RNA, 324 nt, Artificial Sequence
  derived and/or modified sequence opt1 from anti-HIV_119-025683_VR-Chain
cagagcgugcugacccagcccccguccgucagcgccgcccccggccagaaggugaccaucuccugcagcggguccagcuccaacaucggcaacaacuacgugagcugguaccagcagcuccccgggacggcgcccaagcugcugaucuacgagaacaacaagcgcccguccggcauccccgaccgguucagcgacucccagagcgggaccuccgccacccucgccaucaccggccugcagacgggcgacgaggccgacuacuacugcgagaccugggacgggagcggcggggucuucggcaccgggaccaaggugacggugcug

SEQ ID NO: 10133 - RNA, 333 nt, Artificial Sequence
  derived and/or modified sequence opt1 from anti-HIV_119-025614_VR-Chain
cagagccugcucacccagcccccguccgugagcgccgcccccggccagaacgucaucaucuccugcagcggguccagcuccaacaucggcaagaacuacguggcgugguaccagcagguccccgggaccgcccccaagaucgugguguucgagacgaccaaccgcccgagcggcauccccgaccgguucuccgggagcaaguccggcaccagcgccacccuggccaucacgggccugcagaccggggacgaggccgacuacuacugcaccguguggggcguccgcaagggggugggcgcgguguucgggaccggcacgaaggucaccgugcuc

SEQ ID NO: 10134 - RNA, 324 nt, Artificial Sequence
  derived and/or modified sequence opt1 from anti-HIV_119-025548_VR-Chain
cagagcauccugacccagcccccguccgugagcgccgcccccggccagaaggucaccaucuccugcagcggguccagcuccaacaucggcaacaacuacgugagcugguaccagcacgugcccgggacggcgcccaagcuccugaucuacgagaacaaccgccggccguccggcacccccgaccgcuucagcggguccaagagcggcaccuccgccacccuggccaucacgggccuccagagcggggacgaggccgacuacuacugcggcaccugggacggguccggcggggucuucggcaccggcaccaaggugacggugcug

SEQ ID NO: 10135 - RNA, 333 nt, Artificial Sequence
  derived and/or modified sequence opt1 from anti-HIV_119-025526_VR-Chain
cagagcgugcugacccagcccccguccgucagcgccgcccccggccagaaggugaccaucuccugcagcggguccgcgagcaacaucggcaagaacuucguguccugguaccagcagcuccccgggacggcccccaagcugcugaucuacgagaacaaccgccggccgagcggcacccccgaccgcuucuccgggagcaaguccggcaccagcgccacccucgccaucacgggccugcagaccggggacgaggccgacuacuacugcaccgucuggggcgugcggaagggggugggcgcggucuucgggaccggcacgaaggugaccgugcug

SEQ ID NO: 10136 - RNA, 324 nt, Artificial Sequence
  derived and/or modified sequence opt1 from anti-HIV_119-023552_VR-Chain
cagagcgugcugacccagcccccguccgucagcgccgcccccggccagaccgugacgaucuccugcagcggguccaccagcaacaucggcaagaacgacguguccugguaccagcagcuccccgggaccgcgcccaagcugcugaucagcgagaacaaccgccggccguccggcacccccgaccgcuucagcgccuccaagagcgggacguccgccacccucgccaucaccggccugcagaccggcgacgaggccgacuacuacugcgagacguggcacgggagcggcggggucuucggcaccgggaccaaggugaccgugcug

SEQ ID NO: 10137 - RNA, 321 nt, Artificial Sequence
  derived and/or modified sequence opt1 from anti-HIV_119-023092_VR-Chain
cagagcgugcugacccagcccccguccgucagcgccgcccccggccagaaggugaccaucuccugcagcggguccacgagcgaccucggccagacccgcguguccugguaccagcagcugccccggagcgcgcccgagcugcucaucuucgagaacaaccgccggccguccgggauccccgaccgcuucagcggcgccaaguccgggaccagcgccacccuggccaucacgggccugcagaccggcgacgaggccgacuacuucugcuccaccuggagcgggucccucaacuucggcaccgggacgcgggucaccgugcug

SEQ ID NO: 10138 - RNA, 324 nt, Artificial Sequence
  derived and/or modified sequence opt1 from anti-HIV_119-022793_VR-Chain
cagagcgugcugacccagcccccguccgucagcgccgcccccggccagaaggugaccaucuccugcagcgggggcacguccaacaucgggaacaacuacgugagcugguaccgccggcuccccggcaccgcgcccaagcugcugaucuacgagaacaacaagcgcccguccgggauccccgaccgguucagcggcgccaaguccggcaccagcgccacccucgggaucacgggccugcagaccggggacgaggccgacuacuacugcgagaccugggacgacuccggcggggucuucggcaccggcacgaaggugaccgugcug

SEQ ID NO: 10139 - RNA, 324 nt, Artificial Sequence
  derived and/or modified sequence opt1 from anti-HIV_119-022395_VR-Chain
cagagcgugcugacccagcccccguccgucagcgccgcccccggccagaccgugacgaucuccugcagcggguccaccagcaacaucggcaagaacgacguguccugguaccagcagcuccccgggaccgcgcccaagcugcugaucagcgacaacaaccgccggccguccuggacccccgaccgcuucagcggcuccaagagcgggacguccgccacccucgccaucaccggccugcagaccggcgacgaggccgacuacuacugcgagacgugggacgggagcggcggggucuucggccccgggacccgggugaccgugcug

SEQ ID NO: 10140 - RNA, 333 nt, Artificial Sequence
  derived and/or modified sequence opt1 from anti-HIV_119-022334_VR-Chain
cagagcgugcugacccagcccccguccgucagcgccgcccccggccagaacgugaacaucuccugcagcgggggcuccagcaacaucggguccaacuacgugagcugguaccagcaguuccccggcaccgcgcccaagcaccucaucuacgagaacaacaagcgcccguccgggauccccgaccgguucagcgacucccagagcggcacguccgccacccugggcaucaccgggcugcagaccggcgacgaggccgacuacuacugcgggacgugggacggcagccuccgcaccgggggcgucaucggcaccgggacccgggugacggugcug

SEQ ID NO: 10141 - RNA, 321 nt, Artificial Sequence
  derived and/or modified sequence opt1 from anti-HIV_119-021866_VR-Chain
cagagcgugcugacccagcccccguccgucagcgccgcccccggccagcgcgugaccaucuccugcagcggguccgcgagcaacaucggcaagaacuucguguccugguaccagcagcuccccgggaaggcccccaagcugaucaucuacgaggucacgaagcggccgagcggcgugcccgcccgcuucuccgggagcaaguccggcaccagcgccacccuggccaucaccggccuccagacgggggacgaggcggacuacuucugcuccaccuggagcggcucccugaacuucgggaccggcacccgggugacgguccug

SEQ ID NO: 10142 - RNA, 324 nt, Artificial Sequence
  derived and/or modified sequence opt1 from anti-HIV_119-021278_VR-Chain
cagagcgugcugacccagcccccguccgucagcgccgcccccggccagaaggugaccaucuccugcagcggguccgcgagcaacaucggcaagaacuucguguccugguaccagcagcuccccgggacggcccccaagcugcugaucuacgagaacaaccgccggccgagcggcacccccgaccgcuucuccgggagccgguccggcaccagcgccacccucggcaucacggggcugcagaccggcgacgaggcccacuacuacugcgagaccugggacgacuccgggggcgucuucgggaccggcacgaaggugaccgugcug

SEQ ID NO: 10143 - RNA, 333 nt, Artificial Sequence
  derived and/or modified sequence opt1 from anti-HIV_119-021183_VR-Chain
cagagcgugcugacccagcccccguccgucagcgccgcccccggccagaaggugaccaucuccugcagcgggaacuccagcaacaucggcaacaacuucguguccugguaccagcaguuccccgggacggcgcccaagcuccuggucuucgagacccaccgccggccgagcggcauccccgaccgcuucuccgggagcaaguccggcaccagcgccacccuggccaucacgggccuccagaccggggacgaggccgacuacuacugcgccguguggggcgugcggcgcggggucggcgcgguguucggggccggcaccaaggugaccguccug

SEQ ID NO: 10144 - RNA, 333 nt, Artificial Sequence
  derived and/or modified sequence opt1 from anti-HIV_119-019376_VR-Chain
cagagcgugcugacccagcccccguccgucagcgccgcccccggccagaaggugaccaucuccugcagcggguccagcuccaacaucggcaacaacuacgugagcugguaccagcagguccccgggacggcgcccaagcuccugguguacgagaccuaccgccggccguccggcauccccgaccgcuucagcggguccaagagcggcaccuccgccacccuggccaucacgggccuccagaccggggacgaggccgacuacuacugcaccaucuggggcgugcggaagggggucggcgccguguucgggaccggcacgaaggugaccguccug

SEQ ID NO: 10145 - RNA, 321 nt, Artificial Sequence
  derived and/or modified sequence opt1 from anti-HIV_119-019238_VR-Chain
cagagcgugcugacccagcccccguccgucagcgccgcccccggccagaaggugaccaucuccugcagcgggacguccagcaacaucggcaacaaccacguguccugguaccagcagguccccgggaccgcgcccaagcuccugaucuacgagaacaacaagcgcccgagcggcauccccgcccgguucuccgccgccaagagcgggaccuccgccacccuggcgaucacgggccuccagaccggcgacgaggccgacuacuucugcgccaccuggagcgggcgccugaacaucggcaccgggacgaaggugaccgugcug

SEQ ID NO: 10146 - RNA, 333 nt, Artificial Sequence
  derived and/or modified sequence opt1 from anti-HIV_119-018500_VR-Chain
cagagcgugcugacccagcccccguccgucagcgccgcccccggccagaaggugaacaucuccugcagcggguccagcuccaacaucggcaacaacuucgugagcugguaccagcagcgccccgggaccgcgcccaagcuccugaucuacgagacgaaccggcgcccguccggcauccccgaccgguucagcggguccaagagcggcaccuccgccacccuggccaucaccggccuccagacgggggacgaggccgacuacuacugcgccaccugggcggccagccugaccuccgcccgcgucuucggcaucgggaccaaggugacggugcug

SEQ ID NO: 10147 - RNA, 324 nt, Artificial Sequence
  derived and/or modified sequence opt1 from anti-HIV_119-018318_VR-Chain
cagagcgugcugacccagcccccguccgucagcgccgcccccggccagaccgugaucaucuccugcagcggguccacgagcaacaucggcaagaacgacguguccugguaccagcagcuccccgggaccgcgcccaagcugcugaucagcgagaacaaccgccggccguccggcacccccgaccgcuucagcggguccaagagcggcaccuccgccacgcucgccaucaccggccugcagaccggggacgacgccgacuacuacugcgagaccugggacggcagcgggggcgucuucgggacgggcaccaaggugacccuggug

SEQ ID NO: 10148 - RNA, 333 nt, Artificial Sequence
  derived and/or modified sequence opt1 from anti-HIV_119-018218_VR-Chain
cagagcgugcugacccagcccccguccgucagcgccgcccccggccagaaggugaccaucuccugcagcgggaacuccagcaacaucggcaacaacuucguguccugguaccagcagcuccccgggacggcgcccaagcugcugaucuacgagaacaaccgccggccgagcggcauccccgaccgcuucuccgggagcaaguccggcaccagcgccacccucgccaucuccggccugcagaccggggacgaggccgacuacuggugcgccgucuggggcgugcggcgcggggcgggcgccguguucggggccggcacgaaggucaccgugcug

SEQ ID NO: 10149 - RNA, 324 nt, Artificial Sequence
  derived and/or modified sequence opt1 from anti-HIV_119-017876_VR-Chain
cagagcgugcugacccagcccccguccgucagcgccgcccccggccagaaggugaccaucuccugcagcggguccacgagcaagaucggccagaacuccgugagcugguaccagcagcuccccgggaccgcgcccaagcugcugaucuacgagaacgaccgccggccguccggcacccccgaccgcuucagcgccuccaagagcgggaccuccgccacgcucgccaucaccggccugcagaccggcgacgaggccgacuacuacugcgagaccugggacgacagcgggggcgucuucgggacgggcaccaaggugaccgugcug

SEQ ID NO: 10150 - RNA, 324 nt, Artificial Sequence
  derived and/or modified sequence opt1 from anti-HIV_119-017740_VR-Chain
cagagcgugcugacccagcccccguccgucagcgccgcccccggccagaaggugaccaucuccugcagcggguccaacagcaacaucggcaacaaggacguguccugguaccgccagguccccgcgacggcccccaagcucccgaucuacgagaacaagaacgagcccagcggggugcccgaccgguucuccggcagcaaguccgggaccagcgccacccuggccaucaccggccugcagacgggcgacgaggccgacuacuacugcgcgaccugggacgggcgcguguccgucaucggcaccgggaccaaggugacggugguc

SEQ ID NO: 10151 - RNA, 321 nt, Artificial Sequence
  derived and/or modified sequence opt1 from anti-HIV_119-017128_VR-Chain
cagagcgugcugacccagcccccguccgucagcgccgcccccggccagaaggugaccaucuccugcagcggguccagcuccaacaucggcaacaacuacgugagcugguaccagcagcuccccgggacggcgcccaagcugcugaucuacgagaacaacaagcgcccguccggcauccccgaccgguucagcggggccaaguccggcaccagcgccacccucgccaucaccggccugcagacgggggacgaggccgacuacuucugcuccaccuggagcggcucccugaacuucgggaccggcacccgcgucacggugcuc

SEQ ID NO: 10152 - RNA, 324 nt, Artificial Sequence
  derived and/or modified sequence opt1 from anti-HIV_119-017044_VR-Chain
cagagcgugcugacccagcccccguccgucagcgccgcccccggccagaaggugaccaucuccugcagcggguccaacagcaacaucggcaacaacuacguguccugguaccaccaccuccccgggacggcgccccgccugcugaucuacgacaacaacaagcggccgagcggcauccccgaccgcuucuccgggagcaaguccggcaccagcgccacccucgccaucaccggccugcagacgggggacgaggccgacuacuacugcgccaccugggacggccgggucuccgugaucgggaccggcacccaggugacgguccug

SEQ ID NO: 10153 - RNA, 321 nt, Artificial Sequence
  derived and/or modified sequence opt1 from anti-HIV_119-016644_VR-Chain
cagagcgugcugacccagcccccguccgucagcgccgcccccggccagaaggugaccaucuccugcagcgggggcacguccaacaucgggaacaacuacgugagcugguaccagcagcuccccggcaccgcgcccaagcugcugaucuacgagaacaacaagcgcccguccgggauccccgcccgguucagcgccgccaaguccggcaccagcgccacccucgcgaucacgggccugcagaccgaggacgaggccgacuacuacugcgccaccugguccgggagccugaacaucggcaccgggacgaaggucaccgugcuc

SEQ ID NO: 10154 - RNA, 333 nt, Artificial Sequence
  derived and/or modified sequence opt1 from anti-HIV_119-015878_VR-Chain
cagagcgcccugacccagcccccguccgccagcggcucccccgggcagagcgugaccaucuccugcagcggcuccagcuccaacaucgggaacaacuucgucagcugguaccagcagcgccccggcacggcgcccaagcuccugaucuacgagaccaacaagcggccguccgggauccccgaccgcuucagcggcuccaagagcggcaccuccgccacccuggccaucacggggcuccagaccggcgacgaggccgacuacuacugcgccaccugggcgccccggcugaacagcgcccgcguguucgggaacggcaccauggugacgguccug

SEQ ID NO: 10155 - RNA, 321 nt, Artificial Sequence
  derived and/or modified sequence opt1 from anti-HIV_119-015538_VR-Chain
cagagcgugcugacccagcccccguccgucagcgccacccccggccagaaggugacgaucuccugcagcggguccagcuccaacaucggcaacaacuacgugagcugguaccgccggcuccccgggaccgcccccaagcaccugaucuacgagaccaacaaccgcccguccggcguccccgcgcggcugagcgccgccaaguccgggaccagcgccacgcucgccaucaccggccugcagaccgaggacgaggcggacuacuacugcgccaccugguccggcagccugaacaucgggacgggcaccaaggugaccgugcuc

SEQ ID NO: 10156 - RNA, 321 nt, Artificial Sequence
  derived and/or modified sequence opt1 from anti-HIV_119-015455_VR-Chain
cagagcgugcugacccagcccccguccgucagcgccacccccggccagaaggugacgaucuccugcagcggguccaacagcaacaucggcaacaaggacguguccugguaccagcacuuccccgggaccgcccccaagcuccugaucuacgagaacaacaagcgcccgagcggcauccccgaccgguucuccgggagcaaguccgcgaccagcgccacccugacgaucaccggccuccagaccgaggacgaggccgacuacuacugcgccaccugguccggcagccugaacaucgggacgggcaccaaggucaccgugcug

SEQ ID NO: 10157 - RNA, 321 nt, Artificial Sequence
  derived and/or modified sequence opt1 from anti-HIV_119-014425_VR-Chain
cagagcgugcugacccagcccccguccgucagcgccgcccccggccagaaggugaccaucuccugcagcgggggcacguccaacaucgggaacaacuacgugagcugguaccagcaccuccccggcaccgcgcccaagcugcugaucuacgagaacaacaagcgcccguccgggauccccgaccgguucagcggcgccaaguccggcaccagcgccacccucgccaucacggggcugcagaccggcgacgagggggacuacuacugcgccaccugguccggcagccugaacaucgggaccggcacgaaggucaccgugcuc

SEQ ID NO: 10158 - RNA, 324 nt, Artificial Sequence
  derived and/or modified sequence opt1 from anti-HIV_119-013582_VR-Chain
cagagcauggugacccagucccccagcgucuccgccgccccgggccagaaggugaccaucagcugcuccgggacgagcuccaacaucggccagaacuacgugagcugguaccagcagcugcccgggaccgcgcccaagcuccugaucuccgagaacaaccgccggcccagcggcaccccggaccgcuucuccgggagcaaguccggcaccagcgccacgcuggccaucaccggccuccagaccggggacgaggccgacuacuacugcgagaccugggacggcuccgggggcgucuucgggacgggcaccaaggugaccgugcug

SEQ ID NO: 10159 - RNA, 333 nt, Artificial Sequence
  derived and/or modified sequence opt1 from anti-HIV_119-013364_VR-Chain
cagagcgugcugacccagcccccguccgucagcgccgcccccggccagaaggugaccaucuccugcagcggguccagcuccaacaucggcaacaacuacgugagcugguaccagcagcuccccgggacggcgcccaagcugcugaucuacgacaacaacaagcgcccguccggcauccccgaccgguucagcggguccaagagcggcaccuccgccacccucgccaucaccggccugcacacgggggacgaggccgacuacuacugcaccgucuggggcgugcgcaagggggugggcgccgucuucgggaccggcaccaaggugacggugcug

SEQ ID NO: 10160 - RNA, 333 nt, Artificial Sequence
  derived and/or modified sequence opt1 from anti-HIV_119-012886_VR-Chain
cagagcauccugacccagcccccguccgugagcgccgcccccggccagaaggucaccaucuccugcagcggguccagcuccacgaucggcaccaacuacgugagcugguaccagcaguuccccgggaccgcgcccaagcuccugguguucgagacccaccgccggccguccggcauccccgaccgcuucagcggguccaagagcggcacguccgccacccuggccaucaccggccuccagaccggggacgaggccgacuacuacugcgccgucuggggcgugcggcgcggggugggcgcggucuucggggccggcacgaaggugaccgugcug

SEQ ID NO: 10161 - RNA, 333 nt, Artificial Sequence
  derived and/or modified sequence opt1 from anti-HIV_119-012249_VR-Chain
cagagcgugcugacccagcccccguccgucagcggcgcccccgggcagaaggugaccaucuccugcagcggcuccagcuccaacaucgggcgcaacuacgugagcugguaccagcagcuccccggcacggcccccaagcugcugaucuacgagaacaacaagcggccguccgggauccccgaccgcuucagcggcuccaagagcggcaccuccgcgacccucgucaucaccgggcugcagacgggcgacgaggccgacuucuacugcgggaccugggacggcagccuguccgggggcggcgugaucgggaccggcacccgggugacgguccuc

SEQ ID NO: 10162 - RNA, 324 nt, Artificial Sequence
  derived and/or modified sequence opt1 from anti-HIV_119-012161_VR-Chain
cagagcuuccugacccagcccccguccgugagcgccgcccccggccagaaggucaccaucuccugcagcggguccaacagcaacaucggcaagaacuacguguccugguaccaguaccuccccgggacggugcccaagcugcugaucuacgagaacgacaagcgcccgagcggcauccccgggcgguucuccgcgagcaaguccggcaccagcgccacccucgccaucaccggccugcagacgggggacgaggccgacuacuacugcggcaccugggacggguccggcggggucuucggcaccggcaccaaggugacggugcug

SEQ ID NO: 10163 - RNA, 324 nt, Artificial Sequence
  derived and/or modified sequence opt1 from anti-HIV_119-012110_VR-Chain
cagagcgugcugacccagcccccguccgucagcgccgcccccggccagaccgugacgaucuccugcagcggguccaccagcaacaucggcaagaacgacguguccugguaccagcagcuccccgggaccgcgcccaagcugcugaucagcgagaacaaccgccggccguccggcacccccgaccgcuucagcggguccaagagcggcacguccgccacccucgccaucagcggccugcagaccggggacgaggccgacuacuacugcggcaccugggacggguccggcggggucuucggcacgggcaccaaggugaccgugcug

SEQ ID NO: 10164 - RNA, 333 nt, Artificial Sequence
  derived and/or modified sequence opt1 from anti-HIV_119-012100_VR-Chain
caggccgugcugacccagcccccgagcgucuccgccgcgcccggccagaagguggccaucagcugcuccgggagcuccagcaacaucggcaacaacuacguguccugguaccagcagcuccccgggaccguccccaagcugcugaucuacgacacggacaagcgcccgagcggcauccccgaccgguucuccgggagcaaguccggcaccagcgccacccucggcaucacccgccugcagacgggggacgaggccgacuacuacugcgccaccugggcgccccggcugaacuccgcccgcguguucggcaacgggaccauggugaccguccuc

SEQ ID NO: 10165 - RNA, 324 nt, Artificial Sequence
  derived and/or modified sequence opt1 from anti-HIV_119-011651_VR-Chain
cagagcgugcugacccagcccccguccgucagcgccgcccccggccagaaggugaccaucuccugcagcgggaacuccagcaacaucggcaacaacuacguguccugguaccagcagcuccccgggacggcgcccaagcugcugaucuacgagaacaacaagcgcccgagcggcauccccgaccgguucuccgggagcaaguccggcaccagcgccacccucgccaucaccggccugcagacgggggacgaggccgacuacuacugcgccaccugggacggccgcgucuccguguucgggaccggcaccaagguggcgguccug

SEQ ID NO: 10166 - RNA, 333 nt, Artificial Sequence
  derived and/or modified sequence opt1 from anti-HIV_119-011479_VR-Chain
cagagcgugcugacccagcccccguccgucagcgccacccccggccagaaggugacgaucuccugcagcggguccaacagcaacaucggcaacaaguacguguccugguaccagcacuuccccgggaccgcccccaagcuccugaucuacgagaacaaccgccggccgagcggcauccccgaccgcuucuccgggagcaaguccggcaccagcgcgacccuggccaucacgggccuccagaccggggacgaggccgacuacuacugcaccaucuggggcguccggaagggggugggcgccguguucgggaccggcacgaaggucaccgugcug

SEQ ID NO: 10167 - RNA, 333 nt, Artificial Sequence
  derived and/or modified sequence opt1 from anti-HIV_119-011232_VR-Chain
cagagcgugcugacccagcccccguccgucagcgccgcccccggccagaacgugaacaucuccugcagcgggggcuccagcaacaucggguccaacuacgugagcugguaccagcaguuccccggcaccgcgcccaagcuccugaucuacgacgacgacaagcggccguccgggaucccccaccgguucagcgccuccaagagcggcacguccgccacccuggccaucagcggccuccagaccggggacgaggccgacuacugcugcgcggucuggggcgugcgccgcggggccggcgccguguucggggccggcaccaaggucacggugcug

SEQ ID NO: 10168 - RNA, 333 nt, Artificial Sequence
  derived and/or modified sequence opt1 from anti-HIV_119-011175_VR-Chain
cagagcgugcugacccagcccccguccgucagcgccgcccccggccagaaggugaccaucuccugcagcggguccaacagcuacaucggcaacaaguacguguccugguaccagcaguuccccgggacggcgcccaagcuccugaucuacgagaacaaccgccggccgagcggcauccccgaccgcuucuccgggagcaaguccggcaccagcgccacccuggccaucuccggccuccagaccggggacgaggccgacuacugcugcgccgucuggggcgugcggcgcggggcgggcgccguguucgggcccggcacgaaggucaccgugcug

SEQ ID NO: 10169 - RNA, 321 nt, Artificial Sequence
  derived and/or modified sequence opt1 from anti-HIV_119-008396_VR-Chain
cagagcgugcugacccagcccccguccgucagcgccgcccccggccagaaggugaccaucuccugcagcggguccagcuccaacaucggcaacaacuacgugagcugguaccagcagguccccgggacggcgcccaagcuccugguguacgagaacacccgccggccguccggcgugcccgaccgcuucagcggggccaaguccggcaccagcgccacccuggccaucacgggccuccagaccggggacgagggcgacuacuacugcgccaccugguccgggagccugaacaucggcaccgggacgaaggucaccgugcug

SEQ ID NO: 10170 - RNA, 324 nt, Artificial Sequence
  derived and/or modified sequence opt1 from anti-HIV_119-007148_VR-Chain
cagagcgugcugacccagcccccguccgucagcgccgcccccggccagaaggugaccaucuccugcagcggguccacgagcaacaucggcaagaacuacguguccugguaccagcaccuccccgggaccgcgcccaagcugcugcucuacgagaacgaccgccggccgagcggcacccccgaccgcuucuccgggagcaaguccggcaccagcgccacgcuggccaucaccggccugcacaccggggacgaggccgacuacuacugcgagaccugggacggcuccgggggcgucuucgggacgggcaccaaggugaccgugcuc

SEQ ID NO: 10171 - RNA, 333 nt, Artificial Sequence
  derived and/or modified sequence opt1 from anti-HIV_119-007029_VR-Chain
cagagcgugcugacccagcccccguccgucagcgccgcccccggccagaaggugaccaucuccugcagcgggaacuccagcaacaucggcaacaacuucguguccugguaccagcagguccccgggacggcgcccaagcuccugcuguacgagaccuaccgccggccgagcggcaucuccgaccgcuucagcggguccaagagcggcaccuccgccacccucgccaucacgggccugcagaccggggacgaggccgacuacuacugcaccguguggggcgugcggaagggggucggcgccguguucgggaccggcacgaaggugaccguccug

SEQ ID NO: 10172 - RNA, 324 nt, Artificial Sequence
  derived and/or modified sequence opt1 from anti-HIV_119-004707_VR-Chain
cagagcgugcugacccagcccccguccgucagcgccgcccccggccagaaggugaccaucuccugcagcggguccacgagcaacaucggcaagaacgacguguccugguaccagcagcuccccgggaccgcgcccaagcugcugaucagcgagaacaaccgccggccguccggcacccccgaccgcuucagcggguccaagagcggcaccuccgccacgcucgccaucaccggccugcagaccggggacgaggccgacuacuacugcgagaccugggacggcagcgggggcgucuucgggacgggcaccaaggugaccgugcug

SEQ ID NO: 10173 - RNA, 333 nt, Artificial Sequence
  derived and/or modified sequence opt1 from anti-HIV_119-003910_VR-Chain
cagagcgugcugacccagcccccguccgucagcgccgcccccggccagaagguggcgaucuccugcagcgggaacaccuccagcaucggcaacaacuucguguccugguaccagcagguccccgggacggcccccaagcuccugguguacgagaccuaccgccggccgagcggcauccccgaccgcuucuccgggagcaaguccggcaccagcgccacccuggccaucacgggccuccagaccggggacgaggccgacuacuacugcaccguguggggcguccggaagggggugggcgcgguguucgggaccggcacgaaggucaccgugcug

SEQ ID NO: 10174 - RNA, 321 nt, Artificial Sequence
  derived and/or modified sequence opt1 from anti-HIV_119-002450_VR-Chain
cagagcgugcugacccagcccccguccgucagcggcgcccccgggcagcgcgugaccaucuccugcacgggcagcuccagcaacaucgggaacaacuacguguccugguaccagggccuccccgggaccgcccccaagcugcugaucuacgagaacaacaagcggccgagcggcauccccgaccgcuucuccggcgccaagagcgggaccgcggccacccucgccaucacgggccugcagaccggggacgaggccgacuacuacugcgcgaccugguccggcagccugaacuucgggaccggcacgaaggucaccgugcuc

SEQ ID NO: 10175 - RNA, 321 nt, Artificial Sequence
  derived and/or modified sequence opt1 from anti-HIV_119-001552_VR-Chain
cagagcgugcugacccagcccccguccgucagcgccgcccccggccagaaggugaccaucuccugcagcggguccaacagcuaccucggcaacaaguacguguccugguaccagcaguuccccgggacggcgcccaagcugcugaucuacgagaacaacaagcgcccgagcggcauccccgaccgguucuccgccagcaaguccgccgccagcgccacccucgcgaucaccgggcugcagaccggcgacgagggcgacuacuacugcgccacguggaccgggucccugaacaucggcaccgggaccaaggucacggugcuc

SEQ ID NO: 10176 - RNA, 333 nt, Artificial Sequence
  derived and/or modified sequence opt1 from anti-HIV_059-188169_VR-Chain
cagagcgugcugacccagcccccguccgucagcgccgcccccggccagaaggugaccaucuccugcagcggguccacgagcaacaucggcgacaacuacguguccugguaccagcagguccccgggaccgcgcccaagcuccugaucuacgagaacaaccgccggccgagcggcacccccgaccgcuucuccgggagcaaguccggcaccagcgccacgcuggccaucaccggccuccagaccggggacgaggccgacuacuacugcggcaccugggacacgucccugagcaccgggggcguguucgggaccggcaccaaggugacgguccug

SEQ ID NO: 10177 - RNA, 333 nt, Artificial Sequence
  derived and/or modified sequence opt1 from anti-HIV_059-183739_VR-Chain
cagagcgugcugacccagcccccguccgucagcgccgcccccggccagaaggugaccaucuccugcagcggguccacgagcaacaucggcaagaacuacguguccugguaccagcagcuccccgggaccgcgcccaagcugcugaucuacgagaacaaccgccggccgagcggcacccccgaccgcuucuccgggagcaaguccggcaccagcgccacgcucggcaucuccgggcugcagaccggcgacgaggccgacuacuacugcgggaccugggacaccagccuguccggcgggggcgucuucggcacggggaccaaggugaccgugcuc

SEQ ID NO: 10178 - RNA, 333 nt, Artificial Sequence
  derived and/or modified sequence opt1 from anti-HIV_059-182376_VR-Chain
cagagcgugcugucccagcccccgagcgucuccgccgcccccggccagaaggugaccaucagcugcuccgggagcuccagcaacaucggcaacuacuacguguccugguaccagcaguuccccgggaccgcgcccaagcuccugaucuacaagaacgacaaccgcccgagcggcauccccgaccgguucuccgggagcaaguccggcacgagcgccacccugggcaucuccgggcuccagaccggcgacgaggccgacuacuacugcgggaccuggggcacgagccuguccgggggcggcgucuucgggaccggcaccaaggugaccgugcug

SEQ ID NO: 10179 - RNA, 333 nt, Artificial Sequence
  derived and/or modified sequence opt1 from anti-HIV_059-182199_VR-Chain
cagagcgugcugacccagcccccguccgucagcgccgcccccggccagaacaucaccaucuccugcagcggguccagcuccaacaucggcagccacuccaucagcugguaccagcaccuccccgggacggcgcccaagaucgugaucuacgacaacgacaagcgcccgcugggcauccccgaccgguucuccgggagcaaguccggcaccagcgccacccugggcaucaccgggcuccagacgggcgacgaggccgacuacuacugcgggaccugggacaccucccugagcggcgggggcguguucggccccgggaccaaggucacggugcug

SEQ ID NO: 10180 - RNA, 324 nt, Artificial Sequence
  derived and/or modified sequence opt1 from anti-HIV_059-169202_VR-Chain
cacagcgugcugacccagcccccguccgucagcgccgcccccggccagaaggugaccaucuccugcagcggguccagcuccaagaucggcaacaacuucgugagcugguaccagcagcuccccgggacggcgcccaagcugcugaucuacgagaacaacaagcgcccguccggcauccccgaccgguucagcggguccaagagcggcaccuccgccacccucgccaucaccggccugcagacgggggacgaggccgacuacuacugcggcaccugggacgggcgcgucagcgugaucggcuccgggaccaagcugaccgugcuc

SEQ ID NO: 10181 - RNA, 324 nt, Artificial Sequence
  derived and/or modified sequence opt1 from anti-HIV_059-155645_VR-Chain
cagagcgcccugacccagcccgccuccgugagcggcuccccggggcagagcaucaccaucuccugcacgggcaccagcuccgacgucggguacaacuacgugagcugguaccagcagcuccccggcaccgcgcccaagcugcugaucuacgagaacaacaagcgccccuccgggaucccggaccgguucagcggcuccaagagcggcaccuccgccacgcucgccaucaccgggcugcagaccggcgacgaggccgacuacuacugcgggaccugggacggccgccugagcgugaucgggacgggcaccaaggucaccgugcuc

SEQ ID NO: 10182 - RNA, 333 nt, Artificial Sequence
  derived and/or modified sequence opt1 from anti-HIV_059-151619_VR-Chain
cagagcgugcugacccagcccccguccgucagcgccgcccccggccagaaggugaccaucuccugcagcggguccagcuccaacaucggcaacaacuucgugagcugguaccagcuccugcccgggacgcccccgaagcugcucaucuucaagaacaacgagcgccccuccggcauccccgaccgguucagcggguccaagagcggcaccuccgcgacccugggcaucaccgggcugcagacgggcgacgagggggacuacuacugcggcaccugggacaccagccucuccgggggcggcgucuucgggaccggcacgcgcgugaccgugcug

SEQ ID NO: 10183 - RNA, 333 nt, Artificial Sequence
  derived and/or modified sequence opt1 from anti-HIV_059-146503_VR-Chain
cagagcgugcugacccagcccccguccgucagcgccacccccggccagaaggugacgaucuccugcagcggguccgccagcaacaucggcaacaacuacguguccugguaccagcaguuccccgggaccgcgcccaagcuccugaucuacgacaccaacaagcgcccgagcggcauccccgaccgguucuccgggagcaaguccggcaccagcgccauccugggcaucacggggcuccagaucggcgacgaggccgacuacuacugcgggaccugggacaccucccugagcggcgggggcgucuucggcaccgggacgaaggugaccgugcug

SEQ ID NO: 10184 - RNA, 324 nt, Artificial Sequence
  derived and/or modified sequence opt1 from anti-HIV_059-136098_VR-Chain
cagagcgugcugacccagcccccguccgucagcgccgcccccggccagcgcgugaccaucuccugcagcggguccagcuccaacaucggcaacaacuacgugagcugguaccagcagcuccccgggacggcgcccaagcugcugaucuacgagaacaaccggcgcccguccggcauccccgaccgguucagcggguccaagagcggcaccuccgccacccucgccaucaccggccugcagacgggggacgagggcgacuacuacugcgcccgcugggacgggcggcugagcgucaucggcuccgggaccaaggugaccgugcuc

SEQ ID NO: 10185 - RNA, 333 nt, Artificial Sequence
  derived and/or modified sequence opt1 from anti-HIV_059-105516_VR-Chain
cagagcgcccugacccagcccccguccgugagcgccgcgcccggccagaaggucaccaucuccugcagcggguccagcuccaacaucggcaacaacuacgugagcugguaccagcagcuccccgggacggcccccaagcugcugaucuacgacaacaacaagcgcccguccggcauccccgaccgguucagcggguccaagagcggcaccuccgccacccucgccaucgccggccugcagaccggggacgaggcgaacuacuacugcggcacgugggacgggagccugcgcaccggcgggguguucggcaccggcaccaaggucacggugcuc

SEQ ID NO: 10186 - RNA, 333 nt, Artificial Sequence
  derived and/or modified sequence opt1 from anti-HIV_059-095709_VR-Chain
cagagcgugcugacccagcccccguccgucagcgccgcccccggccagaaggugaccaucuccugcagcgggcgcuccagcaacaucggcaacaacuucguguccugguaccagcuccugcccgggacggcgcccaagcugcucaucuacaagaacaacgagcggccgagcggcauccccgaccgcuucuccgccagcaaguccgggaccagcgccacccugggcaucaccggccugcagacgggggacgaggccgacuacuacugcggcaccugggacaccucccucagcgggggcggggucuucggcaccggcacgaaggugaccgugcug

SEQ ID NO: 10187 - RNA, 333 nt, Artificial Sequence
  derived and/or modified sequence opt1 from anti-HIV_059-069468_VR-Chain
cagagcgugcugacccagcccccguccgucagcggcgcgccccgccaguccgugaucaucagcugcaccggguccagcuccaacaucggcggguucgacgugcacugguaccagcagcuccccggcacggcccccaagcugcugaucuacgagaacaaccggcgcccgagcgggacccccgaccgguucuccggcagcaaguccggcaccagcgccacccucgccaucacggggcugcagaccggcgacgaggccgacuacuacugcgggaccugggacggcucccugagcaccgggggcgucaucggcacggggaccaaggugaccgugcuc

SEQ ID NO: 10188 - RNA, 333 nt, Artificial Sequence
  derived and/or modified sequence opt1 from anti-HIV_059-060026_VR-Chain
cagagcgugcugacccagcccccguccgucagcgccgcccccggccagaaggugaccaucuccugcagcggguccagcuccaacaucggcaacaacuacgugagcugguaccagcagcuccccgggacgguccccaagcugcugaucuacaagaacgacaagcgcccguccggcauccccgaccgguucagcggguccaagagcgcgaccuccgccacccucggcaucaccggccugcagacgggggacgaggccgacuacuacugcggcaucugggacaccagccuguccgccgggggcguguucgggaccggcacccgcgugacgguccuc

SEQ ID NO: 10189 - RNA, 333 nt, Artificial Sequence
  derived and/or modified sequence opt1 from anti-HIV_059-053668_VR-Chain
cagagcgugcugacccagcccccguccgucagcgccgcccccggccagaaggugaccaucuccugcagcggguccagcuccaacaucggcaacaacuacgugagcugguaccagcagcuccccgggacggcgcccaagcugcugaucuacgagaacaacaagcgcuccagcggcaucccggaccgguucuccgggagcaaguccggcaccagcgccacccucgccaucaccggccugcagacgggggacgaggccgacuacuacugcggcacccgcgacuccagccuguccgggggcggggucaucggcaccggcaccaaggugacggugcuc

SEQ ID NO: 10190 - RNA, 333 nt, Artificial Sequence
  derived and/or modified sequence opt1 from anti-HIV_059-052864_VR-Chain
cagagcgugcugacccagcccccgucccucagcgccgcccccggccagcgcgucaccaucuccugcagcggguccagcuccaacaucggcaacaacuacgugagcugguaccagcagcugcccgggacggcgcccaagcugcucaucuacgaguccaacaagcggccgagcggcacccccgaccgcuucuccgggagcaaguccggcaccagcgccacccuggccaucacgggccugcagaccggggacgaggccgacuacuacugcggcaccugggacgccucccucagcuccgggggcgugauggggaccggcacgaaggucaccgugcug

SEQ ID NO: 10191 - RNA, 333 nt, Artificial Sequence
  derived and/or modified sequence opt1 from anti-HIV_059-050968_VR-Chain
cagagcgugcugacccaggcccccuccgucagcgccgcgccgggcgagaaggugaccaucuccugcagcgggacguccagcaacaucggcuacuacuacguguccugguaccagcaguuccccgggaccgcccccaaggucgugaucuacgagaacaaccgccggcccagcggcaccccggaccgcuucuccgggagcaaguccggcaccagcgccacgcucgccaucaccggccugcagaccggggacgaggccgacuacuacugcggcaccuggggcgggucccugagcaccgggggcgugaucggcacggggaccaaggucaccgugcuc

SEQ ID NO: 10192 - RNA, 333 nt, Artificial Sequence
  derived and/or modified sequence opt1 from anti-HIV_059-046422_VR-Chain
cagagcgugcugacccagcccccguccgucagcgccgcccccggccagaaggugaccaucuccugcagcggguccagcuccacgaucggcaacaacuacaucagcugguaccagcuccugcccgggacgcccccgaacuaccugaucuucaagaucuccgagcgccccagcggcgugcccgaccgguucuccgggagcaaguccggcaccagcgcgacccuccacaucaccggccugcagaccggggacgagggcgacuacuacugcgggaccugggacaccucccugagcggcgggggcgucuucggcacggggaccaaggugaccgugcuc

SEQ ID NO: 10193 - RNA, 333 nt, Artificial Sequence
  derived and/or modified sequence opt1 from anti-HIV_059-045120_VR-Chain
cagagcgugcugacccagcccccguccgucagcgccgcccccggccagaagguggcgaucuccugcagcggguccagcuccaccaucggcaacaacuacgugagcugguaccagcuccugcccgggacgcccccgaagcugcucaucuucaagucccacgagcgccccagcggcauccccgaccgguucuccgggagcaaguccggcaccagcgccacccugggcaucaccgggcugcagacgggcgacgagggggacuacuacugcggcaccugggacuccagccucuccgucgggggcguguucggcaccgggaccaaggugacgguccug

SEQ ID NO: 10194 - RNA, 333 nt, Artificial Sequence
  derived and/or modified sequence opt1 from anti-HIV_059-039932_VR-Chain
cagagcgugcugacccagcccccguccgucagcgccgcccccggccagaaggugaccaucuccugcagcggguccagcuccaucaucggcaagaacuacgugagcugguaccagcaccuccccgggacggcgcccaagcugcugaucuacgagaacaacaagcgcccguccggcauccccgaccgguucagcggguccaagagcggcaccuccgccacccucgccaucgccggccugcagaccggggacgaggccaacuacuacugcggcacguggggcgggagccuguccaccgggggcgucuucggcaccgggaccaaggugacggugcuc

SEQ ID NO: 10195 - RNA, 333 nt, Artificial Sequence
  derived and/or modified sequence opt1 from anti-HIV_059-038595_VR-Chain
cagagcgugcugacccagcccccguccgucagcgccgcccccggccagaaggugaccaucuccugcagcgggcgcuccagcaacaucggcaacaacuucguguccugguaccagcagcuccccgggacggcgcccaagcugcugaucuacgagaacaacaagcggccgagcggcauccccgaccgcuucuccgggagcaaguccggcaccagcgccacccucggcaucaccgggcugcagacgggcgacgaggccgacuacuacugcgggaccugggacaccucccugagcgccggcggggucuucggcuccggcaccaaggugaucgugcuc

SEQ ID NO: 10196 - RNA, 333 nt, Artificial Sequence
  derived and/or modified sequence opt1 from anti-HIV_059-035082_VR-Chain
cagagcgugcugacccagcccccguccgucagcgccgcccccggccagaaggugaccaucuccugcagcggguccacgagcaacaucggcaaguccuucgugagcugguaccagcagcuccccgggaccgcgcccaagcugcugaucuacgacaacaaccgccggccguccggcacccccgaccgcuucagcggguccaagagcggcaccuccgccacgcucgccaucaccggccugcagaccggggacgaggccgacuacuacugcggcaccuggggcgggagccuguccaccgggggcgucaucggcacggggaccaaggugaccgugcuc

SEQ ID NO: 10197 - RNA, 333 nt, Artificial Sequence
  derived and/or modified sequence opt1 from anti-HIV_059-029204_VR-Chain
cagagcgugcugacccagcccccguccgucagcgccgcccccggccagaaggugaccaucuccugcagcggguccacgagcaacaucggcaagauccucguguccugguaccagcagcugcccgggaccgcgcccaagccgagcaucuacgacaacaaccgccggcccuccggcacccccgaccgcuucagcggguccaagagcggcaccuccgccacgcuggccaucaccggccuccagaccggggacgaggccgacuacuacugcggcaccugggacgggagccuguccacgggcggggucaucggcaccggcaccaaggugaccgugccc

SEQ ID NO: 10198 - RNA, 324 nt, Artificial Sequence
  derived and/or modified sequence opt1 from anti-HIV_059-025235_VR-Chain
cagagcgugcugacccagcccccguccgucagcggcgcccccgggcagaagaucaccaucuccugcagcggcuccacgagcaacaucgggaaguccuacgugagcugguaccagcagcuccccggcaccgcccccaagcugcugaucuacgagaacaaccgccggccguccgggacccccgaccgcuucagcggcuccaagagcggcaccuccgcgacgcucgccaucaccgggcugcagaccggcgacgaggccgacuacuacugcgggaccugggacggcagcgggggcgugaucggcacggggaccaaggucaccgugcug

SEQ ID NO: 10199 - RNA, 333 nt, Artificial Sequence
  derived and/or modified sequence opt1 from anti-HIV_059-015192_VR-Chain
cagagcgugcugacccagcccccguccgucagcgccgcccccggccagaaggugaccaucuccugcagcggguccagcuccacgaucggcgacaaguacgugagcugguaccagcuccugcccgggaccgcgcccaagcugcucaucuacaagaacaacaagcgcccguccggcauccccgaccgguucagcggguccaagagcggcaccuccgccacccugggcaucacggggcugcagaccggcgacgaggccgacuacuacugcgggaccugggacaccagccucuccgucggcgggguguucggcacgggcaccaaggugaccguccug

SEQ ID NO: 10200 - RNA, 333 nt, Artificial Sequence
  derived and/or modified sequence opt1 from anti-HIV_059-007060_VR-Chain
cagagcgugcugacccagcccccguccgucagcgccgcccccggccagaaggugaccaucuccugcagcggguccagcuccaacaucggcaacaaguacgugagcugguaccagcagcuccccgggacggcgcccaagcugcugaucuacgagaacaagaagcgcccguccggcauccccgaccgguucagcggguccaagagcggcaccuccgccacccucggcaucaccgggcugcagacgggcgacgaggccgacuacuucugcgggaccugggacaccagccuguccggcgggggcgucuucggcagcgggaccaaggugacggugcuc

SEQ ID NO: 10201 - RNA, 324 nt, Artificial Sequence
  derived and/or modified sequence opt1 from anti-HIV_059-006953_VR-Chain
cagagcgugcugacccagcccccguccgucagcgccgcccccggccagaaggugaccaucuccugcagcggguccagcuccaacaucggcgugagcugguaccagcagguccccgggacggcgcccaagcuccugaucuacgacaacgacaagcgcccgaccggcauccccgaccgguucuccgggagcaaguccggcaccagcgccauccuggccaucaccggccuccagacgggggacgagggcgacuacuacugcgggaccugggagaccucccugagcggcgggggcguguucggcaccgggacgaaggugaccguccug

SEQ ID NO: 10202 - RNA, 333 nt, Artificial Sequence
  derived and/or modified sequence opt1 from anti-HIV_059-005953_VR-Chain
cacagcgugcugacccagcccccguccgucagcgccgcccccggccagaaggugaccaucuccugcagcgggacguccagcaacaucggcaagaacuacguguccugguaccagcagcuccccgggaccgcgcccaagcugcugaucuacgagaacaaccgccggccgagcggcacccccgaccgcuucuccgggagcaaguccggcaccagcgccacgcucgccaucaccggccugcagaccggggacgaggccgacuacuacugcggcaccugggacacgucccugagcaccgggggcgucuucgggaccggcaccaaggugacggugcuc

SEQ ID NO: 10203 - RNA, 324 nt, Artificial Sequence
  derived and/or modified sequence opt1 from anti-HIV_059-003725_VR-Chain
cagagcgugcugacccagcccccguccgucagcgccgcccccggccagaagcucaccaucuccugcagcggguccacgagcaagaucggcaacaacuacguguccugguaccagcaccuccccgggaccgcgcccaagcugcugguguacgagaacaacaagcgcccgagcggcauccccgaccgguucuccgggagcaaguccggcaccagcgccacccuggccaucacgggccugcagaccggggacgaggccgacuacuacugcggcaccugggacgggcgccucuccgucaucggcaccgggacgaaggugaccgugcug

SEQ ID NO: 10204 - RNA, 333 nt, Artificial Sequence
  derived and/or modified sequence opt1 from anti-HIV_059-002618_VR-Chain
cagcuggugcucacccagcccccgagcgucuccgccgcccccggccagaaggugaccaucagcugcuccgggagcuccagcaacaucggcaacaacuucguguccugguaccagcagcugcccgggacggcgcccaagcugcucaucuacgagaacaacaagcgcccgagcggcauccccgaccgguucuccgggagcaaguccggcaccagcgccacccugggcaucaccgggcugcagacgggcgacgaggccgacuacuacugcgggaccugggacacccgccucuccgccggcggggucuucggcaccggcacgaaggugaccgugcug

SEQ ID NO: 10205 - RNA, 324 nt, Artificial Sequence
  derived and/or modified sequence opt1 from anti-HIV_059-001522_VR-Chain
cagagcgugcugacccagcccccguccgucagcgccgcccccggccagaaggugaccaucuccugcagcggguccaacagcaacaucggcaacaacuacguguccugguaccagcagcuccccgggacggcgcccaagcugcugaucuacgagaacaacaagcgcccgagcggcauccccgaccgguucuccgggagcaaguccggcaccagcgccacccucgccaucaccggccugcagacgggggacgaggccgacuacuacugcggcaccugggacgggcgccuguccgucaucggcgccgggaccaaggugaucgugguc

SEQ ID NO: 10206 - RNA, 333 nt, Artificial Sequence
  derived and/or modified sequence opt1 from anti-HIV_059-000731_VR-Chain
cagagcgugcugacccagcccccguccgucagcgccgcccccggccagaaggugaccaucuccugcagcggguccacgagcaacaucggcaacaaguacguguccugguaccagcagguccccgggaccgcgcccaagcuccugaucuacgagaacaaccgccggccgagcggcauccccgaccgcuucuccgggagcaaguccggcaccagcgccacccuggccaucacgggccuccagaccggggacgaggccgacuacuacugcggcaccugggacgccucccugcggaccgggggcgugaucgggacgggcaccaaggugaccguccug

SEQ ID NO: 10207 - RNA, 333 nt, Artificial Sequence
  derived and/or modified sequence opt1 from anti-HIV_059-000634_VR-Chain
cagagcgugcugacccagcccccguccgucagcgccgcccccggccagaaggugaccaucuccugcagcggguccagcuccacgaucggcaacaacuacgugagcugguaccaggucgugcccgggaccgcgcccaagcuccugaucuacaagaucaacgagcgcccguccggcauccccgaccgguucagcggguccaagagcggcaccuccgccacccugggcaucacggggcuccagaccggcgacgaggccgacuacuacugcgggaccugggacaccagccuguccggcgggggcguguucggccccgggacgaaggucaccgugcug

SEQ ID NO: 10208 - RNA, 333 nt, Artificial Sequence
  derived and/or modified sequence opt1 from anti-HIV_048-250757_VR-Chain
cagagcgugcugacccagcccccguccgucagcggcgcccccgggcagcgcgugaccaucuccugcacgggcaccaccagcaacaucggguccaacuacguggccugguaccagcagcuccccggcaccgcgcccaagcugcugaucuacgacaacgacaagcggccgagcgggauccccgaccgcuucuccggcagcaaguccggcacgagcgccacccucgggaucaccggccugcagaccggggacgaggccgacuacuacugcggcacgugggacaccucccugagcgccgggggcgucuucggcaccgggaccaaggugacggugcuc

SEQ ID NO: 10209 - RNA, 333 nt, Artificial Sequence
  derived and/or modified sequence opt1 from anti-HIV_048-250716_VR-Chain
cagagcgugcugacccagcccccguccgucagcgccgcccccggccagaaggugaccaucuccugcagcggguccagcuccaacaucggcaacaaguacgugagcugguaccagcagcuccccgggacggcgcccaagcugcugaucuacgagaacuccaagcgcccgagcggcauccccgaccgguucuccgggagcaaguccggcaccagcgccacccucggcaucaccgggcugcagacgggcgggcaggccgacuacuacugcggcaccugggacaccucccugagcgccgggggcgucuucggcuccgggaccaaggugacggugcuc

SEQ ID NO: 10210 - RNA, 333 nt, Artificial Sequence
  derived and/or modified sequence opt1 from anti-HIV_048-250463_VR-Chain
cagagcgugcugacccagcccccguccgucagcgccgcccccggccagaaggugaccaucuccugcagcgggucccgcagcaacaacggcaacaacuacguguccugguaccagcagcuccccgggacggcgcccaagcugcugaucuacgagaacaacaagcggccgagcggcauccccgaccgcuucuccgggagcaaguccggcaccagcgccacccucgccaucaccggccugcagacgggggacgaggccgacuacuacugcggcaccugggacuccagccuguccgggggcggggucaucggcaccggcaccaagcucacggugcug

SEQ ID NO: 10211 - RNA, 333 nt, Artificial Sequence
  derived and/or modified sequence opt1 from anti-HIV_048-248153_VR-Chain
cagagcgcccugacccagcccgccuccgugagcgcguccuucggccagagcaucaccaucuccugcacgggggccgccagcgacgucggcuacaacuacguguccugguaccagcagcucccggggaccacccccaagcugcugaucuaccgcaacaaccagcggcccagcggcauccccgaccgcuucuccgggagcaaguccggcaccagcgccacgcucggcaucaccgggcugcagaccggcgacgaggccgacuacuacugcgggaccugggacacgucccugagcgcgggcgggguguucggcaccggcaccaaggucaccgugcuc

SEQ ID NO: 10212 - RNA, 333 nt, Artificial Sequence
  derived and/or modified sequence opt1 from anti-HIV_048-247532_VR-Chain
cagagcgugcugacccagcccccguccgucagcgccgcccccggccagcaggucaccaucuccugcagcgggacgaccuccaacaucggcaccaacuacgugagcugguaccagcagaugccgcccgcggcccccaagcuccugaucuacgacaacaagaagcgccccuccgacauccccgaccgguucagcggguccaagagcggcaccuccgccacgcuggggaucaccggccuccagaccggcgacgaggccgacuacuacugcgggaccugggacacgagccuguccgccggcgggguguucggcaccgggaccaaggugaccgugcug

SEQ ID NO: 10213 - RNA, 333 nt, Artificial Sequence
  derived and/or modified sequence opt1 from anti-HIV_048-245846_VR-Chain
cagagcgugcugacccagcccccguccgucagcgccacccccggccagcgcgugacgaucuccugcaccgggagcuccagcaacaucggcggguacgacguguccugguaccagguccuccccggcaccgcccccaagcugcugaucuacgacagcgacaagcggccguccgggauccccgaccgcuucagcggcucccagagcggcaccuccgcgacgcucgggaucaccggccugcagaccggggacgaggccgacuacuacugcggcaccugggacacgagccuguccgggggcggcguguucgggaccggcaccaaggugaccguccuc

SEQ ID NO: 10214 - RNA, 333 nt, Artificial Sequence
  derived and/or modified sequence opt1 from anti-HIV_048-244016_VR-Chain
cagagcgugcugacccagcccccguccgucagcggcgcccccgggcagcgcgugaccaucuccugcacgggcagcuccagcaacaucgggggcuacgacgugcacugguaccagcagcuccccgggaccgcccccaagcugcugaucuacaagaacgacaagcggccguccggcauccccgaccgcuucagcggcuccaagagcgggaccuccgcgauccucggcaucaccgggcugcagacgggcgacgaggccgacuacuacugcggggccugggacaccagccuguccgccggcggcgucuucgggaccggcaccaaggugacggugcuc

SEQ ID NO: 10215 - RNA, 333 nt, Artificial Sequence
  derived and/or modified sequence opt1 from anti-HIV_048-243682_VR-Chain
cagagccugcucacccagcccccguccgugagcgccgcccccggccagaaggucaccaucuccugcacggggagcuccagcaacaucggcggguacgacgugcacugguaccagcagcugcccggcaccgcgcccaagcugcucaucuacgagaacaacaagcgcccguccgggauccccgaccgguucagcggcuccaagagcggcaccuccgccacccuggggaucacgggccugcagaccggggacgaggccgacuacuacugcggcaccugggacagcucccucagcgccgggggcguguucggcaccgggacgaaggucaccgugcug

SEQ ID NO: 10216 - RNA, 333 nt, Artificial Sequence
  derived and/or modified sequence opt1 from anti-HIV_048-243588_VR-Chain
cagagccugcucacccagcccccguccgugagcgccccgcccggccagauggucuccaucagcugcuccgggagcucccacaacaucggcgacaacuacgugagcugguaccagcaccuccccgggaccgcccccaagcugcugaucuacgacaacaacucccgccccagcggcauccccgaccgguucuccgggagcaaguccggcacgagcgcgacccugggcaucaccgggcugcagaccggcgacgaggccgacuacuacugcgggacgugggacaccucccucagcggcgggggcguguucggcaccgggaccaaggucacggugcug

SEQ ID NO: 10217 - RNA, 333 nt, Artificial Sequence
  derived and/or modified sequence opt1 from anti-HIV_048-241775_VR-Chain
cagagcgugcuggcccagcccccguccgucagcggcgcccccgggcagcgcgugaccaucuccugcaccggcagcuccagcaacaucggggaguacgacgugcacugguaccagcagcuccccggcacggcgcccaagcugcugaucuacgagaacaacaagcggccguccgggauccccgaccgcuucagcggcuccaagagcggcaccuccgccacccucgggaucaccggccugcagacgggggacgaggccgacuacuacugcggcaccugggacagcucccugagcgccgggggcgucuucggcaccgggaccaaggugacggugcuc

SEQ ID NO: 10218 - RNA, 333 nt, Artificial Sequence
  derived and/or modified sequence opt1 from anti-HIV_048-237996_VR-Chain
cagagcgugcugacccagcccccguccgucagcggcgcccccgggcagcgcgugaccaucuccugcacgggcagcuccagcaacaucgggggcuacgacgugcacugguaccggcagcuccccgggaccgcccccaagcugcugaucuacgacaccgucaagcgcccguccggcauccccgaccgguucagcggcuccaagagcgggaccuccgcgacgcucggcaucaccgggcugcagaccggcgacgaggccgacuacuacugcgggaccugggacacgagccuguccgccggcggcguguucgggaccggcaccaaggugaccguccuc

SEQ ID NO: 10219 - RNA, 330 nt, Artificial Sequence
  derived and/or modified sequence opt1 from anti-HIV_048-237730_VR-Chain
agcgugcugacccagcccccguccgucagcggcgcccccgggcagcgcgugaccaucuccugcacgggcaccaacagcaacuucggguccaacuacgcccacugguaccagcagguccccggcaccgcgcccaagcuccugaucuacagcaacaacgcccggccguccgggauccccgaccgcuucagcggcuccaagagcggcaccuccgccacgcuggggaucaccggccuccagaccggggacgaggccgacuacuacugcggcaccugggacacgagccuguccgccgggggcguguucggcaccgggaccaaggugaccgugcug

SEQ ID NO: 10220 - RNA, 333 nt, Artificial Sequence
  derived and/or modified sequence opt1 from anti-HIV_048-237253_VR-Chain
cagagcgugcugacccagcccccguccgucagcgccgcccccggccagaaggugaccguguccugcagcggguccagcuccaacaucggcagcaacgacgucuccugguaccagcaguuccccggggcggcccccaagcuccugaucuacaagaacaacgagcgcccgagcggcauccccgaccgguucuccgggagcaaguccggcacgagcgccacccugggcaucaccgggcuccagaccggcgacgaggccgacuacuacugcgggacgugggacaccucccugagcgccggcgggguguucggcaccggcaccaaggugacgguccug

SEQ ID NO: 10221 - RNA, 333 nt, Artificial Sequence
  derived and/or modified sequence opt1 from anti-HIV_048-234100_VR-Chain
cagagcaugcugacccagcccccguccgugagcgccgcccccggcgagaaggucaccaucuccugcagcggguccagcuccaacaucggcaagacguucgugagcugguaccagcagguccccgggaccgcgcccaagcuccugaucuacaagaacgacaaccgcccguccggcauccccgaccgguucagcggguccaagagcggcaccuccgccacccugggcaucagcgggcuccagacgggcgacgaggccgacuacuacugcgggaccugggacaccucccugagcggcgggggcguguucggcaccgggacgaaggugaccgugcug

SEQ ID NO: 10222 - RNA, 333 nt, Artificial Sequence
  derived and/or modified sequence opt1 from anti-HIV_048-230882_VR-Chain
cagagcgugcugacccagcccccguccgucagcgccgcccccggccagaaggugaccaucuccugcagcgggaacuccagcaacaucggcuccaacuucgugagcugguaccagcagcuccccgggacggcgcccaagcugcugaucuacgagaacaacaagcgcccguccggcauccccgaccgguucagcggguccaagagcggcaccuccgccacccucggcaucaccgggcugcagacgggcgacgaggccgacuacuacugcgggaccugggacaccagccugucccccggcggggucuucggcaccggcacgaaggugaccgugcuc

SEQ ID NO: 10223 - RNA, 333 nt, Artificial Sequence
  derived and/or modified sequence opt1 from anti-HIV_048-229473_VR-Chain
cagagcgugcugacccagcccccguccgucagcgccgcccccggccagaaggugaccaucuccugcagcggguccagcuccaacaucggcaacaacuacgugagcugguaccagcaguuccccgggacggcgcccaagcuccugaucuacgagaacaacaagcgcccguccggcauccccgaccgguucagcggguccaagagcggcaccaccgccacccuggccaucacgcgccuccagaccggcgacgaggccgacuacuacugcgggaccuggggcgggucccugagcgccggcggggucuucggcaccggcacgaaggugaccgugcug

SEQ ID NO: 10224 - RNA, 333 nt, Artificial Sequence
  derived and/or modified sequence opt1 from anti-HIV_048-228238_VR-Chain
cagagcgugcugacccagcccccguccgucagcgccgcccccggccagaaggugaccaucuccugcagcggguccagcuccaacaucggcaucaacuacgugagcugguaccagcagcuccccgggacggcgcccaagcugcugaucuacgacaacaccaagcgcccgcagggcauccccgaccgguucuccgggagcaaguccggcaccagcgccacccucgccaucacgggccugcagaccggggacgaggccgacuacuacugcggcaccugggacgggucccugagcaccggcggggucaucggcacgggcaccaaggugaccgugcuc

SEQ ID NO: 10225 - RNA, 333 nt, Artificial Sequence
  derived and/or modified sequence opt1 from anti-HIV_048-228027_VR-Chain
cagagccugcucacccagucccccagcgccuccggcccgcccgggcagcgcgugaccaucagcugcuccggcagcaacuccaacaucgggagcaacacggucaacugguaccaccaccuccccggcgccgcgcccaagcugcugaucuacgagaacuccaagcggccgagcgggauccccgaccgcuucuccggcagcaaguccggcaccagcgccacccuggggaucaccggccugcagacgggggacgaggccgacuacuacugcggcaccugggacaccucccucagcgccgggggcguguucggcuccgggaccaaggugacgguccug

SEQ ID NO: 10226 - RNA, 333 nt, Artificial Sequence
  derived and/or modified sequence opt1 from anti-HIV_048-227795_VR-Chain
cagagcgugcugacccagcccccguccgucagcgccgcccccggccagaaggugaccaucuccugcagcggguccagcuccaacaucgagagccgcuccgugcacugguaccagcagaagcccggccaggcgcccguccucgugaucuacuacgacagcgaccggccguccgggauccccgaccgcuucagcggcuccaagagcgggacggccgccacccugggcaucaccggccugcagaccggggacgaggccgacuacuacugcggcacgugggacaccucccucagcgccgggggcguguucgggaccggcaccaaggucacggugcug

SEQ ID NO: 10227 - RNA, 333 nt, Artificial Sequence
  derived and/or modified sequence opt1 from anti-HIV_048-227770_VR-Chain
cagagcgugcugacccagcccccguccgucagcggcgcccccgggcagcgcgugaccaucuccugcacgggcagcuccagcaacaucgggccccgggacgugcacugguaccagcagcuccccggcaccgucccgaagcugcugaucuacgacaccuacacccgccccuccgggauccccgaccgguucagcggcuccaagagcggcgccuccgcgacgcucgacaucaccgggcugcagaccggcgacgaggccgacuacuacugcgggaucugggacaccagccuguccgccggcgggguguucggcacgggcaccaaggugaccguccuc

SEQ ID NO: 10228 - RNA, 333 nt, Artificial Sequence
  derived and/or modified sequence opt1 from anti-HIV_048-225298_VR-Chain
cagagcgcccugacccagccccgcuccgugagcggcuccccggggcagagcgucaccaucuccugcacgggcaccagcaacgacgugggguacgacuacguguccugguaccagcagcuccccggcaccgcccccaagcugcugaucuacgacaucaacaagcggcccagcgggaucccggaccgcuucuccggcagcaaguccggcaccagcgcgacgcucgggaucaccggccugcagaccggggacgaggccgacuacuacugcggcaccugggacacgucccugagcgccgggggcgucuucggcaccgggaccaaggugaccgugcuc

SEQ ID NO: 10229 - RNA, 327 nt, Artificial Sequence
  derived and/or modified sequence opt1 from anti-HIV_048-225090_VR-Chain
gagcugacccagcccccgagcguguccggcgcccccgggcagcgcgucaccaucagcugcacgggcuccagcuccaacaucgggggcuacgacgugcacugguaccagcagcuccccgggaccgcccccaagcugcugaucuacgacaacaacaagcggccgagcggcauccccgaccgcuucuccggcagcaaguccgggaccagcgcgacccucggcaucacggggcugcagaccggcgacgaggccgacuacuacugcgggaccugggacaccucccugagcacgggcggcguguucgggaccggcaccaaggucaccgugcuc

SEQ ID NO: 10230 - RNA, 333 nt, Artificial Sequence
  derived and/or modified sequence opt1 from anti-HIV_048-224187_VR-Chain
cagagcgugcugacccagcccccguccgccagcggcacccccgggcagcgcgucacgaucuccugcagcggcuccagcgccaacaucgggaccaacuacguguucugguaccagcaccuccccggcaccacgccccggcugcugaucuuccgcaacaacgagcggccguccgggauccccgaccgcuucagcggcuccaagagcggcaccuccgcgacccucgggaucaccggccugcagaccggggacgaggccgacuacuacugcggcacgugggacaccagccuguccgccgggggcguguucggcaccgggaccaaggucacggugcuc

SEQ ID NO: 10231 - RNA, 333 nt, Artificial Sequence
  derived and/or modified sequence opt1 from anti-HIV_048-223055_VR-Chain
cagagcgugcugacccagcccccguccgucagcgccgcccccggccagaaggugaccaucuccugcagcggguccagcuccaacaucggcaacaacuacgugagcugguaccagcaguuccccgggacggcgcccaagguccucaucuacggcaacuccaagcgcccgagcgggauccccgaccgguucuccggcagcaaguccggcaccagcgccacccuggggaucaccggccugcagacgggggacgaggccgacuacuacugcggcaccugggacaccucccucagcgccgggggcguguucggcuccgggaccaaggugacgguccug

SEQ ID NO: 10232 - RNA, 333 nt, Artificial Sequence
  derived and/or modified sequence opt1 from anti-HIV_048-222711_VR-Chain
cagcccgugcugacccagccgcccagcgucuccggcgcccccgggcagcgcgugaccaucagcugcacgggcuccagcuccaacaucgggggcuacgacgugcacugguaccagcagguccccgggaccgccccgaagcuccugaucuucgagaacaaccggcgccccagcggcauccccgaccgguucuccggcagcaaguccgggaccagcgcgacccuggccaucacgggccuccagaccggggacgaggccgacuacuacugcggcaccugggacgggucccugagcaccggcggcgugaucgggacgggcaccaaggugaccguccug

SEQ ID NO: 10233 - RNA, 333 nt, Artificial Sequence
  derived and/or modified sequence opt1 from anti-HIV_048-221209_VR-Chain
cagagcgugcugacccagcccccguccgucagcggcgcccccgggcagcgcgugaccaucuccugcacgggcaacagcuccaacaucggggacuacgacgugcacugguaccagcaggucgccggcaccgcgcccaagcuccugaucuucaagaacaacgagcggcccagcgggaucccggaccgcuucuccggcagcaaguccggcaccagcgccacccuggggaucacgggccuccagaccggggacgaggccgacuacuacugcggcaccugggacaccucccugagcgccgggggcguguucggcuccgggacgaaggugaccguccug

SEQ ID NO: 10234 - RNA, 333 nt, Artificial Sequence
  derived and/or modified sequence opt1 from anti-HIV_048-220629_VR-Chain
cagagcgcccugacccagcccgccuccgugagcggcucccucgggcagagcaucaccaucuccugcacgggcaccagccgcgacgucggguacuccuacgugagcugguaccagcaccucccgggcaccgcgcccaagcugcugaucuacgagaacaacaagcggcccuccgggauccccgaccgcuucagcggcuccaagagcggcaccuccgccacgcuggggaucaccggccugcagaccggggacgaggccgacuacuacugcggcaccugggacagcucccucagcgccgggggcguguucggcacggggaccaaggucaccgugcug

SEQ ID NO: 10235 - RNA, 333 nt, Artificial Sequence
  derived and/or modified sequence opt1 from anti-HIV_048-219430_VR-Chain
cagagcgugcugacccagcccccguccgucagcgccgcccccggccagauggugaccaucuccugcagcggguccacgagcaacaucggcaucaacuacguguccugguaccagcacguccccgggaccgcgcccaagcuccugaucuacgacaacaacaagcgcccgagcggcauccccgaccgguucuccgggagcaaguccggcaccagcgccacccugggcaucacggggcuccacaccggcgacgaggccgacuacuacugcgggaccugggacaccucccugagcgccggcgggguguucggcacgggcaccaaggugaccguccug

SEQ ID NO: 10236 - RNA, 333 nt, Artificial Sequence
  derived and/or modified sequence opt1 from anti-HIV_048-216250_VR-Chain
cagagcgugcugacccagcccccguccgucagcgccgcccccggccagaaggugaccaucuccugcacggggaccaccagcgacuucggcuacaacugcguguccugguaccagcagcaccccgggcgcgcgcccaaggucaucaucagcggcgugaacaagcggccguccgggauccccgaccgcuucagcggcuccaagagcggcaccuccgccacgcucgggaucaccggccugcagaccggggacgaggccgacuacuacugcggcaccugggacagcucccugagcgccgggggcguguucggcacggggaccaaggucaccgugcuc

SEQ ID NO: 10237 - RNA, 321 nt, Artificial Sequence
  derived and/or modified sequence opt1 from anti-HIV_048-216133_VR-Chain
acccagcccccgagccuguccgccacccccggccagcgcgugagcaucuccugcagcgggggcggguccaacaucggcaacaacgacgucuucugguuccagcaguuccccggggccggcccccggcuccugaucuacgacaaccacaagcgccacuacggcacgccggaccgguucagcggguccaagagcggcaccuccgcgacccuggccaucaccgggcuccagacgggcgacgaggccgccuacuacugcgggaccugggacggcagccuguccaccggcggggugaucggcaccgggacgaaggugaccguccug

SEQ ID NO: 10238 - RNA, 333 nt, Artificial Sequence
  derived and/or modified sequence opt1 from anti-HIV_048-214886_VR-Chain
cagagcgcccugacccagccccgcuccgugagcggcuccccggggcagagcgucaccaucuccugcacgggcaccagcuccgacgugggguacaacuacgugagcugguaccagcaccaccccggcaccgcccccaagcuccugaucuacaagaacaacaaccggcccuccgggaucccggaccgcuucagcggcuccaagagcggcaccuccgcgacgcuggggaucaccggccuccagaccggggacgaggccgacuacuacugcggcaccugggacacgagccuguccgccgggggcgucuucggcaccgggaccaaggugaccgugcug

SEQ ID NO: 10239 - RNA, 333 nt, Artificial Sequence
  derived and/or modified sequence opt1 from anti-HIV_048-214709_VR-Chain
cagagcgugcugacccagcccccguccgucagcgccgcccccggccagaaggugaccaucuccugcagcggguccagcuccaacaucggcaacaacuacgugagcugguaccagcagcuccccgggacggcgcccaagcugcugaucuacgagaacgaccgccggccguccggcauccccgaccgcuucagcggguccaagagcggcaccuccgccacccucggcaucaccgggcugcagacgggcgacgaggccgacuacuacugcgggaccugggacaccagccuguccgccggcggggucuucggcaccggcacgaaggugaccgugcuc

SEQ ID NO: 10240 - RNA, 333 nt, Artificial Sequence
  derived and/or modified sequence opt1 from anti-HIV_048-214001_VR-Chain
cagagcgugcugacccagcccccguccgucagcggcgcccccgggcagaccgugacgaucuccugcagcggcuccaacagcaacaucgggaaccacgacgugcacugguaccagcacguccccggcaccgcccccaagcuccugaucuacgacaacaacaagcgcccguccgggauccccgaccgguucagcggcuccaagagcggcaccuccgcgacccuggggaucacgggccuccagaccggggacgaggccgaguacuacugcgccaccugggacgccagccuguccggcgggggcguguuccgcaccggcacgaaggugaccguccug

SEQ ID NO: 10241 - RNA, 333 nt, Artificial Sequence
  derived and/or modified sequence opt1 from anti-HIV_048-213230_VR-Chain
cagagcgugcugacccagcccccguccaugagcgccgcccccggccagaaggucaccaucuccugcagcggguccagcaacaacaucggcaagaacgugguguccugguaccagcagcuccccgggacggcgcccaagguccugaucuacgagaacaacaagcgccugagcggcaucccggaccgguucuccgggagcaaguccggcaccagcgccacccucgugaucaccggccugcagacgggggacgaggccgacuacuacugcggcaccugggacuccagccuguccgccgggggcguguucgggaccggcaccaaggucacggugcuc

SEQ ID NO: 10242 - RNA, 333 nt, Artificial Sequence
  derived and/or modified sequence opt1 from anti-HIV_048-212574_VR-Chain
cagagcgugcugacccagcccccguccgucagcgccgcccccggccagcgcgugaccguguccugcagcggguccacgagcaacaucgaguccaacuacgucagcugguaccagcagguccccggcaccgcgcccaagcuccugaucuacgagaacaacaagcggccguccgggauccccgaccgcuucagcggcuccaagagcgggaccuccgccacccuggccaucacgggccuccagaccggcgacgaggccgccuacuacugcgggaccugggacggcagccuguccaccgggggcgugaucgggacgggcaccaaggugaccgugcug

SEQ ID NO: 10243 - RNA, 333 nt, Artificial Sequence
  derived and/or modified sequence opt1 from anti-HIV_048-212207_VR-Chain
cagagcgugcugacccagcccccgucccucagcgccgcccccggccagaaggucaccaucuccugcagcgggggcuccagcaacaucgggaacaacuacguguccugguaccagcaccuccccggcacggcgcccaagcugcugaucuacgacaacuacaagcgcccgagcgggauccccgaccgguucuccggcagcaaguccggcaccagcgccacccuggacaucaccgggcugcagacgggcgacgaggccgacuacuacugcgggaccugggacaccucccucagcgccggcgggguguucggcaccggcacgaaggucaccgugcug

SEQ ID NO: 10244 - RNA, 333 nt, Artificial Sequence
  derived and/or modified sequence opt1 from anti-HIV_048-209146_VR-Chain
cagagcgugcugacccagcccccguccgucagcggcgcccccgggcagaagaucaccguguccugcacgggcaccaccagcaacaucgggccccacgacgugcacugguaccagcucguccccggccgcccgcccaagcugcugaucuuccacaacaacauccggcccuccgggauccccgaccgcuucagcggcuccaagagcggcauguccgccacccucgggaucacgggccugcagaccggggacgaggcggacuacuacugcggcaccugggacagcucccugagcgccgggggcguguucggcaccgggacgaaggugaccguccuc

SEQ ID NO: 10245 - RNA, 333 nt, Artificial Sequence
  derived and/or modified sequence opt1 from anti-HIV_048-208206_VR-Chain
cagagcgugcugacccagcccccguccgucagcgccgcccccggccagaaggugaccaucuccugcagcggguccagcuccaacaucggcagcaacuacguguccugguaccagcaguuccccgggacggcgccccgccuccugaucuacgagaacgacaagcggccgagcgccauccccgaccgcuucuccggcagcaaguccgggaccagcgccacccugggcaucaccggccuccacacgggggacgaggccgacuacuacugcggcaccugggacgggucccugagcaccggcggggucaucggcaccggcacgaaggugaccgugcug

SEQ ID NO: 10246 - RNA, 333 nt, Artificial Sequence
  derived and/or modified sequence opt1 from anti-HIV_048-208194_VR-Chain
cagagcgcccugacccagcccccguccgccagcggcucccccgggcagagcgugaccaucuccugcacgggcaccagcuccgacaucggguacaaguacgucagcugguaccagcuccugcccggcacgcccccgaagcugcucaucuucaagaacaacgagcgccccuccgggauccccgaccgguucagcggcuccaagagcggcaccuccgcgacccuggggaucaccggccugcagaccggggacgaggccgacuacuacugcggcgccugggacaccagccucuccgccgggggcguguucggcacggggaccaaggugaccguccug

SEQ ID NO: 10247 - RNA, 333 nt, Artificial Sequence
  derived and/or modified sequence opt1 from anti-HIV_048-207744_VR-Chain
cagagcgcccugacccagcccgccuccgugagcgcguccuucggccagagcaucaccaucuccugcacgggggccgccagcaccaucggcaacaaccucgucuccugguaccgccugcugccggggaccgcccccaagcuccugaucuacaagaacgacaaccggcccagcggcauccccgaccgcuucuccgggagcaaguccggcaccagcgccacgcugggcaucuccgggcuccagaccggcgacgaggcggacuacuacugcgggaccugggacaccagccuguccggcgggggcguguucggcacggggaccaaggugaccguccug

SEQ ID NO: 10248 - RNA, 333 nt, Artificial Sequence
  derived and/or modified sequence opt1 from anti-HIV_048-206501_VR-Chain
cagagcgugcugacccagcccccguccgucagcggcgcccccgggcagcgcgugaccaucuccugcagcggcuccagcuccaacaucgggaacaacgccgugaacugguaccagcagcuccccggcaaggcgcccaagcugcugaucuacgagaacaacaagcggccgagcgggauccccgaccgcuucuccggcagcaaguccggcacgagcgccacccucgggaucaccggccugcagaccggggacgaggccgacuacuacugcggcacgugggacuccagccuguccgccgggggcgucuucggcaccgggaccaaggugaccgugcuc

SEQ ID NO: 10249 - RNA, 333 nt, Artificial Sequence
  derived and/or modified sequence opt1 from anti-HIV_048-204221_VR-Chain
cagagcgugcugacccagcccccguccgccagcggcacccccgggcagcgcgucacgaucuccugcuucggcagcuccagcaacaucgccuccagcgcggugaacugguaccagcagcuccccgggaccgcccccaagcugcugaucuacaagaacgacaagcggccguccggcauccccgaccgcuucagcggguccaagagcggcaccuccgccacccucggcaucacggggcugcagaccggcgacgaggccgacuacuacugcgggaccugggacaccagccuguccgccggcgggguguucggcacgggcaccaaggucaccgugcuc

SEQ ID NO: 10250 - RNA, 333 nt, Artificial Sequence
  derived and/or modified sequence opt1 from anti-HIV_048-204015_VR-Chain
cagagcgugcugacccagcccccguccgccagcggcacccccgggcagcgcgucacgaucuccugcagcggcuccagcuccaacaucgggagcaaguacguguacugguaccagcagcuccccggcaccgcccccaagcugcugaucuacaagaacgacaaccggccguccgggauccccgaccgcuucagcggcuccaagagcggcaccuccgcgacccucgggaucagcggccugcagacgggggacgaggccgacuacuacugcggcaccugggacaccucccugagcgggggcggcguguucgggaccggcacgaaggucaccgugcuc

SEQ ID NO: 10251 - RNA, 333 nt, Artificial Sequence
  derived and/or modified sequence opt1 from anti-HIV_048-201240_VR-Chain
cagagcgugcugacccagcccccguccgucagcgccgcccccggccagaaggugaccaucuccugcagcggguccagcuccaacaucggcaacaacuacguggcgugguaccagcagcuccccgggacggcccccaagcugcugaucaaggagaacagccagcgcccguccggcauccccgaccgguucagcggguccaagagcggcaccuccgccacccucgccaucaccggccugcagacgggggacgaggccgacuacuacugcggcaccugggacaccagccuguccaccgggggcgucuucgggacgggcaccaaggugaccgugcuc

SEQ ID NO: 10252 - RNA, 333 nt, Artificial Sequence
  derived and/or modified sequence opt1 from anti-HIV_048-200455_VR-Chain
cagagcgcccugacccagcccgccuccgugagcggcuccccggggcagagcaucaccaucuccugcacgggcaccagcuccgacgucggguacaacuacgugagcugguaccaggugcuccccggcaccgcgcccaagcugcugaucuacaagaacaccgagcgccccuccgggaucccggaccgguucagcggcuccaagagcggcacguccgccacccucgacaucaccgggcugcagaccggcgacgaggccgacuacuacugcgggacgugggacaccagccuguccgccggcggggucuucggcaccggcaccaaggugacggugcuc

SEQ ID NO: 10253 - RNA, 333 nt, Artificial Sequence
  derived and/or modified sequence opt1 from anti-HIV_048-200319_VR-Chain
cagagcguggucacccagcccccguccgccagcggcacccccgggcagcgggugacgaucuccugcagcggcuccagcuccaacaucgggagcaaguacguguacugguaccaccagcaccccggcaccgcccccaagcugcucaucuacgacaacaacaaccggccguccgggauccccgaccgcuucagcggcuccaagagcggcaccuccgcgacccuggggaucacgggccugcagaccggggacgaggccgacuacuacugcggcaccugggacaccagccucucccgcgggggcgucuucggcacggggaccaaggugaccgugcug

SEQ ID NO: 10254 - RNA, 333 nt, Artificial Sequence
  derived and/or modified sequence opt1 from anti-HIV_048-197896_VR-Chain
cagagcgugcugacccagcccccguccgucagcgccgcccccggccagaaggugaccaucuccugcagcggggcguccuacaacaucggcaagaacagcguguccugguaccagcagcuccccgggacgcccccgaagcugcugaucuucaagaacaacgagcgccccagcggcauccccgaccgguucuccgggagcaaguccggcaccagcgccacccucggcaucaccgggcugcagacgggcgacgaggccgacuacuacugcgccaccugggacaccucccugagcgccgggggcgucuucgggaccggcacgaaggugaccgugcuc

SEQ ID NO: 10255 - RNA, 333 nt, Artificial Sequence
  derived and/or modified sequence opt1 from anti-HIV_048-193813_VR-Chain
cagagcgugcugacccagucccccagcgucuccgccgccccgggccagaaggugaccaucagcugcuccgggagcaacuccaacgugggcaacuacuacgucagcugguaccagcaccuccccgggacggcgcccaaggugcugaucuacgagggcaacaagcgccccuccggggugccggaccgguucagcggcuccaagagcggcaccuccgccagccuggccaucaccgggcuccagaccggcgacgaggccgacuacuacugcgggacgugggacaccucccugagcgccggcggggucuucggcuccggcaccaaggugaccgugcug

SEQ ID NO: 10256 - RNA, 333 nt, Artificial Sequence
  derived and/or modified sequence opt1 from anti-HIV_048-192098_VR-Chain
cagagcgugcugacccagcccccguccgccagcggcacccccgggcagcgcgucacgaucuccugcagcggcuccaccagcaacaucggguccaacuacguguacugguaccagcagcuccccggcaccacccccaagcugcugaucuacgagaacaacaagcggccgagcgggaucacggaccgcuucuucggcuccaagagcggccccuccgccacccucgacaucaccgggcugcagaccggcgacgaggcggacuacuacugcgggacgugggacgccagccuguccgccggcgggguguucggcaccggcaccaaggucaccgugcuc

SEQ ID NO: 10257 - RNA, 333 nt, Artificial Sequence
  derived and/or modified sequence opt1 from anti-HIV_048-191786_VR-Chain
cagagcgugcugacccagcccccguccgucagcgccgcccccggccagaacgugaacaucuccugcagcggguccagcuccaacaucgagaacaacuucgugagcugguaccagaagcuccccggcaccgcgcccaagcugcugaucuacgacaacaacaagcgcccguccgggauccgggaccgcuucagcggcuccaagagcgggacguccgccacccucggcaucaccggccugcagaccggggacgaggccgacuacuacugcggcacgugggacaccagccuguccgccgggggcgucuucgggagcggcaccaaggugaccgugcuc

SEQ ID NO: 10258 - RNA, 333 nt, Artificial Sequence
  derived and/or modified sequence opt1 from anti-HIV_048-188746_VR-Chain
cagagcgugcugacccagcccccguccgccagcggcacccccgggcagaaggucacgaucuccugcagcggcuccaacagcaacaucggguccaacuucgugagcugguaccagcuccugcccggcaccacccccaagcugcucaucuaccgcaacaaccagcggccguccggggugcccgaccgcuucagcggcuccaagagcggcaccuccgccacgcuggggaucaccggccugcagaccggggacgaggcggacuacuacugcggcaccugggacagcucccucagcgccgggggcgucuucggcacggggaccaaggugaccgugcug

SEQ ID NO: 10259 - RNA, 333 nt, Artificial Sequence
  derived and/or modified sequence opt1 from anti-HIV_048-185937_VR-Chain
cagagcgugcugacccagcccccguccgucagcgccgcccccggccagaaggugaccaucuccugcagcggguccagcuccaacaucggcaacaacuacgugagcugguaccagcagcuccccgggacggcgcccaagcugcugaucuacgagaacaacaagcgcccguccggcauccccuaccccaucagcggguccaagagcggcaccuccgccacccucggcaucaccgggcugcagacgggcgacgaggccgacuacuacugcgggaccugggacagcucccugagcgccggcggggucuucggcaccggcaccaaggugacggugcuc

SEQ ID NO: 10260 - RNA, 333 nt, Artificial Sequence
  derived and/or modified sequence opt1 from anti-HIV_048-184849_VR-Chain
cagagcgugcugacccaggcccccuccgccagcggcaccccggggcagacggucaccaucuccugcagcggcuccagcuccaacaucgggaccaaguacguguacugguaccagcagcuccccggcaccgcgcccaagcugcugaucuacaagaacaacgagcgccccagcgggaucccggaccgguucuccggcagcaaguccggcacgagcgccacccucgggaucaccggccugcagaccggggacgaggccgacuacuacugcggcacgugggacaccucccugagccccgggggcguguucggcaccgggaccaaggucacggugcuc

SEQ ID NO: 10261 - RNA, 333 nt, Artificial Sequence
  derived and/or modified sequence opt1 from anti-HIV_048-183089_VR-Chain
cagagcgugcugacccagcccccguccgccagcggcacccccgggcagcgcgucacgaucuccugcagcggcuccagcuccaacaucgggagcuccuacguguacugguaccagcuccugcccggcacgcccccgaagcugcucaucuucaagaacaacgagcggcccagcgggauccccgaccgcuucuccggcagcaaguccggcaccagcgccacccuggggaucaccggccugcagaccggggacgaggcggacuacuacugcggcaccugggacaccucccucagcgccgggggcguguucggcacggggaccaaggucaccgugcug

SEQ ID NO: 10262 - RNA, 333 nt, Artificial Sequence
  derived and/or modified sequence opt1 from anti-HIV_048-181509_VR-Chain
cagagcgugcugacccagcccccguccgucagcggcgcccccgggcagcgcgugaccaucuccugcacgggcagcuccagcaacaucgggggcuacgacgugcacugguaccaccagcuccccggggccgcgcccaagcugcugaucuacaagaacgacaaccggccguccggcauccccgaccgcuucagcggcuccaagagcgggaccuccgccacccucggcaucagcgggcugcagaccggcgacgaggccgacuacuacugcgggacgugggacaccucccugagcggcggcggggucuucggcaccgggaccaaggugacggugcuc

SEQ ID NO: 10263 - RNA, 333 nt, Artificial Sequence
  derived and/or modified sequence opt1 from anti-HIV_048-180990_VR-Chain
cagagcgugcugacccagcccccguccgucagcgccgcccccggccagcgcgugaccaucuccugcagcggguccacgagcaacaucggcaacaacuacguguccugguaccagcacuuccccgggaagguccccaagguggugaucagcgagaccaccaagcggccguccggcauccccgaccgcuucagcggguccaagagcggcaccuccgcgacgcucggcaucaccgggcugcagaccggcgacgaggccgacuacuacugcgggaccugggacagcucccugagcgccggcggggucuucggcacgggcaccaaggugaccgugcuc

SEQ ID NO: 10264 - RNA, 333 nt, Artificial Sequence
  derived and/or modified sequence opt1 from anti-HIV_048-177532_VR-Chain
cagagcgcccugacccagcccccguccgccagcggcucccucgggcagagcgugaccaucuccugcacgggcaccagcuccgacgucgggaacaacuucgugagcugguaccagaagaagcccggcaaggcgcccaagcugaucguguacgaggucaacaagcgccccuccgggaucccggaccgguucagcggcuccaagagcggcaccuccgccacccuggggaucacgggccuccagaccggggacgaggccgacuacuacugcggcaccugggacaccagccuguccaccgggggcguguucggcacggggaccaaggugaccguccug

SEQ ID NO: 10265 - RNA, 324 nt, Artificial Sequence
  derived and/or modified sequence opt1 from anti-HIV_048-177426_VR-Chain
cugacccagccccacagcguguccgagagcccgggcaagaccgucacgaucuccugcaccgggaccagcuccgacgugggcuacaacuacgugagcugguaccagcaccaccccgggaaggcccccaagcuccugaucuacgaggucaccaagcgccccuccggcaucccggaccgguucagcggguccaagagcggcacguccgccacccugggcaucaccgggcuccagaccggcgacgaggcggacuacuacugcgggacgugggacagcucccugagcgccggcgggguguucggcaccggcaccaaggugaccguccug

SEQ ID NO: 10266 - RNA, 333 nt, Artificial Sequence
  derived and/or modified sequence opt1 from anti-HIV_048-177389_VR-Chain
cagagcgugcugacccagcccccguccaugagcgccgcccccggcgagcgcgucaccaucuccugcagcggguccagcuccaacaucggcaaccaccacgugagcugguaccagcagcggcccgggacggcgcccaagcuccugaucuacgagaacaacgagcgcccguccggcauccccgaccgguucagcggguccaagagcggcaccuccgccacccugggcaucaccgggcuccagacgggcgacgaggccgacuacuacugcgggaccugggacaccagccuguccgccggcgggguguucggcagcggcaccaaggucacggugcug

SEQ ID NO: 10267 - RNA, 333 nt, Artificial Sequence
  derived and/or modified sequence opt1 from anti-HIV_048-174266_VR-Chain
cagagcgugcugacccagcccccguccgucagcggcgcccccgggcagcgcgugaccaucuccugcagcggcuccagcuccaacaucgggagccacuacguguccugguaccagcagguccccggcacggcgccccggcucgugaucuacgacaccaucaagcgccacagcgggaucccggaccgguucuccggcagcaaguccggcaccagcgccacccuggggaucacgggccugcagaccggggacgaggccgacuacuacugcggcaccugggacaccucccucagcgccgggggcguguucggcacggggaccaaggucaccgugcug

SEQ ID NO: 10268 - RNA, 333 nt, Artificial Sequence
  derived and/or modified sequence opt1 from anti-HIV_048-172847_VR-Chain
cagagcgugcugacccagcccccguccgucagcgccgcccccggccagcgcgugaccguguccugcagcggguccacgagcaacaucgaguccaacuacgucagcugguaccagcagguccccggcaccgcgcccaagcuccugaucuacgagaacaacaagcggccguccgggauccccgaccgcuucagcggcuccaagagcgggaccuccgccacccugggcaucacgggccuccagaccggggacgaggccgacuacuacugcggcaccugggacaccagccuguccgccgggggcguguucgggacgggcaccaaggugaccgugcug

SEQ ID NO: 10269 - RNA, 333 nt, Artificial Sequence
  derived and/or modified sequence opt1 from anti-HIV_048-172845_VR-Chain
cagagcgcccugacccagcccccguccgccagcggcucccccgggcagagcgugaccaucuccugcacgggcaccagcuccgacgucggguacaacuacgugagcugguaccagcagcuccccggcaccgcgcccaagcugcugaucuaccgcaacaaccagcggccguccggggugcccgaccgcuucagcggcuccaagagcggcaccuccgccacgcucgggaucaccggccugcagaccggggacgaggccgacuacuacugcgccaccugggacacgagccuguccgccggcggggucuucggcaccggcaccaaggugaccgugcuc

SEQ ID NO: 10270 - RNA, 333 nt, Artificial Sequence
  derived and/or modified sequence opt1 from anti-HIV_048-172363_VR-Chain
cagagcgugcugacccagcccccguccgucagcgccgcccccggccagaaggugaccaucuccugcagcggguccggcagcaacaucgggaacacguacguguccugguaccagcagcuccccggcaccgcgcccaagcugcugaucuucgaggacaacaagcgcccgagcgggauccccgaccgguucuccggcagcaaguccggcaccagcgccacccucgccaucacggggcugcagaccggcgacgaggccgacuacuacugcgggaccugggacuccagccuguccggcgggggcgucaucggcaccgggacgaagcucaccgugcug

SEQ ID NO: 10271 - RNA, 333 nt, Artificial Sequence
  derived and/or modified sequence opt1 from anti-HIV_048-171609_VR-Chain
cagagcgugcugacccagcccccguccgucagcgccgcccccggccaggaggugaccaucuccugcagcgcguccagcuccagcaucgggaacgacuucguguccugguaccagcagcuccccggcacggcccccaagcugcugaucuacgggaacagcaaccgcccguccggcauccccgaccgguucagcggguccaagagcggcaccuccgccacccucggcaucaccgggcugcagacgggcgacgaggccgacuacuacugcgggaccugggacaccagccuguccaccggcggggucuucggcacgggcaccaaggugaccgugcuc

SEQ ID NO: 10272 - RNA, 333 nt, Artificial Sequence
  derived and/or modified sequence opt1 from anti-HIV_048-170705_VR-Chain
cagagcgugcugacccagcccccguccgucagcgccgcccccggccagauggugaccaucuccugcagcggguccacgagcaacaucggcaucaacuacguguccugguaccagcacguccccgggaccgcgcccaagcuccugaucuacgagaacguggagcgccggagcggcaucccggaccgcuucuccgccagcaaguccgccaccagcgccacccuggggaucacgggccuccagaccggcgacgaggccgacuacuacugcgggaccugggacaccucccugagcgcgggcgggguguucggcuccgggacgaaggucaccgugcug

SEQ ID NO: 10273 - RNA, 333 nt, Artificial Sequence
  derived and/or modified sequence opt1 from anti-HIV_048-168381_VR-Chain
cagagcgcccugacccagcccgccuccgugagcggcuccccggggcagagcaucaccaucuccugcacgggcaccagcuccaacaucgggagcaacuacgucuccugguaccagcagcuccccggcaccgcgcccaagcugcugaucuacgagaacaaccagcgccccagcgggaucccggaccgguucuccggcagcaaguccggcaccagcgccacgcucgggaucaccggccugcagaccggggacgaggccgacuacuacugcggcaccugggacacgucccugagcgccgggggcguguucggcuccgggaccaaggugaccguccuc

SEQ ID NO: 10274 - RNA, 333 nt, Artificial Sequence
  derived and/or modified sequence opt1 from anti-HIV_048-166619_VR-Chain
cagagcgugcugacccagcccccguccgucagcggcgcccccgggcagcgcgugaccaucuccugcacgggcagcuccagcaacaucgggggcuaccacacccacugguaccagcagcuccccgggaccgcccccaagcugcugaucuacgagaacuccaagcggccgagcggcauccccgaccgcuucuccggcagcaaguccgggaccagcgcgacgcucggcaucaccgggcugcagaccggcgacgaggccgacuacuacugcgggaccugggacacgucccugagcgccggcggcguguucggguccggcaccaaggucaccgugcuc

SEQ ID NO: 10275 - RNA, 333 nt, Artificial Sequence
  derived and/or modified sequence opt1 from anti-HIV_048-162036_VR-Chain
cagagcgugcuggcccagcccccguccgucagcggcgcccccgggcagaccgugaccaucuccugcacgggcagcuccagcaacaucgggggcuacgacgugcacugguaccagcagcuccccgggaccgcgcccaagcugcugaucuacaaggacgacaagcgcccguccggcauccccgaccgguucagcggcuccaagagcgggaccuccgccacccucggcaucacggggcugcagaccggcgacgaggccgacuacuacugcgggaccugggacaccagccugaaccgcggcggcgucuucgggacgggcaccaaggugaccgugcuc

SEQ ID NO: 10276 - RNA, 333 nt, Artificial Sequence
  derived and/or modified sequence opt1 from anti-HIV_048-160042_VR-Chain
cagagcgugcugacccagcccccguccgucagcgccgcccccggccagaaggugaccaucuccugcagcggguccagcuccaacaucggcaucaacuacaucagcugguaccagcagcuccccgggacggcgcccaagauccugaucuacgacaacgacaagcgcccgcugggcauccccgaccgguucuccgggagcaaguccggcaccagcgccacccucggcaucaccgggcugcagacgggcgacgaggccgacuacuacugcgggaccugggacgccucccugagcgccggcgggguguucggcaccggcaccaaggucacggugcuc

SEQ ID NO: 10277 - RNA, 333 nt, Artificial Sequence
  derived and/or modified sequence opt1 from anti-HIV_048-159676_VR-Chain
cagagcgugcugacccagcccccguccgucagcgccucccccggccagaaggugaccaucagcugcuccgggagcuccagcgacaucggcuccaacuacgugagcugguacguccagcuccccgggacggcccccaagcugcugaucuacaagaacaacgagcgcccguccggcauccccgaccgguucagcggguccaagagcggcaccuccgcgacccucggcaucaccgggcugcagacgggcgacgaggccgacuacuacugcgggaccugggacaccagccuguccgccggcgggguguucggcaccggcacgaaggugaccguccuc

SEQ ID NO: 10278 - RNA, 333 nt, Artificial Sequence
  derived and/or modified sequence opt1 from anti-HIV_048-159500_VR-Chain
cagagcgugcugacccagcccccguccgucagcgccgcccccggccagaacgugaccaucuccugcagcggguccuggagcaacaucggcgcgaacuacguguccugguaccagcagcuccccgggacggcccccaagcugcugaucuacgagaacaacaagcgcccgagcggcauccccgaccgguucuccgggagcaaguccggcaccagcgccacccucggcuucaccgggcugcagacgggcgacgaggccgacuacuacugcgggaccugggacaccucccugagcgccggcggggucuucggcaccggcacgaaggugaccgugcuc

SEQ ID NO: 10279 - RNA, 333 nt, Artificial Sequence
  derived and/or modified sequence opt1 from anti-HIV_048-159421_VR-Chain
cagagccugcucacccaggcccccuccgugagcgccgcgccgggccagaccgucacgaucuccugcagcggguccaacgccgacaucggcaagaacuucgugagcugguaccagcagucccccggggccgcccccaagcugcugaucuacgagaacgaccgccggcccagcggcaucccggaccgcuucuccgggagcaaguccggcaccagcgccacccucggcaucaccgggcugcagacgggcgacgaggcggaguacuacugcgccaccugggacgccucccugagcgggggcgggguguucggcaccggcaccaaggucacggugcuc

SEQ ID NO: 10280 - RNA, 333 nt, Artificial Sequence
  derived and/or modified sequence opt1 from anti-HIV_048-159333_VR-Chain
cagagcgugcugacccagcccccguccgccagcggcacccccgggcagcgcgucacgaucuccugcagcggcuccaacagcaacaucggguccgacagcguguacugguaccagcagcuccccggccggucccccaagcugcugaucuaccgcaacaacgagcggccgagcgggauccccgaccgcuucuccggcagcaaguccggcaccagcgccacccucgggaucaccggccugcagacgggggacgaggcggacuacuacugcggcaccugggacaccucccugagcgccgggggcguguucggcaccgggacgaaggucaccgugcuc

SEQ ID NO: 10281 - RNA, 333 nt, Artificial Sequence
  derived and/or modified sequence opt1 from anti-HIV_048-158932_VR-Chain
cagagcgugcugacccagcccgccuccgucagcggcuccccggggcagagcaucaccaucuccugcagcggcuccagcuccaacaucggggacaucuucgugagcugguaccagcagguccccggcgccgcgcccaagcuccugaucuacgacaacgacaagcgccccuccgggaucccggaccgguucagcggcuccaagagcggcacguccgccacccuggacaucaccgggcuccagaccggcgacgaggccgacuacuacugcgggacgugggacaccagccuguccgccggcgggguguucggcaccggcaccaaggugacggugcug

SEQ ID NO: 10282 - RNA, 333 nt, Artificial Sequence
  derived and/or modified sequence opt1 from anti-HIV_048-155811_VR-Chain
cagagcgcccugacccagcccgccuccgugagcggcuccccggggcagagcaucaccaucuccugcacgggcaccagcuccgacgucggguacgacuacgugagcugguaccagcuccugcccggcaccccgcccaagcugcucaucuucaagaacaacgagcgccccuccgggauccccgaccgguucagcggcuccaagagcggcaccuccgcgacgcuggggaucaccggccugcagaccggggacgaggccgacuacuacugcgccaccugggacacgagccucuccgccggcgggguguucggcaccggcaccaaggucaccgugcug

SEQ ID NO: 10283 - RNA, 333 nt, Artificial Sequence
  derived and/or modified sequence opt1 from anti-HIV_048-155464_VR-Chain
cagagcgcccugacccagcccgccuccgugagcggcuccccggggcagagcaucaccaucuccugcacgggcgcgaccggggacagcggccacaccuacgucuccugguaccagcagcuccccgggaccgcccccaagcugcugaucuacagcaacaacgagcgccccuccggcgugccggaccgguucagcggcuccaagagcgggacguccgccacccucggcaucaccgggcugcagaccggcgacgaggccgacuacuacugcgggacgugggacaccagccuguccgccggcggcguguucgggagcggcaccaaggucaccgugcuc

SEQ ID NO: 10284 - RNA, 333 nt, Artificial Sequence
  derived and/or modified sequence opt1 from anti-HIV_048-155392_VR-Chain
cagagcgugcugacccagcccccguccgucagcgccgcccccggccagauggugaccaucuccugcagcggguccagcuccaacaucggcgacaacuacgugagcugguaccagcagcuccccgggcgcggccccaagcugcuggucuacgacacguacaagcgguaccucgagaccccggaccgcuucuccgggagcaaguccggcaccagcgcgacccugggcaucacggggcugcagaccggcgacgaggccgacuacuacugcgggaccugggacaccucccucagcgccggcgggguguucggcacgggcaccaaggugaccguccug

SEQ ID NO: 10285 - RNA, 333 nt, Artificial Sequence
  derived and/or modified sequence opt1 from anti-HIV_048-155389_VR-Chain
cagagcgugcugacccagcccccguccgucagcgccgcccccggccagaaggugaccaucuccugcagcgggaucuccagcaacaucggcaacaaccccguguccugguaccagcaguuccccgggacggcgccgaagcuccugaucuacaagaacgacaagcgccccagcggcauccccgaccgguucuccgggagcaaguccggcaccagcgccacccugggcaucaccgggcuccagacgggcgacgaggccgacuacuacugcgggaccugggacaccucccugagcaccggcggggucuucggcacgggcaccaaggugaccgugcug

SEQ ID NO: 10286 - RNA, 333 nt, Artificial Sequence
  derived and/or modified sequence opt1 from anti-HIV_048-154449_VR-Chain
cagagcgugcugaagcagcccccguccgucagcggcgcccccgggcuccgcgugaccaucuccugcaccggcgggagcuccaacaucggcggguucgacgugcacugguaccagcacuuccccggcacggcccccaagcugcugaucuacgacaacgaccagcggccgagcggcauccccgaccgcuucuccgggagcaaguccggcaccagcgcgacccucgggaucaccggccugcagacgggggacgaggccgacuacuacugcggcaccugggacuccagccuguccgccggcggggucuucggcaccgggaccaaggugacggugcuc

SEQ ID NO: 10287 - RNA, 333 nt, Artificial Sequence
  derived and/or modified sequence opt1 from anti-HIV_048-153379_VR-Chain
cagagcgugcugacccagcccccguccgucagcgccacccccggccagaaggugacgaucuccugcagcgggucccgcagcaacaucggcucccacuacgugagcugguaccagcaguuccccgaguccgcccccaagcuccugaucuacaagaacgacaaccggccgagcgggauccccgaccgcuucuccggcagcaaguccgggaccagcgcgacccugggcaucuccggccuccagaccggggacgaggccgacuacuacugcggcacgugggacaccagccuguccgggggcggggucuucggcaccggcaccaaggugacggugcug

SEQ ID NO: 10288 - RNA, 333 nt, Artificial Sequence
  derived and/or modified sequence opt1 from anti-HIV_048-153171_VR-Chain
cagagcgugcugacccagcccccguccgucagcgccgcccccggccagaaggugaccaucuccugcagcggguccacgagcaacaucgaggacaucuacguguccugguaccagcaccuccccggcaccgcgcccaagcugcugaucuacgacaacaacaagcgcccgagcgggauccccgaccgguucuccggcagcaaguccgggaccagcgccacccucgccaucacgggccugcagaccggcgacgaggccgacuacuacugcgggaccugggacaccucccugagcgccggcggggucuucggcacggggaccaaggugaccgugcuc

SEQ ID NO: 10289 - RNA, 333 nt, Artificial Sequence
  derived and/or modified sequence opt1 from anti-HIV_048-152324_VR-Chain
cagagcauggugacccagucccccagcgucuccgccgccccgggccagaaggugaccaucagcugcuccgggacgagcuccaacaucggccagaacuacgugagcugguaccagcagcugcccgggaccgcgcccaagcuccugaucuacgagaacuccaagcgccccagcggcaucccggaccgguucuccgggagcaaguccggcaccagcgccacccugggcaucacggggcuccagaccggcgacgaggccgacuacuacugcgggaccugggacaccucccugagcgccggcggggucuucggcuccggcacgaaggugaccgugcug

SEQ ID NO: 10290 - RNA, 333 nt, Artificial Sequence
  derived and/or modified sequence opt1 from anti-HIV_048-146102_VR-Chain
cagagcgugcugacccagcccccguccgucagcgccgcccccggccagaaggugaccaucuccugcagcggguccagcuccacgaucggcaacaacuacaucagcugguaccagcuccugcccgggacgcccccgaagcugcucaucuacaagaacaacgagcgccccuccggcauccccgaccgguucagcggguccaagagcggcaccuccgcgacccugggcaucaccgggcugcagaccggcgacgaggccgacuacuacugcgggaccugggacaccagccucuccgccggcgggguguucggcacgggcaccaaggucaccgugcug

SEQ ID NO: 10291 - RNA, 333 nt, Artificial Sequence
  derived and/or modified sequence opt1 from anti-HIV_048-145984_VR-Chain
cagagcgugcugacccagccccucuccgucagcggcgccccggggcagcgcgugaccaucuccugcacgggcagcuccagcaacaucggguccaacuucgugagcugguaccagguccugcccggcaccacccccaagcugcucaucuucaagaacaacgagcggcccuccgggaucccggaccgcuucagcggcuccaagagcggcaccuccgccacgcuggggaucaccggccugcagaccggggacgaggcggacuacuacugcggcgccugggacaccagccucuccgccgggggcguguucggcacggggaccaaggugaccguccug

SEQ ID NO: 10292 - RNA, 333 nt, Artificial Sequence
  derived and/or modified sequence opt1 from anti-HIV_048-145371_VR-Chain
cagagcgugcugacccagcccccguccgucagcgccgccuccggccagaaggugagcauccccugcuccgggggcaccagcaacaucggggacaacuacguguccugguuccagcaguuccccggcagcgcgcccaagauccucaucuacgacuccgacaagcgcccgagccggaucuccgaccgcuucagcgccuccaagagcgggacguccgccacccuggacaucacccggcugcagaccggcgacgaggccgacuacuacugcggcacgugggacaccagccucuccgccgggggcgucuucgggaccggcaccaaggugacggugcug

SEQ ID NO: 10293 - RNA, 333 nt, Artificial Sequence
  derived and/or modified sequence opt1 from anti-HIV_048-144907_VR-Chain
cagagcgcccugacccagcccgccuccgugagcggcuccccggggcagagcaucaccaucuccugcacgggcacccgccgggacgucggguucaacuacgugagcugguaccagcagcaccccggcaccgcgcccaagcuccugaucuacgagaacaacaagcgccccuccgggaucccggaccgguucagcggcuccaagagcggcaccuccgccacgcuggggaucaccggccuccagaccggggacgaggccgacuacuacugcggcaccugggacagcucccugagcgccgggggcguguucggcacggggaccaaggucaccgugcug

SEQ ID NO: 10294 - RNA, 333 nt, Artificial Sequence
  derived and/or modified sequence opt1 from anti-HIV_048-142298_VR-Chain
cagagcgugcugacccagcccccguccgccagcggcacccccgggcagcgcgucacgaucuccugcagcggcuccagcuccaccaucgggaacaacuacaucagcugguaccagcuccugcccggcacgcccccgaagcugcucaucuucaagaacaacgagcggcccuccgggauccccgaccgcuucagcgccuccaagagcggcaccuccgcgacccugggcaucaccgggcugcagaccggcgacgaggccgacuacuacugcgggaccugggacacgagccucuccgccggcgggguguucggcaccggcaccaaggugaccguccug

SEQ ID NO: 10295 - RNA, 333 nt, Artificial Sequence
  derived and/or modified sequence opt1 from anti-HIV_048-142277_VR-Chain
cagagcgugcugacccagcccccguccgucagcggcgcccccgggcagcgcaucaccaucuccugcacgggcagcuccagcaacaucggggccuacgacgugcagugguaccagcaccuccccggcaccgcgcccaagcugcugaucuacaagaacaccgagcggccguccgggauccccgaccgcuucagcggcuccaagagcggcaccuccgccacgcucgacaucaccgggcugcagaccggcgacgaggccgacuacuacugcgggaccugggacacgagccuguccgccggcgggguguucggcaccggcaccaaggucaccgugcuc

SEQ ID NO: 10296 - RNA, 333 nt, Artificial Sequence
  derived and/or modified sequence opt1 from anti-HIV_048-141934_VR-Chain
cagagcgugcugacccagcccccguccgucagcggcgcccccgggcagcgcgugaccaucuccugcacgggcaacagcuccaacaucggggccuacgacgugcacugguaccagcagcuccccggcaccgcgcccaagcugaugaucuacgaggucagcaagcggccguccgggauccccgaccgcuucagcggcuccaagagcggcaccuccgccacccuggggaucacgggccuccagaccggggacgaggccgacuacuacugcggcaccugggacaccagccuguccgccgggggcguguucggcagcgggacgaaggugaccguccug

SEQ ID NO: 10297 - RNA, 333 nt, Artificial Sequence
  derived and/or modified sequence opt1 from anti-HIV_048-141207_VR-Chain
cagagcgugcugacccagcccccguccgucagcgccgcccccggccagaaggugaccaucgcgugcuccgggagcuccagcaacaucggcaacaacuacguguccugguaccagcagcuccccgggacggcccccaagcugcugaucuacgccaacaaccgccggccgagcggcauccccgaccgcuucuccgccagcaaguccgggaccagcgccacccucggcaucaccggccugcagacgggggacgaggcggacuacuacugcggcaccugggacaccucccugagcgccgggggcgucuucgggaccggcacgaaggugaccgugcuc

SEQ ID NO: 10298 - RNA, 333 nt, Artificial Sequence
  derived and/or modified sequence opt1 from anti-HIV_048-140796_VR-Chain
cagagcgugcugacccagcccccguccgucagcgccacccccggccagaaggugacgaucuccugcagcgggacccgcuccaacaucggcaacaacuacgugagcugguaccggcaguuccccgggaccgcccccaagcuccugaucuacgaggacaacaagcgcccguccggcauccccgcgcgguucagcggguccaagagcggcaccuccgccacgcugggcaucaccgggcuccagaccggcgacgaggccgacuacuacugcgggaccugggacacgagccuguccgccggcggggucuucggcaccggcaccaaggugaccgugcug

SEQ ID NO: 10299 - RNA, 333 nt, Artificial Sequence
  derived and/or modified sequence opt1 from anti-HIV_048-139893_VR-Chain
cagagcgugcugacccagcccccguccgucagcgccacccccggccagaaggugacguucuccugcagcggguccagcuccaccaucggcaagaacuacgugagcugguaccagguccuccccgggaccgcccccaagcugcugaucuacaagaacaacaagcgcccguccggcauccccgaccgguucagcggguccaagagcggcaccuccgcgacgcucggcaucaccgggcugcagaccggcgacgaggccgacuacuacugcgggaccugggacagcucccugagcgccggcgggguguucggcacgggcaccaaggugaccguccuc

SEQ ID NO: 10300 - RNA, 333 nt, Artificial Sequence
  derived and/or modified sequence opt1 from anti-HIV_048-138820_VR-Chain
cagagcgugcugacccagcccccguccgucagcggcgcccccgggcagaaggugaccaucuccugcagcggcuccgggagcaacaucggcaacacguacguguccugguaccagcaccuccccgggaccgcccccaagcugcugaucuacgagaacaacaagcgcccgagcggcauccccgaccgguucuccggcagcaaguccgcgaccagcgccacccucgggaucacgggccugcagaccggggacgaggccgacuacuacugcggcaccugggacaccucccugagcgccgggggcgucuucggcacggggaccaaggugaccgugcuc

SEQ ID NO: 10301 - RNA, 333 nt, Artificial Sequence
  derived and/or modified sequence opt1 from anti-HIV_048-135858_VR-Chain
cagagcgugcugacccagcccccguccgccagcggcacccccgggcagcgcgucacgaucuccugcagcggcuccagcuccaacaucgggagcuccuacguguacugguaccagcaguuccccggccggagcccccgccuccugaucuaccggaacaacgagcgcccguccgggauccccgaccgguucagcggcuccaagagcggcaccuccgccacccuggggaucaccggccuccagacgggggacgaggcggacuacuacugcggcaccugggacaccagccuguccgccgggggcguguucggcaccgggacgaaggucaccgugcug

SEQ ID NO: 10302 - RNA, 333 nt, Artificial Sequence
  derived and/or modified sequence opt1 from anti-HIV_048-134968_VR-Chain
cagagcgugcugacccagcccccguccgucagcgccgcccccggccagaaggugaccaucuucugcuccgggagcuccagcaacaucggcaagaacuacguguccugguaccagcagcuccccgggacggcgcccaagcugcugaucuacgagaacagcaagcgcccguccggcauccccgaccgguucagcggguccaagagcggcaccuccgccacccucggcaucaccgggcugcagacgggcgacgaggccgacuacuacugcgggaccugggacaccagccuguccgccggcggggucuucggcagcggcaccaaggugacggugcuc

SEQ ID NO: 10303 - RNA, 333 nt, Artificial Sequence
  derived and/or modified sequence opt1 from anti-HIV_048-134312_VR-Chain
cagagcgugcugacccagcccccguccgccagcggcacccccgggcagcgcgucacgaucuccugcagcggcuccagcuccaacaucgggaacaacuacgugagcugguaccggcuccugcccggcaccgcccccaagcugcucaucuacaagaacgacaaccgcccguccgggauccccgaccgguucagcggcuccaagagcggcaccuccgcgacccuggggaucagcggccugcagacgggggacgaggccgacuacuacugcggcaccugggacaccucccucagcgggggcggcguguucgggaccggcacgaaggucaccgugcug

SEQ ID NO: 10304 - RNA, 330 nt, Artificial Sequence
  derived and/or modified sequence opt1 from anti-HIV_048-132253_VR-Chain
agcgcccugacccagcccgccuccgugagcggcuccccggggcagagcaucgcgaucuccugcaccggcacgagcuccgacgucggguacgaccucgugagcugguaccagcagcaccccggcaccgcccccaagcugcugaucuacgacaacaacaagcgccccuccgggaucccggaccgguucagcggcuccaagagcggcaccuccgccacccucgggaucacgggccugcagaccggggacgaggccgacuacuacugcggcaccugggacaccagccuguccgccgggggcguguucggcagcgggacgaaggucaccgugcuc

SEQ ID NO: 10305 - RNA, 333 nt, Artificial Sequence
  derived and/or modified sequence opt1 from anti-HIV_048-130710_VR-Chain
cagagcgugcugacccagcccccguccgucgccggcgcccccgggcagcgcgugaccaucagcugcacgggcaacaccuccaacaucgggggcuacgacgugcacugguaccagcagcuccccgggacgcccccgaagcugcugaucuucaagaacaacgagcggcccagcggcauccccgaccgcuucuccggcagcaaguccgggaccagcgcgacccucggcaucaccgggcugcagaccggcgacgaggccgacuacuacugcgggaccugggacacgucccugagcgccggcggcgucuucgggaccggcaccaaggugaccgugcuc

SEQ ID NO: 10306 - RNA, 333 nt, Artificial Sequence
  derived and/or modified sequence opt1 from anti-HIV_048-128564_VR-Chain
cagagcgugcugacccagcccccguccgccagcggcacccccgggcagcgcgucacgaucuccugcagcggcuccagcuccaacaucgggagcaacaccgugaacugguaccagcagcuccccggcaccgcccccaagcugcugaucuacaagaacaccgagcggccguccgggauccccgaccgcuucagcggcuccaagagcggcacguccgcgacccucgacaucaccgggcugcagaccggcgacgaggccgacuacuacugcgggacgugggacaccagccuguccgccggcgggguguucggcaccggcaccaaggucacggugcuc

SEQ ID NO: 10307 - RNA, 333 nt, Artificial Sequence
  derived and/or modified sequence opt1 from anti-HIV_048-126702_VR-Chain
cagagcgugcugacccagcccccguccgcgagcgccgcgcccggccagcgcgucaccaucuccugcagcggguccaacagcaacaucggcaacaacuacguguccugguaccagcagcuccccgggacggcccccaagcugcugaucuacgacaacagcaagcggccguccggcauccccgaccgcuucagcgccuccaagagcgggaccuccgccacccucggcaucaccggccugcagacgggggacgaggccgacuacuacugcggcaccugggacaccagccuguccgccgggggcguguucgggaccggcacgaaggucaccgugcuc

SEQ ID NO: 10308 - RNA, 333 nt, Artificial Sequence
  derived and/or modified sequence opt1 from anti-HIV_048-124521_VR-Chain
cagagcgugcugacccagcccccguccgucagcggcgcccccgggcagcgcgugaccaucuccugcacgggcagcuccagcaccuucgggggcuacgacguguacugguaccagcagauccccgggaccgcccccaagcuccugaucuacgagaacaacaagcggccguccggcauccccgaccgcuucagcggcuccaagagcgggaccuccgcgacgcuggccaucaccggccuccagaccggggacgaggccgacuacuacugcggcaccugggacgggagccuguccacgggcggcgucaucgggaccggcaccaaggugaccgugcug

SEQ ID NO: 10309 - RNA, 333 nt, Artificial Sequence
  derived and/or modified sequence opt1 from anti-HIV_048-122740_VR-Chain
cagagcgugcugacccagcccccguccaugagcgccgcccccggccaguccgucaccaucagcugcuccgggagcacguucaacaucgagaagcaccaggugaccuggcuccgccaccuccccggcaccgcgcccaccuccgugaucaucaugaacagccagcggccguccgggacgcccgaccgcuucagcggcuccaagagcgggaccuccgccacccuggccaucaccggccugcagacgggcgacgaggccgacuacuacugcgggaccugggacggcagccuguccaccgggggcgucaucgggaccggcacgaaggugaccgugcug

SEQ ID NO: 10310 - RNA, 327 nt, Artificial Sequence
  derived and/or modified sequence opt1 from anti-HIV_048-119536_VR-Chain
gagcugacccagagccccuccgugagcgccgccccgggcgagaaggucaccaucuccugcagcgggacgaacuccaacaucggcuacuacuacgugagcugguaccagcaguuccccgggaccgcgcccaagguggucaucuacgagaacaccaagcgccccuccggcaucccggaccgguucagcggguccaagagcggcaccuccgccacgcucggcaucaccgggcugcagaccggcgacgaggccgacuacuacugcgggaccugggacacgagccuguccgccggcgggguguucggcagcggcaccaaggugaccguccuc

SEQ ID NO: 10311 - RNA, 333 nt, Artificial Sequence
  derived and/or modified sequence opt1 from anti-HIV_048-116929_VR-Chain
cagagcgugcugacccagcccccguccgucagcggcgcccccgggcagcgcgugaccaucuccugcacgggcagcuccagcaacaucggggacuacgacgugcacugguaccagcagcuccccggcaccgcccccaagcugcugaucuaccggaacaaccagcgcccguccgggguccccgaccgguucagcggcuccaagagcggcaccuccgcgacccucgggaucacgggccugcagaccggggacgaggccgacuacuacugcggcaccugggacgccagccuguccgccgggggcguguucggcaccgggacgaaggugaccguccuc

SEQ ID NO: 10312 - RNA, 333 nt, Artificial Sequence
  derived and/or modified sequence opt1 from anti-HIV_048-116577_VR-Chain
cagagcgugcugacccagcccccguccgccagcggcacccccgggcagcgcgucacgaucuccugcagcggcuccagcuccaacaucgggagcaacuacguguccugguaccaggugcuccccggcaccgcccccaagcugcugaucuacaagaacaacaagcggccgagcgggauccccgaccgcuucuccggcagcaaguccggcaccagcgcgacccucgggaucacgggccugcagaccggggacgaggccgacuacuacugcgccaccugggacaccucccugagcgccggcggggucuucggcacgggcaccaaggugaccgugcuc

SEQ ID NO: 10313 - RNA, 333 nt, Artificial Sequence
  derived and/or modified sequence opt1 from anti-HIV_048-116046_VR-Chain
cagagcgugcugacccagcccccguccgucagcggcgcccccgggcagcgcgugaccaucuccugcacgggcagcuccagcaacaucgggggcuacgacgugcacugguaccagcaguuccccgggaccgcccccaagcuccugaucuacgacaacgacaagcggccguccggcauccccgaccgcuucagcggcuccaagagcgggaccuccgcgacccugggcaucacggggcuccagaccggcgacgaggccaacuacuacugcggggccugggacaccagccuguccgccggcggcgucuucgggaccggcacgaaggugaccgugcug

SEQ ID NO: 10314 - RNA, 333 nt, Artificial Sequence
  derived and/or modified sequence opt1 from anti-HIV_048-115875_VR-Chain
cagagcgugcugacccagcccccguccgucagcgccgcccccggccagcgcgugaccguguccugcagcggguccagcuccaacaucggcaacaacuucgucagcugguaccagcaccuccccgggacggcgcccaagcugcugaucuacgacaacuccaaccggccgagcggcauccccgaccgcuucuccgggagcaaguccggcaccagcgccacccucggcaucaccgggcugcacacgggcgacgaggccgacuacuacugcgggaccugggacaccucccugagcgccggcgggguguucggcuccggcaccaaggugacgguccuc

SEQ ID NO: 10315 - RNA, 333 nt, Artificial Sequence
  derived and/or modified sequence opt1 from anti-HIV_048-115599_VR-Chain
cagagcgugcugacccagcccccguccgucagcgccgcccccggccagauggugaccaucuccugcagcggguccagcuccaacaucggcagccacuccgugagcugguaccagcacuuccccgggacggcgcccaagcucgucaucgaggagaacgaccagcgcccguccggcauccccgaccgguucagcggguccaagagcggcaccuccgccacccugggcaucaccgggcugcagacgggcgacgagggggacuacuacugcggcaccugggacaccagccucuccgggggcggcguguucgggaccggcacgaaggugaccguccug

SEQ ID NO: 10316 - RNA, 333 nt, Artificial Sequence
  derived and/or modified sequence opt1 from anti-HIV_048-113988_VR-Chain
cagagcgugcugacccagcccccguccgucagcgccgcccccggccagauggugaccaucuccugcagcggguccagccacaacaucggcgagaacuacguguccugguaccagcaccuccccgggacggcgcccaagcugcugaucuucaagaacaacgagcgcccgagcggcauccccgaccgguucuccgggagcaaguccggcaccagcgccacccucggcaucaccgggcugcagacgggcgacgaggccgacuacuacugcgggaccugggacaccucccugagcgccggcggggucuucggcaccggcacgaaggugaccgugcuc

SEQ ID NO: 10317 - RNA, 333 nt, Artificial Sequence
  derived and/or modified sequence opt1 from anti-HIV_048-112989_VR-Chain
cagagcgugcugacccagcccccguccgccagcggcacccccgggcagcgcgucacgcucuccugcagcggcggguccagcaacaucggcaacgacaacguguacugguaccagcagcggcccgggaccacccccaagcugcugaucuacaacgacaaccgccggccguccggcacccccgaccgcuucagcggcuccaagagcgggacguccgccacccucgcgaucaccggccugcagaccggggacgaggccgacuacuacugcggcacgugggacgggagccuguccaccggcggcgugaucgggaccggcaccaaggucacggugcuc

SEQ ID NO: 10318 - RNA, 333 nt, Artificial Sequence
  derived and/or modified sequence opt1 from anti-HIV_048-112435_VR-Chain
cagagcgugcugacccagcccccguccgucagcgccgcccccggccagaagguguccaucagcugcuccgggagcuccagcaacaucggcaagaacuacguguccugguaccagcagcuccccgggaccgcgcccaagcugcugaucuucaagaacaacgagcgcccgagcggcauccccgaccgguucuccgggagcaaguccggcacgagcgccacccucggcaucaccgggcugcagaccggcgacgaggccgacuacuacugcgccacgugggacaccucccugagcgccgggggcgucuucgggaccggcaccaaggugacggugcuc

SEQ ID NO: 10319 - RNA, 333 nt, Artificial Sequence
  derived and/or modified sequence opt1 from anti-HIV_048-111339_VR-Chain
cagagcgugcugacccagcccccguccgucagcgccgcccccggccagaaggugaccaucuccugcacggggagcuccagcaacaucggcggguacgcggugcacugguaccagcagguccccgccaccgcccccaagcuccugaucuacgagaacaacgagcgcccguccggcauccccgaccgguucagcggguccaagagcggcaccuccgccacccugggcaucacggggcuccagaccggcgacgaggccgacuacuacugcgggaccugggacaccagccuguccgcgggcgggguguucggcacgggcaccaaggugaccguccug

SEQ ID NO: 10320 - RNA, 333 nt, Artificial Sequence
  derived and/or modified sequence opt1 from anti-HIV_048-111055_VR-Chain
cagagcgcccugacccagcccgccuccgugagcggcuccccggggcagagcaucaccaucuccugcacgggcacccgcagcgacgucggguacaacuacguguccugguaccagcagcaccccggcaaggcgcccaagcuccugaucuacgagaacaccaagcggcccagcgggaucccggaccgcuucuccggcagcaaguccggcaccagcgccacgcuggggaucaccggccuccagaccggggacgaggccgacuacuacugcggcaccugggacacgucccugagcgccgggggcguguucggcuccgggaccaaggucaccgugcug

SEQ ID NO: 10321 - RNA, 333 nt, Artificial Sequence
  derived and/or modified sequence opt1 from anti-HIV_048-111027_VR-Chain
cagagcgugcugacccagcccccguccgucagcgccgcccccggccagaaggugaccaucuccugcagcggguccaacagcaaccucggcaacaacuacguguccugguaccagcaccuccccgggacggcgccccgccugcugaucuacgaggacaagaagcggccgagcggcauccccgaccgcuucuccgggagcaaguccggcgccagcgccacccuggacaucaccggccugcagaccggggacgaggccgacuacuacugcggcaucugggacacgucccucagcgccgggggcgucuucgggaccggcaccaaggugaccgugcug

SEQ ID NO: 10322 - RNA, 333 nt, Artificial Sequence
  derived and/or modified sequence opt1 from anti-HIV_048-109721_VR-Chain
cagagcgugcugacccagcccccguccgucagcgccgcccccggccagaaggugaccaucuccugcagcggguccagcuccgacaucggcagcaacuucguguccugguaccagcaccuccccgggacggcgccccgccugcugaucuacgagaacaaccggcgcccgagcggcauccccgaccgguucuccgggagcaaguccggcaccagcgccacccucgccaucaccggccugcagacgggggacgaggccgacuacuacugcggcaccugggacaccucccugaaccgcgggggcgucuucgggaccggcacgaaggugaccgugcuc

SEQ ID NO: 10323 - RNA, 333 nt, Artificial Sequence
  derived and/or modified sequence opt1 from anti-HIV_048-109666_VR-Chain
cagagcgugcugacccagcccccguccaugagcgccgcccccggcgagcgcgucaccaucuccugcagcggguccagcuccaacaucggcaaccaccacgugagcugguaccagcagcggcccgggacggcgcccaagcuccugaucuacgagaacaacgagcgcccguccggcauccccgaccgguucagcggguccaagagcggcuccagcgccacccuggccaucaccggccuccagaccggggacgaggccgacuacuacugcggcacgugggacgggcgccugaacaucggcggggugaucggcaccggcaccaaggucaccgugcug

SEQ ID NO: 10324 - RNA, 333 nt, Artificial Sequence
  derived and/or modified sequence opt1 from anti-HIV_048-109196_VR-Chain
cagagcgugcugacccagcccccguccgucagcgccgcccccggccagaaggugaccaucuccugcagcggguccagcuccaacaucggcaacaacuacgugagcugguaccagcagcuccccgggacggcgcccaagcugcugaucuacgagaccaacaagcgcccguccggcauccccgaccgguucagcggguccaagagcggcaccuccgccacccucgccaucacgggccugcagaccggggacgaggccgacuacuacugcggcaccugggacaccagccuguccgggggcggggucuucggcacgggcaccaaggugaccgugcuc

SEQ ID NO: 10325 - RNA, 333 nt, Artificial Sequence
  derived and/or modified sequence opt1 from anti-HIV_048-109051_VR-Chain
cagagcgugcugacccagcccccguccgucagcgccgcccccggccagaaggugaccaucuccugcagcgggaacaacuccaacauggugaacaacuacaucagcugguaccagcuccugcccggcacgcccccgaagcugcucaucuucaagaacaacgagcgccccuccgggauccccgaccgguucagcggcuccaagagcgggaccuccgcgacccugggcaucaccggccugcagacgggggacgaggccgacuacuacugcggcaccugggacaccagccucuccgccgggggcgucuucgggaccggcacgaaggugaccgugcug

SEQ ID NO: 10326 - RNA, 333 nt, Artificial Sequence
  derived and/or modified sequence opt1 from anti-HIV_048-108570_VR-Chain
cagagcgcccugacccagcccccguccgugagcgccgcgcccggccagaaggucaccaucuccugcagcgggaaguccagcaacaucggcacgaacuucguguccugguaccagcaguuccccgaggccgcccccaagcuccugaucuacgacaacaacaagcgcccgagcgggauccccgaccgguucuccggcagcaaguccgggaccagcgccacccugggcaucaccggccuccagacgggggacgaggccgacuacuacugcggcaccugggacgggucccugagcaccggcggggugaucggcaccggcacgaaggucaccgugcug

SEQ ID NO: 10327 - RNA, 327 nt, Artificial Sequence
  derived and/or modified sequence opt1 from anti-HIV_048-108033_VR-Chain
gagcugacccagagccccuccgugagcgccgccccgggccagcgcgucaccaucuccugcagcgggaacuccagcaacaucggcaacaacuacguguccugguaccagcuccugcccgggacggcgcccaagcugcucaucuacaagaacgacaagcggcccagcggcaucccggaccgcuucuccgggagcaaguccggcaccagcgccacccugggcaucaccgggcugcagacgggcgacgaggccgacuacuacugcgggaccugggacaccucccucagcaccggcgggguguucggcacgggcaccaaggucaccgugcug

SEQ ID NO: 10328 - RNA, 333 nt, Artificial Sequence
  derived and/or modified sequence opt1 from anti-HIV_048-107279_VR-Chain
cagagcgugcugacccagcccccguccgucagcgccgcccccggccagaaggugaucaucuccugcagcggguccagcuccaacaucggcaagaacuacgugagcugguaccagcaccuccccgggaccgcgcccaagcugcugaucuacgagaacaacaagcgcccguccggcauccccgaccgguucagcggguccaagagcggcacguccgccacccucggcaucaccgggcugcagaccggcgacgaggccgacuacuacugcgggacgugggacgccagccuguccgccggcgggguccucggcaccggcaccaaggugaccgugcug

SEQ ID NO: 10329 - RNA, 333 nt, Artificial Sequence
  derived and/or modified sequence opt1 from anti-HIV_048-106271_VR-Chain
cagagcgugcugacccagcccccguccgucagcgccgcccccggccagaaggugaccaucuccugcagcgggucccgcagcaacaucggcuccaacuacaucagcugguaccagcagcuccccgggacggcgcccaagcugcugaucuacaagaacgacaagcggccguccggcauccccgaccgcuucagcggguccaagagcggcaccuccgccauccucggcaucaccgggcugcagaccggcgacgaggccgacuacuacugcggggccugggacacgagccuguccgccggcgggguguucggcaccggcaccaaggucaccgugcuc

SEQ ID NO: 10330 - RNA, 333 nt, Artificial Sequence
  derived and/or modified sequence opt1 from anti-HIV_048-106054_VR-Chain
cagagcgugcugacccagcccccguccgucagcgccgcccccggccagcaggucaccaucuccugcagcggguccacgagcaacaucggcaacaacuacguguccugguaccagcagguccccgggaccgcgcccaagcuccugaucuacgacaacaacaaccgcccgagcggcauccccgaccgguucuccgggagcaaguccggcaccagcgccacccugggcaucuccgggcuccagacgggcgacgaggccgacuacuacugcgggaccugggacaccagccuguccggcgggggcguguucggcaccgggacgaaggugaccgugcug

SEQ ID NO: 10331 - RNA, 333 nt, Artificial Sequence
  derived and/or modified sequence opt1 from anti-HIV_048-104848_VR-Chain
cagagcgcccugacccagcccgccuccgugagcggcuccccggggcagagcaucaccaucuccugcacgggcaccagcuccgacgucggguacaacuacgugagcugguaccagcagcuccccggcaccgcgcccaagcugcugaucuucgacaacgacgaccgccccuccgagaucccggaccgguucagcggguccaagagcggcaccuccgccacgcucggcaucaccgggcugcagcccggcgacgaggccgacuacuacugcgggaccugggacagcucccugagcgccggcgggguguucggcaccggcacgaaggucaccgugcuc

SEQ ID NO: 10332 - RNA, 333 nt, Artificial Sequence
  derived and/or modified sequence opt1 from anti-HIV_048-104638_VR-Chain
cagagcgugcugacccagcccccguccgccagcggcacccccgggcaccgcgucacgaucuccugcagcggcaacuccagcaacaucgggggcaaccacguguacugguaccagcagguccccgggaccacccccaagcuccugaucuaccggaacaacgagcgcccguccggcauccccgaccgguucagcggcuccaagagcgggaccuccgccacgcugggcaucaccgggcuccagaccggcgacgaggcggacuacuacugcgggaccugggacacgagccuguccgccggcggcguguucgggaccggcaccaaggugaccgugcug

SEQ ID NO: 10333 - RNA, 333 nt, Artificial Sequence
  derived and/or modified sequence opt1 from anti-HIV_048-104567_VR-Chain
cagagcgugcugacccagcccccguccgccagcggcacccccgggcagcgcgucacgaucuccugcagcggcuccaacagcaacaucgggaccaacuucgugaacugguaccagcacgugcccggccgggcccccaagcuccugaucuacaagaacaccgagcgcccguccgggauccccgaccgguucagcggcuccaagagcggcaccuccgcgacgcuggacaucaccgggcuccagaccggcgacgaggccgacuacuacugcgggaccugggacacgagccuguccgccggcggggucuucggcaccggcaccaaggugaccgugcug

SEQ ID NO: 10334 - RNA, 333 nt, Artificial Sequence
  derived and/or modified sequence opt1 from anti-HIV_048-102804_VR-Chain
cagagcgugcugacccagcccccguccgucagcaccgcccccggccagaaggugacgaucuccugcagcggguccagcuccaacaucggcuacagcuacguguccugguuccagcaccuccccgggaccgcccccaagcugcugaucuacggcaacagcaaccgcccguccgggguccccgaccgguucagcggcuccaagagcggcaccuccgcgagccucgccaucaccgggcugcagacgggcgacgaggccgacuacuacugcgggaccugggacuccagccuguccgccggcgggguguucggcaccggcaccaaggugacgguccuc

SEQ ID NO: 10335 - RNA, 333 nt, Artificial Sequence
  derived and/or modified sequence opt1 from anti-HIV_048-101676_VR-Chain
cagagcgugcugacccagcccccguccgucagcggcgcccccgggcaguccgugaccaucagcugcacgggcaccuccagcaacaucggggacuucgacgugcacugguaccagcagcuccccggcaccgcccccaagcugcugcucuacgagaacaacaagcgcccguccgggauccccgaccgguucagcggcuccaagagcggcaccuccgcgacgcuggccaucaccgggcugcagaccggcgacgaggccgacuacuacugcgggaccugggacggcagccucuccaccgggggcgucaucggcacggggaccaaggugaccgugcug

SEQ ID NO: 10336 - RNA, 333 nt, Artificial Sequence
  derived and/or modified sequence opt1 from anti-HIV_048-097603_VR-Chain
cagagcgugcugacccagcccccguccgucagcgccgcccccggccagaaggugaccaucuccugcagcggguccagcuccaacaucggcaacaacuacgugagcugguaccagcagcuccccgggacggcgcccaagcugcugaucuacgacaccgucaagcgcccguccggcauccccgaccgguucagcggguccaagagcggcaccuccgccacccucggcaucacggggcugcagaccggcgacgaggccgacuacuacugcgggaccugggacagcucccugagcggcgggggcguguucggcaccgggacgaaggugaccguccuc

SEQ ID NO: 10337 - RNA, 333 nt, Artificial Sequence
  derived and/or modified sequence opt1 from anti-HIV_048-097107_VR-Chain
cagagcgugcugacccagcccccguccgucagcgccgcccccggccagaaggugaccaucuccugcagcggguccagcuccaacaucgagaacaacuacgugagcugguaccgccagguccccggcacggcgcccaagcuccugaucuacaagaacgacaaccggccguccgggauccccgaccgcuucagcggcuccaagagcgggaccuccgccacccugggcaucaccggccuccagacgggggacgaggccgacuacuacugcggcaucugggacaccagccuguccgccgggggcguguucgggaccggcaccaaggugacgguccug

SEQ ID NO: 10338 - RNA, 333 nt, Artificial Sequence
  derived and/or modified sequence opt1 from anti-HIV_048-096871_VR-Chain
cagcccgugcugacccagccgcccagcgccuccggcacccccgggcagcgcgucacgaucagcugcuccggcagcuccagcaacaucggguccaacuacguguacugguaccagcagcuccccggcaccaccccgaagcugcugaucuaccggaacaaccagcgccccagcgggauccccgaccgguucuccggcagcaaguccggcaccagcgccacgcucgggaucaccggccugcagaccggggacgaggcggacuacuacugcggcaccugggacacgucccugagcaccgggggcguguucggcaccgggaccaaggucacggugcuc

SEQ ID NO: 10339 - RNA, 333 nt, Artificial Sequence
  derived and/or modified sequence opt1 from anti-HIV_048-096668_VR-Chain
cagagcgugcugacccagcccccguccgucagcgccgcccccggccagaaggugaccaucuccugcagcggguccggcagcaacaucgggaacaacuacguguccugguaccagcagcuccccggcacggcgcccaagcugcugaucuacaagaacaccgagcgcccgagcgggauccccgaccgguucuccggcagcaaguccggcaccagcgccacccucgacaucacggggcugcagaccggcgacgaggccgacuacuacugcgggaccugggacaccucccugagcgccggcggggucuucggcacgggcaccaaggugaccgugcuc

SEQ ID NO: 10340 - RNA, 333 nt, Artificial Sequence
  derived and/or modified sequence opt1 from anti-HIV_048-095236_VR-Chain
cagagcgugcugacccagcccccguccgucagcgccccgcccggccagaaggugaccaucuccugcagcgggacgaccuccaacaucggcagcaacuacguggccugguaccagcagcuccccgggaccgcgcccaagcuggucaucuacgagaacuccaagcgccccagcggcauccccgaccgguucuccgggagcaaguccggcaccagcgccacgcugggcaucaccgggcuccagaccggcgacgaggccgacuacuacugcgggaccugggacacgucccugagcgccggcgggguguucggcuccggcaccaaggugaccguccug

SEQ ID NO: 10341 - RNA, 333 nt, Artificial Sequence
  derived and/or modified sequence opt1 from anti-HIV_048-094155_VR-Chain
cagagcgugcugacccagcccccguccgucagcgccgcccccggccagaaggugaccguguccugcagcggguccagcuccgacaucggcgagaacuacgucagcugguaccagcaguuccccgagacggcgcccaagcuccugaucuacgacaacaacaagcgcccguccgggauccccgaccgguucagcggcuccaagagcgggaccuccgccacccuggccaucaccggccuccagacgggcgacgaggccgacuacuacugcgggaccugggacagcucccugagcgccggcgggguguucggcaccgggaccaaggugacgguccug

SEQ ID NO: 10342 - RNA, 333 nt, Artificial Sequence
  derived and/or modified sequence opt1 from anti-HIV_048-093219_VR-Chain
cagccccugcucacccagccgcccgccgugagcgccacccccggccagcgcgucacgaucuccugcaccgggagcuccagcaacaucggccggaccuucgugaacugguaccagcagcugcccgggaccgcgccgaagcugcucaucuacgagaacuccaagcgccccagcggcauccccgaccgguucuccgggagcaaguccggcacgagcgccacccugggcaucaccgggcugcagaccggcgacgaggccgacuacuacugcgggacgugggacaccucccucagcgccggcgggguguucggcuccggcaccaaggucaccgugcug

SEQ ID NO: 10343 - RNA, 333 nt, Artificial Sequence
  derived and/or modified sequence opt1 from anti-HIV_048-092976_VR-Chain
cagagcgugcugacccagcccccguccgucagcgccgccuccggccagaaggugaccaucagcugcuccgggagcuccagcaacaucggcaacaacuacguguccugguaccagcaccuccccgggacggcgcccaagcugcugaucuacaagaacgacaagcgccccagcggcaucccggaccgguucuccgggagcaaguccggcaccagcgccacccucggcaucaccgggcugcagacgggcgacgaggccgacuacuacugcgggaccugggacaccucccugagcgccggcggggucuucggcaccggcacgaaggugaccgugcuc

SEQ ID NO: 10344 - RNA, 333 nt, Artificial Sequence
  derived and/or modified sequence opt1 from anti-HIV_048-090866_VR-Chain
cagagcgugcugacccagcccccguccgucagcgccgcccccggccagaaggugaccaucuccugcagcgggucccgcagcaacaucggcuccaacuacaucagcugguaccagcagcuccccgggacggcgcccaagcugcugaucuacgacaacaacaagcggccguccggcauccccgaccgcuucagcggguccaagagcggcaccuccgccacccucggcaucaccgggcugcagacgggcgacgaggccuacuacuacugcgggaccugggacaccagccuguccgccggcgggguguucggcagcggcaccaaggucacggugcuc

SEQ ID NO: 10345 - RNA, 333 nt, Artificial Sequence
  derived and/or modified sequence opt1 from anti-HIV_048-090650_VR-Chain
cagagcgcccugacccagcccgccuccgugagcggcucccucgggcagagcaucaccaucuccugcagcggcuccagcuccacgaucgggaacaacuacgucagcugguaccaggugcugccgggcgcggcccccaagcugcucaucugcaagaacaacgagcgccccuccgggauccccgaccgguucagcggcuccaagagcggcaccuccgccacccuggggaucaccggccugcagacgggggacgaggccgacuacuacugcggcaccugggacaccagccucuccgccgggggcguguucggcaccgggacgaaggucaccgugcug

SEQ ID NO: 10346 - RNA, 333 nt, Artificial Sequence
  derived and/or modified sequence opt1 from anti-HIV_048-089009_VR-Chain
cagagcgugcugacccagcccccguccgucagcgccgcccccggccagaaggugaccaucuccugcagcgggggcuccagcaacaucgggaacaacuacguguccugguaccagcagcuccccgagacggcgcccaagcugaucaucuacgacaacaacaagcgcccgagcggcauccacgaccgguucuccgggagcaaguccggcaccagcgccacccuggacaucaccgcccuccagacgggcgacgaggccgacuacuacugcgggaccugggacaccucccugagcgccggcggggucuucggcaccgggacgaaggugaccgugcug

SEQ ID NO: 10347 - RNA, 333 nt, Artificial Sequence
  derived and/or modified sequence opt1 from anti-HIV_048-088654_VR-Chain
cagagcgcccugacccagccccgcuccgugagcgccgcgccgggccagaaggucuccaucagcugcuccgggcggagcaccaaccucggcuacaacuacguguccugguaccagcaccuccccggggccgcccccaaggugcugaucuacgagaacaacaagcgccccagcggcaucccggaccgguucuccgggagcaaguccggcacgagcgccacccugggcaucaccgggcugcagaccggcgacgaggccgacuacuacugcgggacgugggacaccucccugagcgcgggcggggucuucggcuccggcaccaaggugaccgugcuc

SEQ ID NO: 10348 - RNA, 333 nt, Artificial Sequence
  derived and/or modified sequence opt1 from anti-HIV_048-086513_VR-Chain
cagagcgcccugacccagcccccguccgugagcgccgcgcccggccagaaggucaccaucuccugcagcggguccacgagcaacaucggcaacaacuacguguccugguaccagcagcuccccgggaccgcccccaagcugcugaucuacaagaacgacaaccgcccgagcggcauccccgaccgguucuccagcuccaagagcgggaccuccgccacccucggcaucacgggccugcagaccggggacgaggccgacuacuacugcggcaucugggacaccagccuguccgccgggggcguguucgggaccggcacgaaggucaccgugcuc

SEQ ID NO: 10349 - RNA, 324 nt, Artificial Sequence
  derived and/or modified sequence opt1 from anti-HIV_048-086024_VR-Chain
cuggcccagcccccgagcguguccggcacccccgggcagcgcgucaccaucagcugcuccggcagcuccagcaacaucggguccaacgccgugaacugguaccagcaguuccccggcacggcgcccaagcuccugaucuacgacaccgacaagcggccgagcgggauccccgaccgcuucuccggcagcaaguccggcaccagcgccauccuggggaucaccggccuccagacgggggacgaggccgacuacuacugcggcgccugggacaccucccugagcgccgggggcguguucggcaccgggaccaaggucacggugcug

SEQ ID NO: 10350 - RNA, 333 nt, Artificial Sequence
  derived and/or modified sequence opt1 from anti-HIV_048-085857_VR-Chain
cagagcgcccugacccagccccgcuccgugagcggcucccucgggcagagcgucaccaucuccugcacgggcaccaccagcgacgugggguucgacuacguguccugguaccagguccugccgggcaccgcccccaagcugcucaucuacaagaacgacaagcggcccagcgggauccccgaccgcuucuccggcagcaaguccggcacgagcgcgacccuggggaucaccggccugcagaccggggacgaggccgacuacuacugcggcacgugggacaccucccucagcaccgggggcguguucggcaccgggacgaaggugaccguccug

SEQ ID NO: 10351 - RNA, 333 nt, Artificial Sequence
  derived and/or modified sequence opt1 from anti-HIV_048-084277_VR-Chain
cagagcgugcugcgccagcccccgucccucagcggcgcccccgggcagcgggucacccuguccugcaccggcagcuccagcaacaucgggggcuacgacgugcacugguaccagcacgugcccgggacggcccccaagcugcucaucuacgagaacaccaagcgcccguccggcauccccgaccgguucagcggcuccaagagcgggaccuccgcgacccugggcaucacggggcugcagaccggcgacgaggccgacuacuacugcgggaccugggacaccagccucuccgccggcggcgucuucgggagcggcacgaaggugaccgugcug

SEQ ID NO: 10352 - RNA, 333 nt, Artificial Sequence
  derived and/or modified sequence opt1 from anti-HIV_048-084245_VR-Chain
cagagcacccugacccagcccccguccgugagcgccgcccccggccagaaggucacgaucuccugcagcggguccaacagcaacaucggcaagcacuacguguccugguaccagcaguuccccggggcggugcccaagcuccugaucuacgagaacaagaagcgcccgagcggcauccccgaccgguucuccgggagcaaguccgacaccagcgccacccuggacaucaccggccuccagacgggcgacgaggccgacuacuacugcgggaccugggacaccucccugagcgccggcggggucuucggcuccgggaccaaggugacggugcug

SEQ ID NO: 10353 - RNA, 333 nt, Artificial Sequence
  derived and/or modified sequence opt1 from anti-HIV_048-082487_VR-Chain
cagagccugcucacccagcccccguccgugagcgccgcccccggccagaaggucaccaucuccugcagcggguccagcuccacgaucggcaacaacuacgugagcugguaccaggugcugcccggggcggcccccaagcugcucaucugcaagaacaacgagcgcccguccggcauccccgaccgguucagcggguccaagagcggcaccuccgccacccugggcaucaccgggcugcagacgggcgacgaggccgacuacuacugcgggaccugggacaccagccucuccgccggcggggucuucggcagcggcaccaaggugacggugcug

SEQ ID NO: 10354 - RNA, 333 nt, Artificial Sequence
  derived and/or modified sequence opt1 from anti-HIV_048-081787_VR-Chain
cagagcgugcugacccagcccccguccgucagcggcgcccccgggcagcgcgugaccaucuccugcacgggcagcuccagcaacaucggguccuacgacgugcacugguaccagcagcuccccggcaccgcccccaagcugcugaucuacgagaacagcaagcggccguccgggauccccgaccgcuucagcggcuccaagagcggcaccuccgcgacccucgggaucacgggccugcagaccggggacgaggccgacuacuacugcggcaccugggacaccagccuguccgggggcggcgucuucgggacgggcaccaaggugaccgugcuc

SEQ ID NO: 10355 - RNA, 333 nt, Artificial Sequence
  derived and/or modified sequence opt1 from anti-HIV_048-081062_VR-Chain
cagagcgugcugacccagcccccguccgucagcgccgcccccggccagaaggugaccaucuccugcagcgggacguccagcaacaucggcgcgaacuacguguccugguaccagcagguccccgggaccgcccccaagcuccugaucuacgagaacaacaagcgcccgagcggcacccccgaccgguucuccgggagcaaguccggcaccagcgccacgcugggcaucaccgggcuccagaccggcgacgaggccgacuacuacugcgggaccugggacacgucccugagcgccggcgggguguucggcuccggcaccaaggugaccguccug

SEQ ID NO: 10356 - RNA, 333 nt, Artificial Sequence
  derived and/or modified sequence opt1 from anti-HIV_048-079639_VR-Chain
cagagcgugcugacccagcccccguccgucagcgccgcccccggccagaaggugaccaucuccugcagcggguccagcuccaacaucggcaagaacuacgugagcugguaccagcaccuccccgggacggcgcccaagcugcugaucuacgagaacaacaagcgcccguccggcauccccgaccgguucagcggguccaagagcggcaccgccgccacccucggcaucaccgggcugcagacgggcgacgaggccggguacuacugcggcaccugggacaccucccugagcgccgggggcgucuucggcaccgggacgaaggugaccgugcuc

SEQ ID NO: 10357 - RNA, 333 nt, Artificial Sequence
  derived and/or modified sequence opt1 from anti-HIV_048-079126_VR-Chain
cagagcgugcugacccagcccccguccgucagcgccgcccccggccagaaggugaccaucuccugcagcggguccagcuccaacaucggcaacaacuacgugagcugguaccagcaccuccccgggacgcccccgaagcugcugaucuucaagaacaacgagcgccccuccggcauccccgaccgguucagcggguccaagagcggcaccuccgcgacccucggcaucaccgggcugcagacgggcgacgaggccgacuacuacugcgggaccugggacaccagccuguccgccggcggggucuucggcaccggcacgaaggugaccgugcuc

SEQ ID NO: 10358 - RNA, 333 nt, Artificial Sequence
  derived and/or modified sequence opt1 from anti-HIV_048-073118_VR-Chain
cagagcgugcugacccagcccccguccgucagcgccgcgccccgccacaacgugaccaucuccugcagcggcggguccagcaacaucggcaacaacuucguguccugguaccaguaccuccccgggacggcccccaagcugcugaucuacgacaacaacaagcggccgagcggcauccccgaccgcuucuccgggagcaaguccggcaccagcgccacccucggcaucaccgggcugcagacgggcgacgaggccgacuacuacugcgccaccugggacaccucccugagcgccgggggcgucuucgggaccggcacgaaggugaccgugcuc

SEQ ID NO: 10359 - RNA, 333 nt, Artificial Sequence
  derived and/or modified sequence opt1 from anti-HIV_048-070264_VR-Chain
cagagcgugcugacccagucccccagcgucuccgccgccccgggccagaaggugaccaucagcugcuccgggacgagcuccaacaucggcaacaccuacgugagcugguaccagcagcuccccgggaccgcgcccaagcugcugaucuacaagaacgacaagcgccccuccggcaucccggaccgguucagcggguccaagagcggcaccuccgccacgcucggcaucaccgggcugcagaccggcgacgaggccgacuacuacugcgggaccugggacagcucccugagcgccggcggggucuucggcacgggcaccaaggugaccgugcuc

SEQ ID NO: 10360 - RNA, 333 nt, Artificial Sequence
  derived and/or modified sequence opt1 from anti-HIV_048-069426_VR-Chain
cagagcgugcugacccagcccccguccgucagcgccgcccccggccagaaggugaccaucuccugcagcggguccagcuccacgaucggcaacaacuacgugagcugguaccagcagcuccccgggaccgcgcccaagcugcugaucuacaagaacaacaagcgcccguccggcguccccgaccgguucagcggguccaagagcggcaccuccgccacccccggcaucacggggcuccagaccggcgacgaggccgacuacuacugcgggaccugggacaccagccuguccgccggcgggguguucggcacgggcaccaaggugaccguccug

SEQ ID NO: 10361 - RNA, 333 nt, Artificial Sequence
  derived and/or modified sequence opt1 from anti-HIV_048-068564_VR-Chain
cagagcgcccugacccagccccgcuccgugagcggcuccccggggcagagcgucgccaucuccugcaccggcacgagcuccgacgugggguacaacuacgugagcugguaccagguccuccccggcaccgcgcccaagcugcugaucuacaagaacaacgagcggcccuccgggaucccggaccgcuucagcggcuccaagagcggcaccuccgccacccucgggaucacgggccugcagaccggggacgaggccgacuacuacugcggcaccugggacaccagccuguccgccgggggcguguucggcacggggaccaaggugaccguccuc

SEQ ID NO: 10362 - RNA, 333 nt, Artificial Sequence
  derived and/or modified sequence opt1 from anti-HIV_048-068345_VR-Chain
cagagcgugcugacccagacccccuccgucagcgccgccccgggccagcgcgugacgaucuccugcagcggguccaccagcaacaucggcaacaacuacguguccugguaccagcagcuccccgggaccgcgcccaagcugcugaucuacgagaacaacaagcggcccagcggcauccgcgaccgguucuccgccagcaaguccgggaccagcgccacgcucggcaucaccggccugcagaccggggacgaggccgacuacuacugcggcaccugggacacgucccugagcgccgggggcgucuucgggaccggcaccaaggugaccgugcuc

SEQ ID NO: 10363 - RNA, 333 nt, Artificial Sequence
  derived and/or modified sequence opt1 from anti-HIV_048-067337_VR-Chain
cagagcgugcugacccagcccccguccgucagcgcggcccccggccagaaggugaccaucuccugcagcggggcguccuacaacaucggcaagaacagcguguccugguaccagcagcuccccgggacggcccccaagcugcugaucuacaagaacgacaagcgcccgagcggcauccccgaccgguucuccgggagcaaguccggcgccagcgccacccucgacaucaccggccugcagaccggggacgaggccgacuacuacugcggcaucugggacacgucccugagcgccgggggcgucuucgggaccggcaccaaggugaccgugcuc

SEQ ID NO: 10364 - RNA, 333 nt, Artificial Sequence
  derived and/or modified sequence opt1 from anti-HIV_048-067180_VR-Chain
cagagcgugcugacccagcccccguccgucagcgccgcccccggccagaaggugaccaucuccugcagcggguccagccccaacaucggcaacaacuacguguccugguaccagcgccuccccgggacggcgccgaagcugcugaucuacgagaacgaccagcggcccagcggcauccccgaccgcaucuccgggagcaaguccggcaccagcgccacccucggcaucaccgggcugcagacgggcgacgaggccgacuacuacugcgggaccugggacaccucccugagcaccggcggggucuucggcacgggcaccaaggugaccgugcuc

SEQ ID NO: 10365 - RNA, 333 nt, Artificial Sequence
  derived and/or modified sequence opt1 from anti-HIV_048-063017_VR-Chain
cagagcgugcugacccagcccccguccgucagcgccgcccccggccagaaggugaccaucuccugcagcggguccagcuccaacaucggcaacaacuacgugagcugguaccagcaccaccccgggaaggcgcccaagcucaugaucuacgaggucuccaagcgcccgagcggcauccccgaccgguucuccgggagcaaguccggcacgagcgccacccugggcaucaccgggcugcagaccggcgacgaggccgacuacuacugcgggacgugggacaccucccucaaccgcggcgggguguucggcaccggcaccaaggugacgguccug

SEQ ID NO: 10366 - RNA, 333 nt, Artificial Sequence
  derived and/or modified sequence opt1 from anti-HIV_048-061885_VR-Chain
cagagcgugcugacccagcccccguccgucagcgcggcccccggccagaaggugaccaucuccugcagcggguccagcuccaacaucggcagccacuacaucuccugguaccagcaguuccccggggcggcccccaagcuccugaucuacgagaacgacaagcgcccgagcggcauccccgaccgguucuccgccagcaaguccgggacgagcgccacccugggcaucaccggccuccagaccggggacgaggccgacuacuacugcggcacgugggacaccucccugagcgccgggggcguguucgggaccggcaccaaggucacggugcug

SEQ ID NO: 10367 - RNA, 333 nt, Artificial Sequence
  derived and/or modified sequence opt1 from anti-HIV_048-061671_VR-Chain
cagagcgugcugacccagcccccguccgccagcggcacccccgggcagcgcgucacgaucuccugcagcggcucccggagcaacaucggguccaacuacguguacugguaccagcaguuccccggcaccgcccccaagcuccugaucuacgagaacaacaagcgcccgagcgggauccccgaccgguucuccggcagcaaguccggcaccagcgcgacccuggggaucacgggccuccagaccggggacgaggccgacuacuacugcgccaccugggacaccucccugagcgccggcgggguguucggcacgggcaccaaggucaccgugcug

SEQ ID NO: 10368 - RNA, 333 nt, Artificial Sequence
  derived and/or modified sequence opt1 from anti-HIV_048-060700_VR-Chain
cagagcgugcugacccagcuccccucccugagcgccgccccgggccagaaggucaccaucuccugcagcggguccagcuccaacaucggcaacaacuacgugagcugguaccagcagcugcccgggacggcgcccaagcuccugaucuacgagaacaacaagcgccccuccggcaucccggaccgguucagcggguccaagagcggcaccuccgccacccugggcaucaccgggcuccagacgggcgacgaggccgaguacuacugcgccaccugggacgccagccuguccgggggcgggguguucggcaccggcaccaaggucacggugcug

SEQ ID NO: 10369 - RNA, 333 nt, Artificial Sequence
  derived and/or modified sequence opt1 from anti-HIV_048-060592_VR-Chain
cagagcgugcugacccagcccccguccgucagcgcggcccccggccagaaggugaccaucuccugcagcggguccagcuccaacaucggcaagaacuacgugagcugguaccagcaguuccccgggacggcgcccaagcuccugaucuacgagaacaacaagcgcccguccggcauccccgaccgguucagcgccuccaagagcgccaccuccgccacccuggucaucaccgggcuccagacgggcgacgaggccguguacuacugcggcaccugggacaccagccuguccgccgggggcguguucgggagcggcaccaaggucacggugcug

SEQ ID NO: 10370 - RNA, 333 nt, Artificial Sequence
  derived and/or modified sequence opt1 from anti-HIV_048-060300_VR-Chain
cagcccgugcugacccagccgcccagcgccuccggcacccccgggcagcgcgucacgaucagcugcuccggcagcuccagcaacaucgggaccaacaccgugaacugguaccagcaguuccccggcaccgccccgaagcuccugaucuacaagaacaacgagcggcccuccgggauccccgaccgcuucagcggcuccaagagcggcacguccgcgacccuggggaucaccggccuccagaccggggacgaggccgacuacuacugcggcacgugggacaccagccuguccgggggcggcguguucgggaccggcaccaaggucacggugcug

SEQ ID NO: 10371 - RNA, 333 nt, Artificial Sequence
  derived and/or modified sequence opt1 from anti-HIV_048-059141_VR-Chain
cagcccgugcugacccagccgcccagcgccuccggcacccccgggcagcgcgucagcaucuccugcagcggcaacuucuccaacaucgggagcaaguacguguacugguaccagcagauccccggcacggccccgaacgugaucaucuaccggaccaaccuccgccccuccgggauccccgaccgguucagcgcguccaagagcggcaccuccgccacccugggcaucacggggcugcagaccggcgacgaggccgacuacuacugcgggaccugggacaccagccucuccgccggcggggucuucggcacgggcaccaaggugaccgugcug

SEQ ID NO: 10372 - RNA, 333 nt, Artificial Sequence
  derived and/or modified sequence opt1 from anti-HIV_048-057777_VR-Chain
cagagcgugcugacccagcccccgucccucagcgcggcccccggccagcgcgucaccaucuccugcagcggguccagcuccaacaucggcaacaacuacgugagcugguaccagcaguuccccgggacggcgcccacccugcugaucuacgagaacgacaagcggccguccggcauccccgaccgcuucagcgccuccaagagcgggaccuccgccacccucggcaucacgggccugcaggccggggacgaggccgacuacuacugcggcaccugggacaccagccuguccgccgggggcguguucgggaccggcacgaaggucaccgugcuc

SEQ ID NO: 10373 - RNA, 333 nt, Artificial Sequence
  derived and/or modified sequence opt1 from anti-HIV_048-056928_VR-Chain
cagagcgugcugacccagcccccguccgucagcgccgcccccggccagaaggugaccaucuccugcagcggguccagcuccacgaucggcaacaacuacgugagcugguaccagcuccugcccgggaccgcgcccaagcugcucaucuacgacaacgacaaccgcccguccgacauccccgaccgguucagcggcuccaagagcgggaccuccgccacccugggcaucacgggccugcagaccggggacgaggccgacuacuacugcggcgccugggacaccagccucuccgccgggggcgucuucgggaccggcacgaaggugaccgugcug

SEQ ID NO: 10374 - RNA, 333 nt, Artificial Sequence
  derived and/or modified sequence opt1 from anti-HIV_048-056131_VR-Chain
caguucgugcugacccagcccgccagcgucuccggcagcccggggcaguccaucaccaucagcugcuccggcacgagcuccgacgugggguacaacuacgugagcugguaccagcagcuccccggcaccgcccccaagcugcugaucuacgagaacaccaagcgccccuccgggaucccggaccgguucagcggcuccaagagcggcaccuccgcgacgcucgggaucaccggccugcagaccggggacgaggccgacuacuacugcggcaccugggacacgagccuguccgccgggggcgucuucggcagcgggaccaaggugaccgugcuc

SEQ ID NO: 10375 - RNA, 333 nt, Artificial Sequence
  derived and/or modified sequence opt1 from anti-HIV_048-055864_VR-Chain
cagagcgugcugacccagcccccguccgucagcguggcccccggccagaaggugaccaucuacugcuccgggagcuccagcaacaucggcaagaacuccgucagcugguacguccaggugcccgggacggcccccaaguuccucaucuacgagaacaaccagcgcccguccggcaucagcgaccgguucuccgggagcaaguccggcaccagcgcgacccugggcaucuccgggcugcagaccggcgacgaggccgacuacuacugcgggacgugggacaccagccucuccggcgggggcguguucggcaccgggaccaaggugacggugcug

SEQ ID NO: 10376 - RNA, 333 nt, Artificial Sequence
  derived and/or modified sequence opt1 from anti-HIV_048-055094_VR-Chain
cagagcgugcugacccagcccccguccgucagcggcgcccccgggcagcgcgugaccaucuccugcagcgccuccagcuccagcaucggcaacgacuucguguccugguaccagcagcuccccgggacggcgcccaagcugcugaucagcgagaacaacaagcggccguccggcauccccgaccgcuucagcggguccaagagcggcaccuccgccacccucggcaucaccgggcugcagacgggcgacgaggccgacuacuacugcgggaccugggacagcucccugagcgccggcggggucuucggcaccggcaccaaggugacggugcuc

SEQ ID NO: 10377 - RNA, 333 nt, Artificial Sequence
  derived and/or modified sequence opt1 from anti-HIV_048-054343_VR-Chain
cagagcgugcugacccagcccccguccgucagcggcgcccccgggcagcgcgugaccaucuccugcacgggcagcuccagcaacaucgggggcuacgacgugaacugguaccagcagcuccccgggaccgcccccaagcugcugaucuucaagaacaacgagcggccguccggcauccccgaccgcuucagcggcuccaagagcgggaccuccgcgacccucggcaucacggggcugcagaccggcgacgaggccgacuacuacugcgggaccugggacaccagccuguccgccggcggcgucuucgggacgggcaccaaggugaccgugcuc

SEQ ID NO: 10378 - RNA, 333 nt, Artificial Sequence
  derived and/or modified sequence opt1 from anti-HIV_048-054193_VR-Chain
cagagcgugcugacccagcccccguccgucagcgccgcccccggccagaaggugaccaucuccugcagcgggggcuccagcaacaucgggaacaacuacguguccugguaccaccagguccccggcacggcgcccaagcuccugaucuucgagaacaacaagcgcccgagcgggauccccgaccgguucuccggcagcaaguccggcaccagcgccacccuggggaucaccggccuccagacgggggacgaggccgacuacuacugcggcaccugggacaccucccugagcgggggcggcguguucgggaccggcacgaaggugaccguccug

SEQ ID NO: 10379 - RNA, 333 nt, Artificial Sequence
  derived and/or modified sequence opt1 from anti-HIV_048-052521_VR-Chain
cagagcgugcugacccagcccccguccgucagcgccgcccccggccagaaggugaccaucuccugcagcggguccagcuccaacaucggccgccacagcguguccugguaccagcagcuccccgggacggcgcccaagcugcugaucuacgacaccgacaagcggccgagcggcauccccgaccgcuucuccgggagcaaguccggcaccagcgccacccucggcaucacggggcugcagaccggcgacgaggccgacuacuacugcgggaccugggacaccucccugagcggcgggggcgucuucggcacggggaccaaggugaccgugcuc

SEQ ID NO: 10380 - RNA, 333 nt, Artificial Sequence
  derived and/or modified sequence opt1 from anti-HIV_048-049037_VR-Chain
cagagcgugcugacccagcccccguccgucagcgcggcccccggccagaaggugaccaucuccugcagcggguccagcuucaacaucggcaacaacuacguguccugguaccagcaccuccccgggacggcgcccaagcugcugaucuacgccgccgucacccgcccgagcggcauccccgaccgguucuccgggagcaaguccggcaccagcgccacccucgacaucacgggccugcagaccggggacgaggccgacuacuacugcggcaccugggacaccucccugagcgccgggggcguguucgggacgggcaccaaggugaccguccuc

SEQ ID NO: 10381 - RNA, 333 nt, Artificial Sequence
  derived and/or modified sequence opt1 from anti-HIV_048-048720_VR-Chain
cagagcgugcugacccagcccccggccgucuccgccgcccccggccagcgcguggccaucagcugcuccgggaccagcuccaacaucggcagcaaccucguguccugguaccagcagcugcccgggaaggcgccccggcugcucaucuacgacaacuacaagcgcccgagcggcauccccgaccgguucuccgggagcaaguccggcacgagcgccacccugggcaucaccgggcugcagaccggcgacgaggccgacuacuacugcgggacgugggacaccucccucagcaccggcggggucuucggcaccggcacgaaggugaccgugcug

SEQ ID NO: 10382 - RNA, 333 nt, Artificial Sequence
  derived and/or modified sequence opt1 from anti-HIV_048-048542_VR-Chain
cagagcgugcugacccagcccccguccgucagcgcggcccccggccagaaggugaccaucuccugcagcggguccagcuccaacaucggcaacaacuucgugagcugguaccagcagcuccccgggacggcgcccaagcugcugaucuacaacaacgaccgccggccguccggcguccccgaccgcuucagcgccuccaaguucgggaccgccgccacccucggcaucaccggccugcagacgggggacgaggccgacuacuacugcggcaccugggacagcucccugagcgccgggggcguguucgggaccggcaccaaggugacgguccuc

SEQ ID NO: 10383 - RNA, 333 nt, Artificial Sequence
  derived and/or modified sequence opt1 from anti-HIV_048-047777_VR-Chain
cagagcgugcugacccagcccccguccgccagcggcacccccgggcagcgcgucacgaucuccugcagcggcuccagcgccaacaucgggaccaacuacguguucugguaccagcaccuccccggcaccgcgcccaagcugcugaucuacgagaacaacaagcggccguccgggauccccgaccgcuucagcggcuccaagagcggcaccuccgccacgcucgggaucaccggccugcagaccggggacgaggccgacuacuacugcggcaccugggacagcucccugagcgccgggggcguguucggcacggggaccaaggucaccgugcuc

SEQ ID NO: 10384 - RNA, 333 nt, Artificial Sequence
  derived and/or modified sequence opt1 from anti-HIV_048-046841_VR-Chain
cagagcgugcugacccagcccccguccgucagcgcggcccucggccagaaggugaccaucacgugcuccggggacaacggcaacaucggguaccacuacgugagcugguaccagcaggucggccgcgcggcccccaagcugcugaucuacgccaacaacaagcggcccuccgggauccccgaccgcuucagcggcuccaagagcggcaccuccgccacccucgggaucaccggccugcagacgggggacgaggccgacuacuacugcggcaccugggacaccagccuguccgccgggggcguguucggcagcgggaccaaggugacgguccuc

SEQ ID NO: 10385 - RNA, 333 nt, Artificial Sequence
  derived and/or modified sequence opt1 from anti-HIV_048-046202_VR-Chain
cagagcgugcugacccagcccccguccgucagcgccgcccccggccagaaggugaccaucuccugcagcggguccagcuccaacaucggcaacaacuacgugagcugguaccagcaccuccccgggacggcgcccaagcugcugaucuacgacaccuacaagcgccacuccggcgucccggaccgguucagcaacuccaagagcgggaccuccgccacccucgccaucacgggccugcagaccggcgacgagggggacuacuacugcggcgccugggacaccagccuguccgccgggggcguguucgggaccggcacgaaggugaccguccuc

SEQ ID NO: 10386 - RNA, 333 nt, Artificial Sequence
  derived and/or modified sequence opt1 from anti-HIV_048-046059_VR-Chain
cagagcgugcugacccagcccccguccgucagcgccgcccccggccagaacgugaccaucuccugcagcgggacguccagcaacaucgagaacaacuacguguccugguaccagacccuccccggcaccgcgcccaagcugcugaucuacgacaacaacaagcgcccgagcgggauccccgaccgguucuccggcagcaaguccgggaccagcgccacgcucggcaucaccggccugcagaccggggacgaggccgacuacuacugcggcaccugggacuccagccuguccgccgggggcgucuucgggacgggcaccaaggugaccgugcuc

SEQ ID NO: 10387 - RNA, 333 nt, Artificial Sequence
  derived and/or modified sequence opt1 from anti-HIV_048-043568_VR-Chain
cagagcgugcugacccagcccccguccgucagcgccgcccccggccagaaggugaccaucuccugcagcggguccgacagcaacaucggcuccaacuacgugagcugguaccagcagcuccccggggcggcccccaagcugcugaucuacaagaacaacaaccgcccguccggcauccccgaccgguucagcggguccaagagcggcacguccgccacccucggcaucagcgggcugcagaccggcgacgaggccgacuacuacugcgggaccugggacacgucccugagcggcgggggcgucuucggcaccgggaccaaggugaccgugcuc

SEQ ID NO: 10388 - RNA, 333 nt, Artificial Sequence
  derived and/or modified sequence opt1 from anti-HIV_048-042713_VR-Chain
cagagcgugcugacccagcccccguccgucagcgccgcccccggccagaaggugaccaucuccugcagcggguccagcuccaacaucggccgccacuacgugagcugguaccagcagcuccccgggacggcgcccaagcugcugaucuacgacaacaacucccggccgagcggcauccccgaccgcuucuccgggagcaaguccggcaccagcgccacccucggcaucaccgggcugcagacgggcgacgaggccgacuacuacugcgggaccugggacaccucccugaaccggggcggggucuucggcaccggcacgaaggugaccgugcuc

SEQ ID NO: 10389 - RNA, 333 nt, Artificial Sequence
  derived and/or modified sequence opt1 from anti-HIV_048-042440_VR-Chain
cagagcgugcugacccagcccccguccgccagcggcacccccgggcagcgcgucacgaucuccugcagcggcuccagcuccaacaucgggaccaacaccgugaacugguaccagcagcuccccggcaccgcccccaagcugcugaucuacgagaacagcaagcggccguccgggauccccgaccgcuucagcggcuccaagagcggcacguccgcgacccucgggaucaccggccugcagaccggggacgaggccgacuacuacugcggcacgugggacaccagccuguccgccgggggcguguucggcagcgggaccaaggucaccgugcuc

SEQ ID NO: 10390 - RNA, 333 nt, Artificial Sequence
  derived and/or modified sequence opt1 from anti-HIV_048-040511_VR-Chain
cagagcgugcugacccagcccccguccgucagcgccgcccccggccagaaggugaccaucuccugcagcggguccagcuccaacaucggcaacaacuacgugagcugguaccagcaccuccccgggacggcgcccaagcugcugaucuacgagaacaacaagcgcuccagcggcaucccggagcgguucuccgggagccaguccggcaccagcgccacccucggcaucaccgggcugcagacgggcgacgaggccgacuacuacugcgggaccugggacaccucccugagcaccggcggggucuucggcacgggcaccaaggugaccgugcuc

SEQ ID NO: 10391 - RNA, 333 nt, Artificial Sequence
  derived and/or modified sequence opt1 from anti-HIV_048-039195_VR-Chain
cagagcgugcugacccagcccccguccgucagcgccgcccccggccagcgcgugaccaucuccugcagcggguccacgagcaacaucggcaaccacuacguguccugguaccagcagcuccccgggaccgcgcccaagcugcugaucuacgacaacggcaaccggccgagcgggauccccgaccgcuucuccggcagcaaguccggcaccagcgccacccucgacaucacggggcugcagaccggcgacgaggccgacuacuacugcgggaccugggacaccucccugaaccggggcggggucuucggcacgggcaccaaggugaccgugcuc

SEQ ID NO: 10392 - RNA, 333 nt, Artificial Sequence
  derived and/or modified sequence opt1 from anti-HIV_048-036935_VR-Chain
cagagcgugcugacccagcccccguccaugagcgccgcccccggcgagcgcgucaccaucuccugcacggggagcuccagcaacaucggcggguacgacgugcacugguaccagcagcuccccggcaucgcgcccaagauccugaucuaccggaacuccauccgcccgagcgggauccccgaccgguucuccggcagcaaguccggcaccagcgccacccuggggaucaccggccuccagacgggggacgaggccgacuacuacugcggcaccugggacaccucccugagcaccgggggcguguucggcacggggaccaaggucaccgugcug

SEQ ID NO: 10393 - RNA, 333 nt, Artificial Sequence
  derived and/or modified sequence opt1 from anti-HIV_048-034478_VR-Chain
cagagcgugcugacccagcccccguccgucagcgccgcccccggccagaaggugaccaucuccugcacggggagcggcuccaacaucgggaacaacgacgugagcugguaccagcagcuccccggcaccgcgccccgccugcugaucuacggggacaacaagcggccguccggcauccccgaccgcuucagcggcuccaagagcgggaccuccgccacccucggcaucacggggcugcagaccggcgacgaggccgacuacuacugcgggaccugggacaccagccuguccgccggcggcgucuucgggacgggcaccaaggugaccgugcuc

SEQ ID NO: 10394 - RNA, 333 nt, Artificial Sequence
  derived and/or modified sequence opt1 from anti-HIV_048-031641_VR-Chain
cagagcgugcugacccagcccccguccgucagcgccgcccccggccagaaggugaccaucuccugcagcgggaacaacuccaacaucggcaacaacuacgugagcugguaccagcagcuccccgggacggcgcccaagcugcugaucuacgagaacuccaagcgcccgagcggcauccccgaccgguucuccgggagcaaguccggcaccagcgccacccucggcaucaccgggcugcagacgggcgacgaggccgacuacuacugcgggaccugggacaccucccugagcgccggcggggucuucggcuccggcaccaaggugacggugcuc

SEQ ID NO: 10395 - RNA, 333 nt, Artificial Sequence
  derived and/or modified sequence opt1 from anti-HIV_048-029760_VR-Chain
cagagcgcccugacccagcccgccuccgugagcggcuccagcgggcaguccaucaccaucagcugcacgggcaccaacuccgacgucggguacgacuacgugugcugguaccagcagcucccgggcaccgcgcccaagcugcugaucuacgagaacaacaagcgccccagcgggauccccgaccgguucuccggcagcaaguccggcaccagcgccacgcucgggaucaccggccugcagaccggggacgaggccgacuacuacugcggcaccugggacacgucccugagcgccgggggcguguucggcaccgggaccaaggucaccgugcuc

SEQ ID NO: 10396 - RNA, 333 nt, Artificial Sequence
  derived and/or modified sequence opt1 from anti-HIV_048-027970_VR-Chain
cagagcgugcugacccagcccccguccgucagcgccccgcccggccagaaggugaccaucuccugcagcgggacgaccuccaacaucggcagcaacuacguggccugguaccagcaguuccccgggaccgcgcccaagcuccugaucuacgagaacaacaagcgccccuccggcauccccgaccgguucagcggguccaagagcggcaccuccgccacgcugggcaucaccgggcuccagaccggcgacgaggccgacuacuacugcgccaccugggacacgagccuguccgccgggggcgucuucgggaccggcaccaaggugaccgugcug

SEQ ID NO: 10397 - RNA, 333 nt, Artificial Sequence
  derived and/or modified sequence opt1 from anti-HIV_048-027337_VR-Chain
cagagcgugcugacccagcccccguccgucagcgccgcccccggccagaaggugaccaucuccugcagcggguccuacagcaacaucggcaacaacuaccucuccugguaccagcagcugcccgggacggcgcccaagcugcucaucuacaagaacaacaagcgcccgagcggcgugcccgaccgguucuccgggagcaaguccggcgccagcgccacccuggacaucaccggccugcagaccggggacgaggccgacuacuacugcggcaucugggacacgucccucagcgccgggggcgucuucgggaccggcaccaaggugaccgugcug

SEQ ID NO: 10398 - RNA, 333 nt, Artificial Sequence
  derived and/or modified sequence opt1 from anti-HIV_048-027217_VR-Chain
cagagcgugcugacccagcccccguccgucagcgccgcccccggccagaaggugaccaucuccugcagcggguccagcuccaucaucggcaacaacuacgugagcugguaccagcagcuccccgggacggcgcccaagcugcugaucuacgagaacaacaagcgcccguccggcauccccgaccgguucagcggguccaagagcggcaccuccgccacccucgccaucgccggccugcagaccggggacgaggccgacuacuacugcgcgacgugggacaccagccuguccgccggcggggucuucggcaccgggaccaaggugacggugcuc

SEQ ID NO: 10399 - RNA, 333 nt, Artificial Sequence
  derived and/or modified sequence opt1 from anti-HIV_048-026760_VR-Chain
cagagcgugcugacccagcccccguccgucagcgccgcccccggccagaaggugaccaucuccugcagcggguccagcuccaacaucggcaacaacuacgugagcugguaccagcaccuccccgggacggcgcccaagcugcugaucuacgacaccgucaagcgccacuccggcgugccggaccgguucagcggguccaagagcggcaccuccgccacccucggcaucagcgggcugcagacgggcgacgaggccgacuacuacugcgggaccugggacaccucccugagcgccggcgggguguucggcuccggcaccaaggucacggugcuc

SEQ ID NO: 10400 - RNA, 333 nt, Artificial Sequence
  derived and/or modified sequence opt1 from anti-HIV_048-024800_VR-Chain
cagagcgugcugacccagcccccguccgucagcgccgcccccggccagaaggugaccaucuccugcagcggguccuacagcaacaucggcaacaacuacguguccugguaccagguccuccccgggacggcgcccaagcugcugaucuacaagaacaacgagcgcccgagcggcauccccgaccgguucuccgggagcaaguccggcaccagcgccacccucggcaucaccgggcugcagacgggcgacgaggccgacuacuacugcgggaccugggacaccucccugagcgccggcgggguguucggcaccggcacgaaggugaccguccuc

SEQ ID NO: 10401 - RNA, 333 nt, Artificial Sequence
  derived and/or modified sequence opt1 from anti-HIV_048-024313_VR-Chain
cagagcgugcugacccagcccccguccgucagcgccgcccccggccagaaggugaccaucuccugcagcggguccagcuccacgaucggcaacagccacguguccugguaccagauccuccccgggaccgcgcccaagcugcugaucuacaaggacgacaagcgcccgagcggcauccccgaccgguucuccgggagcaaguccggcaccagcgccacccucggcaucacggggcugcagaccggcgacgaggccgacuacuacugcgggaccugggacaccucccugaaccgcggcggggucuucggcacgggcaccaaggugaccgugcuc

SEQ ID NO: 10402 - RNA, 333 nt, Artificial Sequence
  derived and/or modified sequence opt1 from anti-HIV_048-021748_VR-Chain
cagagcgugcugacccagcccccguccgucagcgccgcccccggccagcgcgugaccaucuccugcagcggguccacgagcaacaucggcaacaacuacguguccugguaccagcagcuccccgggaccgcgcccaagcugcugaucuacgagaacaacaagcggccgagcggcauccccgaccgcuucuccgggagcaaguccggcaccagcgccacccucggcaucuccgggcugcagacgggcgacgaggccgacuacuacugcgggaccugggacagcucccugagcggcgggggcgucuucggcaccgggaccaaggugacggugcuc

SEQ ID NO: 10403 - RNA, 333 nt, Artificial Sequence
  derived and/or modified sequence opt1 from anti-HIV_048-020991_VR-Chain
cagagcgugcugacccagcccccguccgccagcggcacccccgggcagaaggucacgaucuccugcagcggcuccagcuccaccaucgggaacaacuacgugagcugguaccaggugcuccccggcaccgcccccaagcugcugaucuacaagaacgacaagcgcccguccgggauccccgaccgguucagcggcuccaagagcggcaccuccgcgacgcucgggaucaccggccugcagaccggggacgaggccgacuacuacugcggcaccugggacacgagccuguccaccgggggcgucuucggcaccgggaccaaggugacggugcuc

SEQ ID NO: 10404 - RNA, 333 nt, Artificial Sequence
  derived and/or modified sequence opt1 from anti-HIV_048-020340_VR-Chain
cagagcgugcugacccagcccccguccgucagcgccgcccccggccagcgcgugaccaucuccugcagcggguccagcuccaacgugggcaacaacuacgucagcugguaccagcagcuccccgggacggcgcccaagcugcugaucuacgagaacaacaagcggccguccggcauccccgaccgcuucagcggguccaagagcggcaccuccgccacccucggcaucaccgggcugcagacgggcgacgaggccgacuacuacugcgggaccugggacgccagccuguccgccggcgggguguucggcaccggcaccaaggugacgguccuc

SEQ ID NO: 10405 - RNA, 333 nt, Artificial Sequence
  derived and/or modified sequence opt1 from anti-HIV_048-019993_VR-Chain
cagagcgugcugacccagcccccguccgucagcggcgcccccgggcagcgcgugaccaucuccugcacgggcagcuccagcuccaucgggggcuucgacgugcacugguaccagcggcuccccgggaccgcgccccgccugcugaucuacgagaacaacaagcggccgagcggcauccccgaccgcuucuccggcagcaaguccgggaccagcgccacccucggcaucacggggcugcagaccggcgacgaggccgacuacuacugcgggaccugggacuccagccuguccgccggcggcgucuucgggaccggcacgaaggugaccgugcuc

SEQ ID NO: 10406 - RNA, 333 nt, Artificial Sequence
  derived and/or modified sequence opt1 from anti-HIV_048-019947_VR-Chain
cagagcgugcugacccagcccccguccgucagcgccgcccccggccagcgcgugaccaucuccugcagcggguccagcuccaacaucggcagcaaguacguguccugguaccagcagcuccccgggacggcgcccaagcugcugaucuacgagaacagcaagcggccguccggcauccccgaccgcuucagcggguccaagagcggcaccuccgccacccucggcaucaccgggcugcagacgggcgacgaggccgacuacuacugcgggaccugggacaccagccuguccaccggcggggucuucggcacgggcaccaaggugaccgugcuc

SEQ ID NO: 10407 - RNA, 333 nt, Artificial Sequence
  derived and/or modified sequence opt1 from anti-HIV_048-017871_VR-Chain
cagagcgugcugacccagcccccguccgucagcgccgcccccggccagaaggugaccaucuccugcagcggguccagcuccaacaucggcaaccgcuacgugagcugguaccagcagcuccccgggacggcgcccaagcugcugaucuacaagaacaacaagcggccguccggcauccccgaccgcuucagcggguccaagagcggcaccuccgccacccucggcaucaccgggcugcagacgggcgacgaggccgacuacuacugcgggaccugggacggcagccuguccaccgggggcgucaucggcaccgggacgaaggugaccgugcuc

SEQ ID NO: 10408 - RNA, 333 nt, Artificial Sequence
  derived and/or modified sequence opt1 from anti-HIV_048-015931_VR-Chain
cagagcgugcugacccagcccccguccgucagcgccgcccccggccagaaggugaccaucuccugcagcgggggcuccagcaacaucggguccacguacgugagcugguaccagcagguccccggcaccgcgcccaagcuccugaucuacgagaacaacaagcgcccguccgggauccccgaccgguucagcggcuccaagagcggcaccuccgccacccuggacaucacggggcuccagaccggcgacgaggccgacuacuacugcgggaccugggacaccagccuguccggcgggggcguguucggcacggggaccaaggugaccguccug

SEQ ID NO: 10409 - RNA, 333 nt, Artificial Sequence
  derived and/or modified sequence opt1 from anti-HIV_048-015920_VR-Chain
cagagccugcucacccagcccccguccgugagcgccgcccccggccagaaggucaccaucuccugcagcggguccagcuccacgaucggcaacaacuacgugagcugguaccaggugcugcccgggaccgcgcccaagcugcucaucuacaagaacaacgagcgcccguccggcauccccgaccgguucagcggguccaagagcggcaccuccgccacccugggcaucacggggcugcagaccggcgacgaggccgaguacuacugcgccaccugggacgccagccucuccgggggcggggucuucggcaccggcacgaaggugaccgugcug

SEQ ID NO: 10410 - RNA, 333 nt, Artificial Sequence
  derived and/or modified sequence opt1 from anti-HIV_048-013898_VR-Chain
cagagcgugcugacccagcccccguccgucagcgccgcccccggccagaaggugaccaucuccugcagcggguccagcuccaacaucggcaagcacagcguguccugguaccagcagcuccccgggacggcgcccgagcugcugaucuacgacaacaacaaccgcccgagcggcauccccgaccgguucuccgggagcaaguccggcaccagcgccacccucggcaucaccgggcugcagacgggcgacgaggccgacuacuacugcgggaccugggacaccucccugagcgccggcggggucuucggcaccggcacgaaggugaccgugcuc

SEQ ID NO: 10411 - RNA, 333 nt, Artificial Sequence
  derived and/or modified sequence opt1 from anti-HIV_048-013429_VR-Chain
cagagcgugcugacccagcccccguccgucagcgccgcccccggccagaaggugaccaucuccugcagcggguccagcuccaacaucggcaacaacuacgugagcugguaccagcagcuccccgggacggcgcccacccugcugaucuacgagaacgacaagcgcccguccggcauccccgaccgguucagcggguccaagagcggcaccuccgccacccucggcaucacggggcugcagaccggcgacgaggccgacuacuacugcgggaccugggacagcucccugagcgccggcggggucuucggcaccggcacgaaggugaccgugcuc

SEQ ID NO: 10412 - RNA, 333 nt, Artificial Sequence
  derived and/or modified sequence opt1 from anti-HIV_048-012358_VR-Chain
cagagcgugcugacccagcccccguccgucagcgccgcccccggccagaaggugaccaucuccugcagcggguccaacagcgcgaucggcaacaacuacguguccugguaccagguccuccccgggacggcccccaagcugcugaucuacaagaacaacgagcgcccgagcggcauccccgaccgguucuccgggagcaaguccggcaccagcgccacccucgacaucaccggccugcagacgggggacgaggccgacuacuacugcggcaccugggacaccucccugagcgccgggggcguguucgggaccggcacgaaggugaccguccuc

SEQ ID NO: 10413 - RNA, 333 nt, Artificial Sequence
  derived and/or modified sequence opt1 from anti-HIV_048-011158_VR-Chain
cagagcgugcugacccagcccccguccgucagcgccgcccccggccagaaggugaccaucuccugcagcgggaucuccagcaacaucggcaacaacgacguguccugguaccagcagcuccccgggacggcgcccaagcugcugaucuacgacaacgacaagcgcccgagcggcauccccgaccgguucuccgggagcaaguccggcaccagcgccacccucggcaucaccgggcugcagacgggcgacgaggccgacuacuacugcgggaccugggacuccagccuguccgccggcggggucuucggcaccggcaccaaggugacggugcuc

SEQ ID NO: 10414 - RNA, 333 nt, Artificial Sequence
  derived and/or modified sequence opt1 from anti-HIV_048-010720_VR-Chain
cagagcgugcugacccagcccccguccgucagcgccgcccccggccagaaggugaccaucuccugcagcggguccagcuccaacaucggcagccacuacguguccugguaccagcagguccccgggacggcgccccgccucgugaucuacgagaacagcaagcggccguccggcauccccgaccgcuucagcggguccaagagcggcaccuccgccacccugggcaucaccgggcugcagacgggcgacgaggccgacuacuacugcgggaccugggacaccagccucuccgccggcgggguguucggcagcggcaccaaggucacggugcug

SEQ ID NO: 10415 - RNA, 333 nt, Artificial Sequence
  derived and/or modified sequence opt1 from anti-HIV_048-009445_VR-Chain
cagagcgugcugacccagcccccguccgucagcgccgcccccggccagaaggugaccaucuccugcagcggguccagcuccaacaucggcaacaacuacgugagcugguaccagcagcuccccgggacgguccccaagcugcugaucuacgacaccuacacccgcccguccggcacccccgaccgguucagcggguccaagagcggcacguccgcgacccucgccaucaccggccugcagaccggggacgaggccgacuacuacugcggcacgugggacgggagccuguccaccggcggggugaucggcaccggcaccaaggugacgguccuc

SEQ ID NO: 10416 - RNA, 324 nt, Artificial Sequence
  derived and/or modified sequence opt1 from anti-HIV_048-006126_VR-Chain
cagagcgugcugacccagcccccguccgucagcggcgcccccgggcagaaggugaccaucuccugcagcggcaucuccagcaacuucgggaucuccugguaccagcagguccccggcacggcccccaagcuccugaucuacgagaacgacaagcgcccgagcgggauccccgaccgguucuccggcagcaaguccggcaccagcgcgacccuggggaucaccggccuccagacgggggacgaggccgacuacuacugcggcaccugggacaccucccugagcgccgggggcguguucggcaccgggacgaaggugaccgugcug

SEQ ID NO: 10417 - RNA, 333 nt, Artificial Sequence
  derived and/or modified sequence opt1 from anti-HIV_048-005652_VR-Chain
cagagcgugcugacccagcccccguccgucagcgccgcccccggccagaaggugaccaucuccugcagcggguccaacagcgcgaucggcaacaacuacguguccugguaccagguccuccccgggacggcccccaagcugcugaucuacgacaccuacaagcgcgccagcggcaucccggaccgguucuccgggagcaaguccggcaccagcgccacccucggcaucacggggcugcagaccggcgacgaggccgacuacuacugcgggaccugggacaccucccugagcggcgggggcguguucggcacggggaccaaggugaccguccuc

SEQ ID NO: 10418 - RNA, 333 nt, Artificial Sequence
  derived and/or modified sequence opt1 from anti-HIV_048-005532_VR-Chain
cagagcgugcugacccagcccccguccgucagcgccgcccccggccagaaggugaccaucuccugcagcgggacguccagcaacaucggcaacaccuacguguccugguaccagcagcuccccgggaccgcgcccaacuaccugaucuacaagaucgacaagcgcccgagcggcauccccgaccgguucuccgggagcaaguccggcaccagcgccacgcugggcaucaccgggcuccagaccggcgacgaggccgacuacuacugcgggaccugggacacgucccugagcgccggcggggucuucggcaccggcaccaaggugaccgugcug

SEQ ID NO: 10419 - RNA, 333 nt, Artificial Sequence
  derived and/or modified sequence opt1 from anti-HIV_048-005189_VR-Chain
cagagcgugcugacccagcccccguccgucagcgccgcccccggccagaaggugaccaucuccugcagcggguccggcagcacgaucgggaacaacgacguguccugguaccagcagcuccccggcgcggcccccaagcugcugaucuacgaggacaacaagcgcccgagcgggauccccgcccgguucuccggcagcaaguccggcaccagcgccacccuccgcaucaccgggcugcagacgggcgacgaggccgacuacuacugcgggaccugggacuccagccuguccgcgggcggggucuucggcaccggcacccgggugagcgugcuc

SEQ ID NO: 10420 - RNA, 333 nt, Artificial Sequence
  derived and/or modified sequence opt1 from anti-HIV_048-005088_VR-Chain
cagagcgugcugacccagcccccguccgucagcgccgcccccggccagaaggugaccaucuccugcagcggguccagcuccaacaucggcaagaacuacgugagcugguaccagcagcuccccgggacggcgcccaagcugcugaucuacgacaacaacaaccgcccguccggcauccccgaccgguucagcggguccaagagcggcaccuccgccacccucggcaucaccgggcugcagacgggcgacgaggccgacuacuacugcggggccugggacaccagccuguccgccggcggggucuucggcaccggcaccaaggugacggugcuc

SEQ ID NO: 10421 - RNA, 333 nt, Artificial Sequence
  derived and/or modified sequence opt1 from anti-HIV_048-004023_VR-Chain
cagagcgugcugacccagcccccguccgucagcgccacccccggccagaaggugacgaucuccugcagcgggggcuccagcaacaucgggaagaacgacguguccugguaccagcagcuccccggcaccgcccccaagcugcugaucuacgacaccaacaagcgcccgagcgggauccccgaccgguucuccgcggcccgcagcggcaccuccgccacgcucgacaucaccggccugcagaccggggacgaggccgacuacuacugcggcaccugggacacgagccuguccgccgggggcgucuucgggaccggcaccaaggugaccgugcuc

SEQ ID NO: 10422 - RNA, 333 nt, Artificial Sequence
  derived and/or modified sequence opt1 from anti-HIV_048-001580_VR-Chain
cagagcgugcugacccagcccccguccgucagcgccgcccccggccagaaggugaccaucuccugcagcggguccagcuccaacaucggcaacaacuacgugagcugguaccagcagcuccccgggacggcgcccaagcugcugcucuacgagaacaacaagcgcccguccggcauccccgaccgguucagcggguccaagagcggcaccuccgccacccuggccaucaccggccugcagacgggggacgaggccgccuacuacugcggcaccugggacgggagccucuccaccggcggggucaucggcaccggcacgaaggugaccgugcug

SEQ ID NO: 10423 - RNA, 333 nt, Artificial Sequence
  derived and/or modified sequence opt1 from anti-HIV_038-221120_VR-Chain
cagagcgugcugacccagcccccguccgucagcgccgcccccggccagaaggugaccaucuccugcagcggguccacgagcaacaucggcaagaacuacguguccugguaccagcagcuccccgggaccgcgcccaagcugcugaucuacgacaacaacgagcgcccgagcggcauccccgaccgguucuccgggagcaaguccggcaccagcgccacccucggcaucacggggcugcagaccggcgacgaggccgacuacuacugcgccaccugggacuccagccuguccgggggcggggucuucggcaccggcacgcgcgugaccgugcuc

SEQ ID NO: 10424 - RNA, 333 nt, Artificial Sequence
  derived and/or modified sequence opt1 from anti-HIV_038-197677_VR-Chain
cagagcgugcugacccagcccccguccgucagcgccgcccccggccagaaggugaccguguccugcagcggguccaacagcaacaucggcaaccacuacgucuccugguaccagcagcuccccgggacggcgcccaagcugcugaucuacgacaacaacaagcgcccgagcggcauccccgaccgguucuccgggagcaaguccggcaccagcgccacccucggcaucaccgggcugcagacgggcgacgaggccgacuacuacugcgggaccugggacuccagccuguccgccggcgggguguucggcaccggcaccaaggugacgguccuc

SEQ ID NO: 10425 - RNA, 333 nt, Artificial Sequence
  derived and/or modified sequence opt1 from anti-HIV_038-196765_VR-Chain
cagagcgcccugacccagcccgccuccgugagcggcuccccggggcagagcaucaccaucuccugcacgggcaccagcggggacgucggcuacaaccucguguccugguaccagcagcugcccgggaccgcgcccaaggugcugaucuacgagaacaacaagcgccccagcggcaucccggaccgguucuccggcagcaaguccgggaccagcgccacgcucggcaucaccgggcugcagaccggcgacgaggccgacuacuacugcgggaccugggacuccagccuguccgccggcggcgucuucgggacgggcaccaaggugaccgugcuc

SEQ ID NO: 10426 - RNA, 333 nt, Artificial Sequence
  derived and/or modified sequence opt1 from anti-HIV_038-186200_VR-Chain
cagagcgugcugacccagcccccguccgccagcggcacccccgggcagcgcaucacgaucuccugcagcggcaccuccagcaacaucggguccaacaucgucagcugguaccagcaccuccccggcaccacccccaagcuggugaucuuccggaacaaccagcgcccguccgggauccccgaccgguucagcggcuccaagagcggcacguccgccacccuggggaucaccggccuccagaccggggacgaggcggacuacuacugcggcacgugggacagcucccugagcgccgggggcguguucggcaccgggaccaaggucaccgugcug

SEQ ID NO: 10427 - RNA, 333 nt, Artificial Sequence
  derived and/or modified sequence opt1 from anti-HIV_038-126170_VR-Chain
cagagcgugcugacccagcccccguccgucagcgccccgcccggccagaaggugaccaucuccugcagcgggacgaccuccaacaucggcagcaacuacguggccugguaccagcagcuccccgggaccgcgcccaagcugcugaucuacgacaacgucaagcgccccaccaacauccccgaccgguucuccggcagcaaguccgggacgagcgccacccucggcaucaccggccugcagaccggggacgaggccgacuacuacugcggcacgugggacuccagccuguccgccgggggcguguucgggaccggcaccaaggugaccguccuc

SEQ ID NO: 10428 - RNA, 333 nt, Artificial Sequence
  derived and/or modified sequence opt1 from anti-HIV_038-108545_VR-Chain
cagagcgugcugacccagcccccguccgccagcggcacccccgggcagcgcgucacgaucuccugcagcggcuccagcuccaacaucggguacaacaccgugagcugguaccagcagcuccccggcaccgcccccaagcugcugaucuacgagaacaacaagcggccguccgggauccccgaccgcuucagcggcuccaagagcggcaccuccgcgacgcucgggaucaccggccugcagaccggggacgaggccgacuacuacugcggcaccugggacagcucccugagcgccgggggcguguucggcacggggaccaaggucaccgugcuc

SEQ ID NO: 10429 - RNA, 333 nt, Artificial Sequence
  derived and/or modified sequence opt1 from anti-HIV_038-107263_VR-Chain
cagagcgugcugacccagcccccguccgccagcggcacccccgggcagcgcgucacgaucuccugcagcggcuccagcuccaacaucgggagcaacaccgugaacugguaccagcagguccccggcaccgcccccaaccuccugaucuacuccaacgaccagcggccgagcgggauccccgaccgcuucuccggcagcaaguccggcaccagcgcgacgcuggggaucaccggccuccagaccggggacgaggccgacuacuacugcggcaccugggacuccagccuguccgccgggggcguguucggcacggggaccaaggugaccgugcug

SEQ ID NO: 10430 - RNA, 333 nt, Artificial Sequence
  derived and/or modified sequence opt1 from anti-HIV_038-104530_VR-Chain
cagagcgugcugacccagcccccguccgucagcgccgcccccggccagaaggugaccaucuccugcagcggguccagcuccaacaucggcagcaacuacguguccugguaccagcaccuccccgggaaggcgcccaagcugcugaucuacgacaacaacaagcgcccgagcggcauccccgaccgguucuccgggagcaaguccggcacgagcgccacccucggcaucaccgggcugcagaccggcgacgaggccgacuacuacugcgggacgugggacuccagccuguccgccggcggggucuucggcaccggcaccaaggugaccgugcuc

SEQ ID NO: 10431 - RNA, 333 nt, Artificial Sequence
  derived and/or modified sequence opt1 from anti-HIV_038-099169_VR-Chain
cagagcgugcugacccagcccccguccgccagcggcacccccgggcagcgcgucuccaucagcugcuccggcaucacgagcucccucgggagcaaccacauguccugguaccagcagcugcccggcaccgcccccaagcugcucaucuacgagaacaacaagcggccgagcgggauccccgaccgcuucuccggcagcaaguccggcaccagcgcgacccuggggaucacgggccugcagaccggggacgaggccgacuacuacugcggcaccugggacuccagccucuccgccgggggcguguucggcaccgggacgaaggugaccguccug

SEQ ID NO: 10432 - RNA, 333 nt, Artificial Sequence
  derived and/or modified sequence opt1 from anti-HIV_038-075067_VR-Chain
cagagcgugcugacccagcccccguccgucagcggcgcccccgggcagcgcgugaccaucuccugcagcggcuccagcuccacgaucgggaacaacuacgugagcugguaccagcuccugcccggcaccgcccccaagcugcucaucuacaagaacaacaagcggccguccgggauccccgaccgcuucagcggcuccaagagcggcaccuccgcgacccuggggaucacgggccugcagaccggggacgaggccgacuacuacugcggcaccugggacaccagccucuccgccgggggcgucuucggcacggggaccaaggugaccgugcug

SEQ ID NO: 10433 - RNA, 333 nt, Artificial Sequence
  derived and/or modified sequence opt1 from anti-HIV_038-072368_VR-Chain
cagagcgugcugacccagucccccagcgccuccggcaccccggggcagcgcgucacgaucagcugcuccggcagcuccagcaacaucgggaacaacuacguguccugguaccagcagcuccccggcaccgcccccaagcugcugaucuacgagaacaacaagcggcccagcgggaucccggaccgcuucuccggcagcaaguccggcaccagcgcgacccucgggaucacgggccugcagaccggggacgaggccgacuacuacugcggcaccugggacuccagccuguccgccgggggcguguucggcaccgggacgaaggucaccgugcuc

SEQ ID NO: 10434 - RNA, 333 nt, Artificial Sequence
  derived and/or modified sequence opt1 from anti-HIV_038-068503_VR-Chain
cagagcgugcugacccagcccccguccgucagcgccgcccccggccagauggugaccaucuccugcagcgggucccgcagcaacaucgagaaccacuacguguccugguaccagcaccuccccggcgcggcccccaagcugcugaucuacgacaacgggaagcggccgagcggcauccccgaccgcuucuccgggagcaaguccggcacgagcgccacccucggcaucaccgggcugcagaccggcgacgaggccgacuacuacugcgggacgugggacuccagccuguccgccggcggggucuucggcaccggcaccaaggugaccgugcuc

SEQ ID NO: 10435 - RNA, 333 nt, Artificial Sequence
  derived and/or modified sequence opt1 from anti-HIV_038-068016_VR-Chain
cagagcgugcugacccagcccccguccgccagcggcacccccgggcagcgcgucacgaucuccugcagcggcuccagcuccaacaucgagagcaacuucguguacugguaccagcaguuccccgggaccacccccaagcuccugaucuaccgggacggccagcgcccguccgggauccccgaccgguucagcggcuccaagagcggcaccuccgccacgcuggggaucaccggccuccagaccggggacgaggcggacuacuacugcggcaccugggacagcucccugagcgccgggggcguguucggcacggggaccaaggucaccgugcug

SEQ ID NO: 10436 - RNA, 333 nt, Artificial Sequence
  derived and/or modified sequence opt1 from anti-HIV_038-063958_VR-Chain
cagagcgugcugacccagcccccguccgucagcggcgcccccgggcagcgcgugaccaucuccugcacgggcagcuccagcaacaucgggaacuccggcgugcacugguaccagcagcuccccgggaccgcccccaagcugcugaucuacgagaacaacaagcggccgagcggcauccccgaccgcuucuccggcagcaaguccgggaccagcgcgacccucggcaucacggggcugcagaccggcgacgaggccgacuacuacugcgggaccugggacuccagccuguccgccggcggcgucuucgggaccggcacgaaggugaccgugcuc

SEQ ID NO: 10437 - RNA, 333 nt, Artificial Sequence
  derived and/or modified sequence opt1 from anti-HIV_038-033733_VR-Chain
cagagcgugcugacccagcccccguccgccagcggcacccccgggcagcgcgucacgaucuccugcagcggcuccagcuccaacaucgggagcaaguacguguacugguaccagcagcuccccggcaccgcccccaagcugcugaucuacgacaacgacaagcggccguccgggauccccgaccgcaucagcgcguccaagagcggcaccuccgccacccucgacaucacgcggcugcagaccggcgacgaggccgacuacuacugcgggaccugggacagcucccugagcgccggcgggguguucggcaccgggacgaaggucaccgugcuc

SEQ ID NO: 10438 - RNA, 333 nt, Artificial Sequence
  derived and/or modified sequence opt1 from anti-HIV_038-030557_VR-Chain
cagagcgugcugacccagcccccguccgucagcgccgcccccggccagaaggugaccaucuccugcagcggguccagcuccacgaucggcaacaacuacgugagcugguaccagcuccugcccgggaccgcgcccaagcugcucaucuacaagaacaacaagcgcccguccggcauccccgaccgguucagcggguccaagagcggcaccuccgccacccugggcaucacggggcugcagaccggcgacggggccgacuacuacugcggcaccugggacaccagccucuccgccgggggcgucuucggcacggggaccaucgugaccgugcug

SEQ ID NO: 10439 - RNA, 333 nt, Artificial Sequence
  derived and/or modified sequence opt1 from anti-HIV_038-024298_VR-Chain
cagagcgugcugacccagcccccguccgucagcgccgcccccggccagaaggugaccaucuccugcagcggguccagcuccaacaucggcaacagccacguguccugguaccagcaguuccccgggacgggccccaagcuccugaucuacgagaacgcgaagcgcccgagcgggauccccgaccggaucuccggcagcaaguccgacaccagcgccacccugggcaucaccgggcuccagacgggcgacgaggccgacuacuacugcgggaccugggacuccagccuguccgccggcggggucuucggcaccggcaccaaggugacggugcug

SEQ ID NO: 10440 - RNA, 333 nt, Artificial Sequence
  derived and/or modified sequence opt1 from anti-HIV_038-011154_VR-Chain
cagagcgugcugacccagcccccguccgucagcgccgcccccggccagcgcaucaccaucuccugcagcggguccagcuccaacaucggcaacaacuacgugagcugguaccagcagcuccccgggacggcgcccaagcugcugaucuacaagaacaacaagcggccguccggcauccccgaccgcuucagcggguccaagagcggcaccuccgccacccucggcaucaccgggcugcagacgggcgacgaggccgacuacuacugcgggaccugggacaccagccuguccgccggcgggguguucggcaccggcacgaaggucaccgugcuc

SEQ ID NO: 10441 - RNA, 318 nt, Artificial Sequence
  derived and/or modified sequence opt1 from anti-HIV-1_LightChain
gagaucgugcugacccagagccccggcacccucucccugagcccgggggagcgcgccacgcuguccugccgggccagccaguccgucagcaacaacuuccucgcgugguaccaguacaagcccggccagccgccccgcgugcugaucuacgggaccucccggcgcgccagcggcauccccgaccgguucuccgggagcggcuccggcaccgacgggagccugaccaucucccgccucgaggccgaggacuucgccguguacuacugccagcaguacgaguucuucggccaggggacgcggcuggagaugaagcgcacc

SEQ ID NO: 10442 - RNA, 318 nt, Artificial Sequence
  derived and/or modified sequence opt1 from anti-HIV-1_LightChain
gaggugguccugacccagagccccggcacccucucccugagcccgggggagcgcgccacgcuguccugccgggccagccaguccgugagccgcaacuaccucgcgugguaccagcagaagcugggccacgggccccggcugcucguguacgccaccucccgccgggccaccggcauccccgaccgcuucaucgggagccaguccggcaccgaguacaaccugacgaucacccggcuggaccccggcgacuucgcccaguacuucugccagcaguacgaguucuucgggccgggcacccgccucgacaucaagcggacc

SEQ ID NO: 10443 - RNA, 309 nt, Artificial Sequence
  derived and/or modified sequence opt1 from anti-HIV-1_LightChain
gaggugguccugacccagagccccggcacccucucccugagcccgggggagcgcgccuccuucagcugcaaguccagccaguacggccacacggccugguaccagcagaagcuggggcacggcccccggcuccugaucuacgcgaccucccgccgggccaccgggauccccgaccgcuucaucggcagccaguccggcaccgaguacaaccugacgaucacccggcucgaccccggggacuucgcccacuacuucugccagcagaacgaguucuucggcccggggacccgccuggacaugaagcggacc

SEQ ID NO: 10444 - RNA, 306 nt, Artificial Sequence
  derived and/or modified sequence opt1 from anti-HIV-1_LightChain
gagaucgugcugacccagagccccuccagccucucccugagcccgggcgagcgcgccucccugagcugccgggggucccacggccacgucgccugguaccagcacaagcccgggcagaucccccgccuccugaucuacgcgaccagcaagcgggccuccggcaucagcgaccgcuucuccgggagcggcuccggcacggacgccacccugagcaucucccggcucgagcccgaggacuucgccguguacuucugccagcaguacgaguucuucgggcagggcacccgccuggagaucaagcggacc

SEQ ID NO: 10445 - RNA, 306 nt, Artificial Sequence
  derived and/or modified sequence opt1 from anti-HIV-1_LightChain
gagaucaugcugacccagagccccggcacccucucccugagcccgggggagcgcgccacgcuguccugccggggcagccacgggcacguggccugguaccagcagaagcccggccgcaucccccggcuccugaucuacgggaccuccaagcgcgcgagcggcauccccgaccgguucuccggcagcggguccggcaccgacgccacccugacgaucagccgccucgaguccgaggacuucgccgucuacuucugccagcaguacgaguucuucgggcagggcacccggcuggacaucaaccgcacc

SEQ ID NO: 10446 - RNA, 309 nt, Artificial Sequence
  derived and/or modified sequence opt1 from anti-HIV-1_LightChain
gagagcgugcugacccagucccccggcacccucagccuguccccgggggagacggccagccuguccugcaccgccgcgcucuacggccacaugaccugguaccagaagaagcccgggcagccgcccaagcugcugcucuacgccagcuccaagcgcgccagcggcauccccgaccgguucuccgggagccaguucggcaagcaguacacccugaucaucacgaagauggagcccgaggacuucgccgaguacuacugccagcaguucgaggucuucggccaggggacccgccuggacaugcggcgcacc

SEQ ID NO: 10447 - RNA, 306 nt, Artificial Sequence
  derived and/or modified sequence opt1 from anti-HIV-1_LightChain
gaggugguccugacccagagccccggcacccucucccugagcccgggggagcgcgccacgcuguccugccggggcagccacgggcaccucuccugguaccaguacaagcccggccagccgccccgcgugcugaucuacgggaccagccggcgcgccuccggcauccccgaccgguucagcggcuccgggagcggcaccgacgggucccugaccaucagccgccucgaggcggaggacuucgccguguacuacugccagcaguacgaguucuucggccaggggacgcggcuggagaugaagcgcacc

SEQ ID NO: 10448 - RNA, 309 nt, Artificial Sequence
  derived and/or modified sequence opt1 from anti-HIV-1_LightChain
gaggugguccugacccagagccccggcacccucucccugagcccgggggagcgcgccucccugagcugcaaguccagccaguacggccacacggccugguaccagcagaagcucgggcagggcccccggcugcugaucuacgcgaccucccgccgggccaccgggauccccgaccgcuucagcggcucccagagcggcaccgaguacaaccucacgaucacccggcuggaccccggggacuucgcccaguacuucugccagcaguacgaguucuucggcccggggacccgccuggacaucaagcggacc

SEQ ID NO: 10449 - RNA, 306 nt, Artificial Sequence
  derived and/or modified sequence opt1 from anti-HIV-1_LightChain
gagaucaugcugacccagagccccggcacccucucccugagcccgggggagcgcgccacgcuguccugccggggcagccacgggcacguggccugguaccagcagaagcccggccgcaucccccggcuccugaucuacgggaccuccaagcgcgcgagcggcauccccgaccgguucuccggcagcggguccggcaccgacgccacccugacgaucagccgccucgaguccgaggacuucgccgucuacuacugccagcaguacgaguucuucgggcagggcacccggcuggacaucaagcgcacc

SEQ ID NO: 10450 - RNA, 309 nt, Artificial Sequence
  derived and/or modified sequence opt1 from anti-HIV-1_LightChain
gagagcgugcugacccagucccccggcacccucagccuguccccgggggagacggccagccuguccugcaccgccgcgagcuacggccacaugaccugguaccagaagaagcccgggcagccgcccaagcuccugaucuucgccaccuccaagcgcgccagcggcauccccgaccgguucuccgggagccaguucggcaagcaguacacgcugaccaucacccgcauggagcccgaggacuucgccggcuacuacugccagcaggucgaguucuucgggcagggcacccggcucgagauccgccggacg

SEQ ID NO: 10451 - RNA, 309 nt, Artificial Sequence
  derived and/or modified sequence opt1 from anti-HIV-1_LightChain
gacauccagaugacccagagccccuccagccuguccgccagcgugggcgaccgcgucaccaucacgugccaggccucccaggacaucagcaacuaccucaacugguaccagcagaagccggggaaggcgcccaagcugcugaucuacgacgccuccaaccucgagaccggcgugcccagccgguucuccgggagcggcuuccacaccaccuucucccugacgaucagcgggcugcagcgcgacgacuucgccaccuacuucugcgccgugcucgaguucuucggccccggcaccaaggucgacuucaac

SEQ ID NO: 10452 - RNA, 309 nt, Artificial Sequence
  derived and/or modified sequence opt1 from anti-HIV-1_LightChain
gacauccagaugacccagagccccuccagccuguccgccagcgugggcgaccgcgucaccaucacgugccaggccucccaggacaucaccaacuaccucaacugguaccagcagaagccggggcgggcgcccaagcugcuggugcacggcgccagcaaccuccagcgcggggugcccucccgguucagcggcuccggguuccacaccaccuucacgcugaccaucagcucccugcagcccgacgacgucgccaccuacuucugcgagguguuccagugguucggcccgggcacccgcguggacuucaac

SEQ ID NO: 10453 - RNA, 309 nt, Artificial Sequence
  derived and/or modified sequence opt1 from anti-HIV-1_LightChain
ggcuuccagcugacccagagccccuccagccucuccgccagcgugggggaccgcgucuccaucaacugccaggccggcgaggggaucggcagcucccugaacugguaccagcagaagccggggcgggcgcccaagcugcucgugcacggcgccagcaaccugcagcgcggcgugcccucccgguucagcggguccggcuuccacaccacguucacccugaccaucagcucccuccagcccgacgacgucgccaccuacuucugcgagguguuccagugguucgggccgggcacgcgcguggacuucaac

SEQ ID NO: 10454 - RNA, 309 nt, Artificial Sequence
  derived and/or modified sequence opt1 from anti-HIV-1_LightChain
ggcauccagcugacccagagccccuccagccucuccgugagcgucggggaccgcgugaccaucacgugccgggccucccagggcaucgggaacagccugaacugguaccagcagaagccgggcaaggcccccaaccugaugguguucgggaccaccaagcucaaccgcggcguccccucccgguucagcggcuccgggagcggcaccacggcgacccugaccaucaacucccugcagcccgaggacaucgccaccuacuucugccagguguucgaguuccucgggccgggcacgaagcuggacaugaag

SEQ ID NO: 10455 - RNA, 309 nt, Artificial Sequence
  derived and/or modified sequence opt1 from anti-HIV-1_LightChain
gacauccagaugacccagagccccuccagccuguccgccagcgugggcgaccgcgucaccaucacgugccaggccgggcagggcaucggguccagccucaagugguaccagcagaagccgggccgggcgccccgccugcuggugcacggggccuccaaccuccaccggggcgugcccagccgcuucuccggcagcggguuccacaccaccuucucccugaccaucagcggccugcagcgggacgacuucgccacguacuucugcgccguccucgaguucuucgggcccggcaccaagguggacuucaac

SEQ ID NO: 10456 - RNA, 309 nt, Artificial Sequence
  derived and/or modified sequence opt1 from anti-HIV-1_LightChain
ggcauccagcugacccagagccccuccagccucuccgccagcgugggggaccgcgucaccaucacgugccaggccucccagggcaucgggagcucccugcagugguaccagcagaagccgggccgggcgcccaaccugcucgugcacggggccagcaaccugcaccgcggcgugcccucccgguucagcggcuccggguuccacaccaccuucagccugaccaucuccggccuccagcgcgacgacuucgccacguacuucugcgccguccuggaguucuucgggcccggcaccaagguggagaucaag

SEQ ID NO: 10457 - RNA, 309 nt, Artificial Sequence
  derived and/or modified sequence opt1 from anti-HIV-1_LightChain
ggcgugcagcugacccagagccccuccagccucuccgccagcgucggggaccgcguguccaucaacugccaggccggccaggggaucggcagcucccugaacugguaccagcagaagcgggggaaggcgccgaagcugcucgugcacggcgccagcacccugcagcgcggcguccccucccgguucagcggguccggcuuccacacgaccuucacccugaccaucagcucccuccagcccgacgacguggccacguacuucugcgagguguuccagugguucgggcccggcacccgcgucgacuucaac

SEQ ID NO: 10458 - RNA, 306 nt, Artificial Sequence
  derived and/or modified sequence opt1 from anti-HIV-1_LightChain
uacauccagcugacccagagccccuccagccucuccgccagcaucggcgaccgcgugaccaucgccugccgggcgucccaggggaucggcuacguccacugguaccagcagaagcgcgggaagccgcccaagcugcugauccacggcgccagcauccucgagcgcggggugcccucccgguucagcggcuccggcagcgggacgcuguucaaccugaccguguccggccuccagcccgaggacuucgccaccuacaugugccaggucuucgagagcuucgggccgggcaccaaggugcagaugaag

SEQ ID NO: 10459 - RNA, 309 nt, Artificial Sequence
  derived and/or modified sequence opt1 from anti-HIV-1_LightChain
ggcauccagcugacccagagccccuccagccucuccgccagccugggggaccgcgugaccaucacgugccaggccucccagggcaucgggagcucccugcagugguaccagcagaagccgggcaaggcgcccaagcuccugguccacggggccagcaagcugcaccggggcgugcccucccgcuucagcggcuccggguuccacaccaccuucagccucaccaucuccagccugcagcccgaggacuucgccacguaccugugccaggugcucgaguucuucggcccggggaccaaggucgacuucaac

SEQ ID NO: 10460 - RNA, 309 nt, Artificial Sequence
  derived and/or modified sequence opt1 from anti-HIV-1_LightChain
ggcauccagcugacccagagccccuccagccucuccgccagcgugggggacaccgucacgaucacgugccaggccucccagggcaucgggagcucccugcagugguaccagcagaagcgcggccgggcgccgaagcugcucgugcacggggccagcaaccugcagggcggcgugcccucccgcuucagcggguccggcuuccacaccaccuucacccuggccauccgggggcuccagcccgacgacuucgccaccuacuucugccagagccuggaguucuucggccccgggaccaaggucgacaugaag

SEQ ID NO: 10461 - RNA, 306 nt, Artificial Sequence
  derived and/or modified sequence opt1 from anti-HIV-1_LightChain
uacauccagcugacccagagccccuccagccucuccgccagcgugggcgaccgcgucaccaucacgugccgggccucccaggacaucggguacgugagcugguacgcgcagaagcgcggccgggccccgaagcugcugauccacggggccuccggccucgagcgcggggugcccagccgguucuccggcagcggcuccgggacccuguucacccugaccaucgagagccuccagcccgaggacuucgccacguacaugugccaggucuucgaguccuucggccccgggaccaagguggagaugaag

SEQ ID NO: 10462 - RNA, 309 nt, Artificial Sequence
  derived and/or modified sequence opt1 from anti-HIV-1_LightChain
ggcauccagcugacccagagccccuccagccucuccgccagcgugggggaccgcgucuccaucaacugccaggccggccaggggaucggcagcucccugaacugguaccagcagaagccggggcgggcgcccaagcugcucgugcacggcgccagcaaccugcagcgcggcgugcccucccgguucagcggguccggcuuccacaccacguucacccugaccaucagcucccuccagcccgacgacgucgccaccuacuucugcgccguguuccagugguucgggccgggcacgcgcguggacuucaac

SEQ ID NO: 10463 - RNA, 366 nt, Artificial Sequence
  derived and/or modified sequence opt1 from anti-HIV-1_HeavyChain
agccagcagcuggugcaguccggcacccaggucaagaagcccggggccagcgugcgcaucuccugccaggccagcggcuacaccuucacggacuacgugcuccacugguggcggcaggcgccggggcagggccuggaguggaugggguggaucaagcccgucuacggcgcccgcaacuacgcccggcgcuuccagggccggaucgacuucucccgcgacaucuaccgggagaucgccuacauggaccugagcgggcuccgcuccgacgacaccgcccuguacuucugcgcgcgggacggcagcggggacgacaccuccuggcaccuggaccccuggggccaggggacccucgugaucgugagcgcc

SEQ ID NO: 10464 - RNA, 366 nt, Artificial Sequence
  derived and/or modified sequence opt1 from anti-HIV-1_HeavyChain
agccagcagcuggugcaguccggcacccaggucaagaagcccggggccagcgugcgcaucuccugccaggccagcggcuacaccuucacggacuaccuccugcacugguggcggcaggcgccggggcagcgccuggaguggaugggcuggaucaagcccguguacggggcccggaacuacgcccaccgcuuccagggccggaucaacuucgaccgcgacaucuaccgggagaucgccuucauggaccucuccggccugcgcagcgacgacaccgccgucuacuucugcgcgcgggacgggggcggggacgaccgcaccuggcugcucgacaccuggggccaggggacgcuggugguggucuccagc

SEQ ID NO: 10465 - RNA, 366 nt, Artificial Sequence
  derived and/or modified sequence opt1 from anti-HIV-1_HeavyChain
caggugcaccuggagcagcccggcagcgucgugcgcuggccgggggccucccugacccugagcugcaccgccuccggcuacaucuucgugaacuaccacauccacuggcugcggcaggcgcccgggcagcgccucgagcugcugggcacgaucaaccccgucgggggcgccaccagcuacgcccagaaguuccggggccgccucgugcugacccgggacaucggguccagcaccgugacgcugcuccugaaccaccuccgccgggacgacuccgccgucuacuucugcgcccgcgagagcaacgcguccggccgggggcgcagcauggaccacuggggccgggggucccgcgugaucgugagccag

SEQ ID NO: 10466 - RNA, 366 nt, Artificial Sequence
  derived and/or modified sequence opt1 from anti-HIV-1_HeavyChain
caggugcagcugguccagagcggcgccgaggugaagaagcccggggccuccgugcgcgucagcugccaggcguccggcuacaccuucaccaacuacauccugcacugguggcggcaggccccggggcagggccuggaguggauggggcugaucaagcccguguacggcgccgugaacuacgcccgccaguuccagggccggauccagcucacgcgcgacaucuaccgggagaucgccuuccuggaccugagcgggcuccgcuccgacgacaccgcggucuacuacugcgcccgggacgagagcggcgacgaccugaaguggcaccuccaccccugggggcagggcacccaggugaucguguccccc

SEQ ID NO: 10467 - RNA, 366 nt, Artificial Sequence
  derived and/or modified sequence opt1 from anti-HIV-1_HeavyChain
caggugcagcugguccagagcggcgccgaggugaagaagcccggggccuccgugcgcaucagcugccaggcguccggcuacaccuucaccgacuacguccugcacugguggcggcaggccccggggcagggccuggaguggaugggguggaucaagcccguguacggcgcccgcaacuacgcccggcgcuuccagggccggaucaacuucgaccgcgacaucuaccgggagaucgccuacauggaccugagcgggcuccgcuccgacgacacggcgcgguacuucugcgcccgcgacggcagcggggacgacaccuccuggcaccuccaccccuggggccaggggacccuggugaucgucagcgcc

SEQ ID NO: 10468 - RNA, 366 nt, Artificial Sequence
  derived and/or modified sequence opt1 from anti-HIV-1_HeavyChain
agccagcagcuggugcaguccggcacccaggucaagaagcccggggccagcgugcgcguguccugccaggccagcggcuacaccuucacgaacuacauccugcacugguggcggcaggcgccggggcagggccuggaguggauggggcugaucaagcccgucuacggcgccgugaacuacgcccgccaguuccagggccggauccagcucacccgcgacaucuaccgggagaucgccuuccuggaccuguccgggcuccgcaccgacgacaccgccguguacuacugcgcgcgggacgagagcggcgacgaccugaaguggcaccuccaccccugggggcagggcacgcaggucaucguguccccc

SEQ ID NO: 10469 - RNA, 366 nt, Artificial Sequence
  derived and/or modified sequence opt1 from anti-HIV-1_HeavyChain
caggugcaccuggagcagagcggcuccgucgugcgcuggcccggggccagccugacccuguccugcaccgccagcggcuacaucuucgugaacuaccacauccacuggcugcggcaggcgccggggcagcgccucgagcugaugggcacgaucaaccccgucgggggcgccaccuccuacacccagcgguuccgcggccggcuggugcucacccgcgacaucgggagcaacacggugacccugcugcucaaccaccuccgguccgacgacagcgccgucuacuucugcgcccgcgaguccaacgccagcggccgggggcgcuccauggaccacuggggccgggggagccacgugaucguguccccc

SEQ ID NO: 10470 - RNA, 366 nt, Artificial Sequence
  derived and/or modified sequence opt1 from anti-HIV-1_HeavyChain
agccagcaccuggugcaguccggcacccaggucaagaagcccggggccagcgugcgcguguccugccaggccagcggcuacaccuucacgaacuacauccugcacugguggcggcaggcgccggggcagggccuggaguggauggggcugaucaagcccgucuacggcgccgugaacuacgcccgccaguuccagggccggauccagcucacccgcgacaucuaccgggacaucgccuuccuggaccuguccgggcuccgcagcgacgacaccgccguguacuacugcgcgcgggacgaguccggcgacgaccugaaguggcaccuccaccccugggggcagggcacccaggucaucgugagcccc

SEQ ID NO: 10471 - RNA, 366 nt, Artificial Sequence
  derived and/or modified sequence opt1 from anti-HIV-1_HeavyChain
agccagcagcuggugcaguccggcacccaggucaagaagcccggggccagcgugcgcaucuccugccaggccagcggcuacaccuucacggacuacgugcugcacugguggcggcaggcgccggggcagggccuggaguggaugggguggaucaagcccgucuacggcgcccgcaacuacgcccggcgcuuccagggccggaucaacuucgaccgcgacaucuaccgggagaucgccuacauggaccuguccgggcuccgcagcgacgacaccgcccgguacuucugcgcgcgcgacggcuccggggacgacaccagcuggcaccuccaccccuggggccaggggacccuggugaucguguccgcc

SEQ ID NO: 10472 - RNA, 366 nt, Artificial Sequence
  derived and/or modified sequence opt1 from anti-HIV-1_HeavyChain
caggugcaccuggagcagcccggcagcgucgugcgcuggccgggggccucccugacccugagcugcaccgccuccggcuacaucuucgugaacuaccacauccacuggcugcggcaggcgcccgggcagcgccucgagcugcugggcacgaucaaccccgucgggggcgccaccagcuacgcccagaaguuccggggccgccucgugcugacccgggacaucggguccagcaccgugacgcugcuccugaaccaccuccgccgggacgacuccgccgucuacuucugcgcccgcgagagcaacgcguccggccgggggcgcagcauggaccacuggggccgggggaagcccgugaucguguccccg

SEQ ID NO: 10473 - RNA, 321 nt, Artificial Sequence
  derived and/or modified sequence opt1 from anti-HIV-1_HeavyChain
gagaucgugaugacccagagccccgccauccuguccgucagcccgggcgaccgcgccaccuucuccugccgggcgagccaguccgugaagaacaaccucgccugguaccagaagcgccccgggcaggcgccccggcugcugaucuucgacgccagcucccgcgccagcggcauccccgcccgguucuccgggggcgggagcggcacggaguucacccucaccgugaacuccaugcagagcgaggacuucgccaccuacuacugccagcaguacgaggaguggccgcgcacguucggccaggggaccaaggucgagaucaug

SEQ ID NO: 10474 - RNA, 321 nt, Artificial Sequence
  derived and/or modified sequence opt1 from anti-HIV-1_HeavyChain
cagaucgugcugacccagagcccgcccacccucucccugagccccggcgagcgcgccacgcuguccugccgggccagccaguccgucaagaacaaccucgccugguaccagaagcgccccgggcaggcgccccggcugcugaucuucgacaccagcucccgcgccagcaacaucccggcccgguucuccggcgggggcagcgggaccgaguucacccucacggugaacuccaugcagagcgaggacuucgccaccuacuacugccagcaguacgaggaguggccccgcaccuucggccagggcaccaagguggagaucauc

SEQ ID NO: 10475 - RNA, 321 nt, Artificial Sequence
  derived and/or modified sequence opt1 from anti-HIV-1_HeavyChain
gagaucgugaugacccagagccccgccguccuguccgugagcccgggcgaccgcgccacccucuccugccgggcgagccaguccgugaagaacaaccuggccugguaccagaagcgccccgggcaggcgccccggcugcucaucuucgacacgagcucccgcgccagcaacauccccgcccgguucuccggcgggggcagcgggaccgaguucacccugaccgucaacuccaugcagagcgaggacuucgccacguacuacugccagcaguacgaggaguggccgcgcaccuucggccagggcaccaagguggagaucaac

SEQ ID NO: 10476 - RNA, 321 nt, Artificial Sequence
  derived and/or modified sequence opt1 from anti-HIV-1_HeavyChain
gagaucgugcugacccagagcccgcccacccucuccgucagccccggcgaggccgccacgcuguccugccgcgcgagccaguccgugaagaacaaccuggccugguaccaccucaaggccgggcaggcgccccggcugcugaucuucgacgccagcucccgcgccggcgacgcccccgcccgggugagcggguccggcuacgggaccgaguucacccucaccgucaacagcgugcaguccgaggacuucggcgacuacuacugccagcaguacgaggaguggccgcgcacguucggccaggggaccaagguggaccugcgg

SEQ ID NO: 10477 - RNA, 321 nt, Artificial Sequence
  derived and/or modified sequence opt1 from anti-HIV-1_HeavyChain
gagaucgugaugacccagagcccgcccacccuguccgucagccccggcgagacggccacccucuccugccgcgccagccagaacgugaagaacaaccuggccugguaccagcugaagcccgggcaggcgccccggcuccugaucuucgacgccuccagccgcgccggcgggaucccggaccgguucuccggcagcggguacggcaccgacuucacccugacggugaacuccguccagagcgaggacuucggcgacuacuucugccagcaguacgaggaguggccccgcaccuucgggcagggcaccaagguggaccuccgg

SEQ ID NO: 10478 - RNA, 321 nt, Artificial Sequence
  derived and/or modified sequence opt1 from anti-HIV-1_HeavyChain
gagaucgugaugacccagagccccgccguccuguccgugagcccgggcgaccgcgccacccucuccugccgggcgagccaguccgugaagaacaaccuggccugguaccagaagcgccccgggcaggcgccccggcugcucaucuucgacacgagcucccgcgccagcaacauccccgcccgguucuccggcgggggcagcgggaccgaguucacccugaccgucaacuccaugcagagcgaggacuucgccacguacuacugccagcaguacgaggaguggccgcgcaccuucggccagggcaccaagguggagaucauc

SEQ ID NO: 10479 - RNA, 399 nt, Artificial Sequence
  derived and/or modified sequence opt1 from anti-HIV-1_HeavyChain
gaggugcaccuccaggagagcggccccgggcugguccgcccgcuggagacccugucccugaccugcacggccagcggcgccuccauccgcgggggcgaguggggcgacaacgacuaccacugggggugggugcggcacagccccgagaagggccuggaguggaucggguccauccacuggcggggcaccacccacuacaacgcgcccuuccgcgggcgggccacccugagcaucgacacgucccgcaaccaguucuuccuccggcugaccagcaugaccgccgacgacaccgccguguacuacugcgucaagcacaaguaccacgacaucgugauggugguccccaucgccggcugguucgacccgugggggcagggccuccaggugacgguguccgcg

SEQ ID NO: 10480 - RNA, 399 nt, Artificial Sequence
  derived and/or modified sequence opt1 from anti-HIV-1_HeavyChain
gaggugcaccuccaggagagcggccccgggcucguccgcccgcuggagacccugucccugaccugcacggccagcggcgccuccauccgcgggggcgaguggggcgacaacgacuaccacugggggugggugcggcacagccccgagaagggccuggaguggaucggguccauccacuggcggggcaccacccacuacaacgcgcccuuccgcgggcgggccacccugagcaucgacacgucccgcaaccaguucuuccuccggcugaccagcaugaccgccgacgacaccgccguguacuacugcgucaagcacaaguaccacgacaucgugauggugguccccaucgccggcugguucaacccgugggggcagggccugcaggcgacggugcccucc

SEQ ID NO: 10481 - RNA, 399 nt, Artificial Sequence
  derived and/or modified sequence opt1 from anti-HIV-1_HeavyChain
caggugcagcugaaggagagcggccccgggcucgucaagccguccgagacccugagccugaccugcacgguguccggcgggagcaugcgcggcaccgacuggggcgagaacgacuuccacuacggguggauccggcacuccagcgccgagggccucgaguggaucggguccauccacuggcgcggcaccacccacuacaagaugagcuuccggucccgcgccacgaucagcaucgacaccuccaacaaccgguucagccugauguucuccuucgugaccgcggaggacaccgccgucuacuacugcgcccgccacaaguaccacgacaucuuccggguggugcccgucgccgggugguucgaccccuggggccaggggcugcucgugacggugagcucc

SEQ ID NO: 10482 - RNA, 399 nt, Artificial Sequence
  derived and/or modified sequence opt1 from anti-HIV-1_HeavyChain
gaggugcaccuccaggagagcggccccgggcucguccgcccgcuggagacccugucccugaccugcacggccagcggcgccuccauccgcgggggcgaguggggcgacaacgacuaccacugggggugggugcggcacagccccgagaagggccuggaguggaucggguccauccacuggcggggcaccacccacuacaacgcgcccuuccgcgggcgggccacccugagcaucgacacguccaagaaccaguucagccuccgccugaccuccaugaccgccgacgacaccgccguguacuacugcgucaagcacaaguaccacgacaucgugauggugguccccuucgccggcugguucgacccgugggggcagggccugcgggugacggugagcgcg

SEQ ID NO: 10483 - RNA, 399 nt, Artificial Sequence
  derived and/or modified sequence opt1 from anti-HIV-1_HeavyChain
gaggugcaccuccaggagagcggccccgggcucguccgcccgcuggagacccugucccugaccugcacggccagcggcgccuccauccgcgggggcgaguggggcgacaacgacuaccacugggggugggugcggcacagccccgagaagggccuggaguggaucggguccauccacuggcggggcaccacccacuacaacgcgcccuuccgcgggcgggccacccugagcaucgacacguccaagaaccaguucuuccuccgccugaccagcaugaccgccgacgacaccgccguguacuacugcgucaagcacaaguaccacgacaucugcaugguggugcccaucgccggcugguucgacccgugggggcagggccugcaggucacggugucccag

SEQ ID NO: 10484 - RNA, 399 nt, Artificial Sequence
  derived and/or modified sequence opt1 from anti-HIV-1_HeavyChain
caggugcaccuccaggagagcggccccgggcugguccgcccgcuggagacccugucccugaccugcacggccagcggcgccuccauccgcgggggcgaguggggcgacaacgacuaccacugggggugggugcggcacagccccgagaagggccuggaguggaucggguccauccacuggcggggcaccacccacuacaacgcgcccuuccgcgggcgggccacccugagcaucgacacgucccgcaaccaguucuuccuccggcugaccagcaugaccgccgacgacaccgccguguacuacugcgucaagcacaaguaccacgacaucgugauggugguccccaucgccggcugguucgacccgugggggcagggccuccaggugacgguguccagc

SEQ ID NO: 10485 - RNA, 399 nt, Artificial Sequence
  derived and/or modified sequence opt1 from anti-HIV-1_HeavyChain
caggugcaccuccaggagagcggccccgggcucguccgcccgcuggagacccugucccugaccugcacggccagcggcgccuccauccgcgggggcgaguggggcgacaacgacuaccacugggggugggugcggcacagccccgagaagggccuggaguggaucggguccauccacuggcggggcaccacccacuacaacgcgcccuuccgcgggcgggccacccugagcaucgacacgucccgcaaccaguucuuccuccggcugaccagcaugaccgccgacgacaccgccguguacuacugcgucaagcacaaguaccacgacaucgugauggugguccccaucgccggcugguucgacccgugggggcagggccugcgcgugacggugucccag

SEQ ID NO: 10486 - RNA, 399 nt, Artificial Sequence
  derived and/or modified sequence opt1 from anti-HIV-1_HeavyChain
caggugcaccuccaggagagcggccccgggcugguccgcccgcuggagacccugucccugaccugcacggccagcggcgccuccauccgcgggggcgaguggggcgacaacgacuaccacugggggugggugcggcacagccccggcaaggggcuggaguggaucggcuccauccacuggcgggggaccacccacuacaacgcgcccuuccgcggccgggccacccugagcaucgacacguuccgcaaccaguucuuccuccggcugaccuccaugaccgccgacgacaccgccguguacuacugcgucaagcacaaguaccacgacaucgugauggugguccccaucgccgggugguucgacccguggggccagggccuccaggugacggugagccag

SEQ ID NO: 10487 - RNA, 399 nt, Artificial Sequence
  derived and/or modified sequence opt1 from anti-HIV-1_HeavyChain
gaggugcaccuccaggagagcggccccgggcucguccgcccgcuggagacccugucccugaccugcacggccagcggcgccuccauccgcgggggcgaguggggcgacaacgacuaccacugggggugggugcggcacagccccgagaagggccuggaguggaucggguccauccacuggcggggcaccacccacuacaacgcgcccuuccgcgggcgggccacccugagcaucgacacgucccgcaaccaguucuuccuccggcugaccagcaugaccgccgacgacaccgccguguacuacugcgucaagcacaaguaccacgacaucgugauggugguccccaucgccggcugguucgacccgugggggcagggccugcgcggcacgguguccgcg

SEQ ID NO: 10488 - RNA, 393 nt, Artificial Sequence
  derived and/or modified sequence opt1 from anti-HIV-1_HeavyChain
caggugcagcugguccagagcggcgccgugaucaagacccccggguccagcgugaagaucuccugccgcgccagcggcuacaacuuccgggacuacuccauccacuggguccgccucaucccggacaagggguucgaguggaucggcuggaucaagccccuguggggcgcggugagcuacgcccggcagcugcaggggcgcguguccaugacccggcagcucagccgcgaccccgacgaccccgacuggggcgucgccuacauggaguucuccgggcugacgccggccgacaccgccgaguacuucugcgugcggcgcggcagcugcgacuacugcggggacuuccccuggcaguacuggggccaggggaccguggucgugguguccagcgcg

SEQ ID NO: 10489 - RNA, 393 nt, Artificial Sequence
  derived and/or modified sequence opt1 from anti-HIV-1_HeavyChain
caggugcagcugguccagagcggcgccgugaucaagacccccggguccagcgugaagcucuccugccgcgccagcggcuacaacuuccgggacuacuccauccacuggguccgccugaucccggacaagggguucgaguggaucggcuggaucaagccccuguggggcgcggugagcuacgcccggcagcuccaggggcgcguguccaugacccggcagcugagccaggaccccgacgaccccgacuggggcgucgccuacauggaguucuccgggcugacgccggccgacaccgccgaguacuucugcgugcgccggggcagcugcgacuacugcggggacuuccccuggcaguacuggggccaggggaccguggucgugguguccagcgcg

SEQ ID NO: 10490 - RNA, 303 nt, Artificial Sequence
  derived and/or modified sequence opt1 from anti-HIV-1_LightChain
accgccggccugacccagagccccgggacgcucucccugagcccgggcgagcgcgccauccuguccugccggaccagccaguacgggucccucgccugguaccagcagcgccccggccaggcgccccggcuggugaucuacgccgggcugacccgcgccaccggcauccccgaccgguucagcggcucccgcuggggcgccgaguacaaccucacgaucagcaaccuggaguccgaggacuucgggguguacuacugccagcaguacgacuucuucgggcagggcaccaagguccagguggac

SEQ ID NO: 10491 - RNA, 378 nt, Artificial Sequence
  derived and/or modified sequence opt1 from anti-HIV-1_HeavyChain
caggugcagcugguccagagcggcuccggggugaagaagcucggcgccagcgugcgcgucuccugcuggaccagcgaggacaucuucgagcggaccgagcugauccacugggugcgccaggcccccgggcagggccuggaguggaucgggugggugaaggcggucuccggcgccgugaacuacggcagccucgacuuccggcaccgcgugucccugacgcgggaccgcgaccugagcaccgcccacauggacauccgggggcucacccaggacgacaccgccacguacuucugcgcccgccagaaguucgcgcggggcgaccaggggugguucuucgaccuguggggccgcgggacccugaucgucguguccagcgcc

SEQ ID NO: 10492 - RNA, 384 nt, Artificial Sequence
  derived and/or modified sequence opt1 from anti-HIV-1_HeavyChain
caggugcagcugguccagagcggcuccggggugaagaagcucggcgccagcgugcgcgucuccugcuggaccagcgaggacaucuucgagcggaccgagcugauccacugggugcgccaggcccccgggcagggccuggaguggaucgggugggugaaggcggucacgggcaccgugaacuucggcucccucaacuuccggcagcgcgugagccugacccgggaccgcgaccuguucaccgcccacauggacauccgggggcucacgcagggcgacaccgccaccuacuucugcgcccgccagaaguucgagaaguacaccgggggccaggggugguacuucgaccuguggggccggggcacgcugaucgucguguccagcgcc

SEQ ID NO: 10493 - RNA, 378 nt, Artificial Sequence
  derived and/or modified sequence opt1 from anti-HIV-1_HeavyChain
caggugcagcugguccagagcggcuccgccaugaagaagcccggggccagcgugcgcguguccugcuggaccagcgaggacaucuucgacaccacggagcucaucuacuggguccggcaggcgccgggccaggggcuggaguggaucggcugggugaagaucguguccgggaccgucaacuucgccagccuggacuuccgcaaccggaucucccucagccgcgaccgggaccuguucaccgcccacauggacauccgcggccugacccagggcgacacggccaccuacuucugcgcccggcagaaguucuacgccgggggccaggggugguacuucgaccucuggggccgcgggacccugaucgugguguccagcgcg

SEQ ID NO: 10494 - RNA, 387 nt, Artificial Sequence
  derived and/or modified sequence opt1 from anti-HIV-1_HeavyChain
caggugcagcugguccagagcggcgccgaggugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugacccaggacgacacggccaccuacuucugcgcccggcagaaguucgagucccgcuacaccggcgggcagggcugguacuucgaccucugggggcggggcacccacaucguggucagcuccgcg

SEQ ID NO: 10495 - RNA, 387 nt, Artificial Sequence
  derived and/or modified sequence opt1 from anti-HIV-1_HeavyChain
caggugcagcugguccagagcggcuccgccaugaagaagcccggggccagcgugcgcguguccugcuggaccagcgaggacaucuucgagcggaccgagcucaucuacuggguccgccaggcgccgggccgggggcuggaguggaucggcugggugaagacgguguccgggaccgucaacuucggcagcuccgacuuccgcaaccggaucagccugacccgcgaccgggaccucuccaccgcccacauggacauccgcggccugacgcaggacgacaccgccaccuacuucugcgcccggcagaaguucgagagccuguacuccgacgaccaggggagcuacuucgaccucuggggccgcgggacccugaucaucguguccagcgcc

SEQ ID NO: 10496 - RNA, 387 nt, Artificial Sequence
  derived and/or modified sequence opt1 from anti-HIV-1_HeavyChain
caggugcagcugguccagagcggccucgaggugaagaagcccggggccuccgugcgcgucagcugcuggaccuccgaggacaucuucgacaccacggagcugaucuacugggugcggcaggccccgggccaggggcuggaguggaucggcugggugaagaucgucagcgggaccgugaacuucgcgucccucgacuuccgcaaccggaucagccugucccgcgaccgggaccugagcaccgcccacauggacauccgcggccucacccaggacgacacggccaccuacuucugcgcccggcagaaguucgccucccgcuacagcggcgaccagggguccuacuucgaccuguggggccgggggacccugaucaucgugagcuccgcg

SEQ ID NO: 10497 - RNA, 387 nt, Artificial Sequence
  derived and/or modified sequence opt1 from anti-HIV-1_HeavyChain
caggugcagcugguccagagcgccuccggcgugcgccggcccggggccagcgugcgcgucuccugcuggaccagcgaggacaucuucgagcgguccgagcucaucuacugggugcgccaggcgccgggccgggggcuggaguggaucggcuggaucaagcuggugagcggggccgucaacuucggcuccguggacuuccgcgaccgggugagccucacccgcgaccgggaccuguucacggcccacauggacauccgcggccugacccaggacgacaccgccaccuacuucugcgcccggcagaaguucgcgucccgcuacagcggggaccagggcuccuacuucgaccucugggggcggggcacgcugaucaucgucagcuccgcc

SEQ ID NO: 10498 - RNA, 375 nt, Artificial Sequence
  derived and/or modified sequence opt1 from anti-HIV-1_HeavyChain
caggugcagcugguccagagcggcuccggggugaagaagcccggcgccagcgugcgcgucuccugcuggaccagcgaggggaucuucgagaaguccgagcucauccacugggugcggcaggccccgggccaggggcuggaguggaucggcugggugaagaccgucacgggcgcggugaacuucgggcaccagaucagcgaccgcgugucccugacccgggaccgcgaccucuucaccgcccacauggacauccggggccugacccagggggacacggccaccuacuucugcgcccgccagaaguucgagcggggcgggcagggcuggaucuucgaccuguggggccgcgggacccucaucgccgucagcuccgcg

SEQ ID NO: 10499 - RNA, 378 nt, Artificial Sequence
  derived and/or modified sequence opt1 from anti-HIV-1_HeavyChain
caggugcagcugguccagagcggcgccgaggugaagaagcccggggccuccgugcgcgucagcugcuggaccuccgaggacaucuucgagaaguccgagcucauccacugggugcggcaggcgccgggccaggggcuggaguggaucggcugggugaagaccgucacgggggccgugaacuucggcagcagcgacuuccgccagcgggugucccugacccgcgaccgggaccucuucaccgcccacauggacauccgcggccugacccagggggacacggccaccuacuucugcgcccggcagaaguucgagcgcggcgggcagggcugguacuucgaccugugggggcggggcacccucaucgucgugagcuccgcg

SEQ ID NO: 10500 - RNA, 378 nt, Artificial Sequence
  derived and/or modified sequence opt1 from anti-HIV-1_HeavyChain
caggugcagcugguccagagcggcgccgaggugaagcgccccggggccuccgugaaggucagcugcuggaccuccgaggacaucuucgagcggaccgagcucauccacugggugcgccaggcgccgggccaggggcuggaguggaucggcugggugaagacggucagcggggccgugaacuucggcucccccaacuuccggcaccgcgugagccugacccgggaccgcgaccucuucaccgcccacauggacauccggggccugacccagggggacacggccaccuacuucugcgcccgccagaaguucgagcggggcgggcagggcugguacuucgaccugugggggcgcggcacccucaucgucguguccagcgcg

SEQ ID NO: 10501 - RNA, 378 nt, Artificial Sequence
  derived and/or modified sequence opt1 from anti-HIV-1_HeavyChain
caggugcagcugguccagagcggcuccggggugaagaagcccggcgccagcgugcgcgucuccugcuggaccagcgaggacaucuucgagggguccgagcucauccacugggugcggcaggccccgggccaggggcuggaguggaucggcugggugaagaccgucacgggcgcggugaacuucgggagcgccuacuuccgccaccgggugucccugacccgcgaccgggaccucuucaccgcccacauggacauccgcggccugacccagggggacacggccaccuacuucugcgcccggcagaaguucaugagcggcgggcagggcugguacuucgaccuguggggccgcgggaccgucaucgugguguccagcgcg

SEQ ID NO: 10502 - RNA, 387 nt, Artificial Sequence
  derived and/or modified sequence opt1 from anti-HIV-1_HeavyChain
caggugcagcugguccccagcggcuccggggugaagaagccgggcgccagcgugcgcgucuccugcuggaccagcgaggacaucuucgagcggaccgagcucauccacugggugcgccaggcccccgggcagggccuggaguggaucgggugggugaagacggucaccggcgcggugaacuucggcucccuggacuuccggcaccgcaucagccucacccgggaccgcgaccuguucaccgcccacauggacauccgggggcugacgcagggcgacaccgccaccuacuucugcgcccgccagaaguucgagucccgguacaccgggggccaggggugguacuucgaccucuggggccgcggcacgcacaucguggucagcuccgcc

SEQ ID NO: 10503 - RNA, 378 nt, Artificial Sequence
  derived and/or modified sequence opt1 from anti-HIV-1_HeavyChain
caggugcagcugguccagagcggcuccggggugaagaaggugggcgccagcguccgcguguccugcuggaccagcgaggacaucuucgagcggaccgagcucauccacugggugcgccaggcccccgggcagggccuggaguggaucgggugggucaaggcgguguccggcgccgugaacuacggcagccuggacuuccggcaccgcgucucccucacgcgggaccgcgaccuguucaccgcccacauggacauccgggggcugacccaggacgacaccgccaucuacuucugcgcccgccagaaguucuacgcgggcgggcagggcugguacuucgaccucugggggcggggcacgcugaucguggugagcuccgcc

SEQ ID NO: 10504 - RNA, 387 nt, Artificial Sequence
  derived and/or modified sequence opt1 from anti-HIV-1_HeavyChain
caggugcagcugguccagagcggcgccgaggugaagaagcccggguccagcgugcgcgucuccugcuggaccagcgaggacaucuucgagcggaccgagcucauccacugggugcgccaggccccgggccaggggcuggaguggaucggcugggugaagacggucaccggggcggugaacuucggcucccccaacuuccggcaccgcgugagccugacccgggaccgcgaccucuucaccgcccacauggacauccggggccugacgcagggggacaccgccaccuacuucugcgcccgccagaaguucgagucccgguacagcggcgaccagggguccuacuucgaccuguggggccgcgggacccucaucaucgucagcuccgcc

SEQ ID NO: 10505 - RNA, 375 nt, Artificial Sequence
  derived and/or modified sequence opt1 from anti-HIV-1_HeavyChain
caggugcagcugguccagagcggcgccgaggugaagaagcccggggccuccgugaaggucagcugcaaggcguccggcuacaccuucaccagcuacuacaugcacugggugcgccaggccccggggcagggccucgaguggaucgggugggugaagcccgucacgggcgccgugaacuucggcucccccaacuuccggcaccgcgugagccugacccgggaccgcgaccuguucaccgcccacauggacauccgggggcucacccagggcgacacggccaccuacuucugcgcgcgccagaaguacuacgccgggggccaggggugguacuucgaccuguggggccggggcacccugaucgucguguccagcgcc

SEQ ID NO: 10506 - RNA, 375 nt, Artificial Sequence
  derived and/or modified sequence opt1 from anti-HIV-1_HeavyChain
caggugcagcugguccagagcggcgccgaggugaagaagcccggggccuccgugcaggucagcugcaaggcguccggcuacccguucaccaaguacuacaugcacugggugcgccaggcccccgggcagggccucgaguggaucgggugggugaaggccgucagcggcgccgugaacuacggcucccuggacuuccggcaccgcgugagccugacccgggaccgcgaccucuccacggcccacauggacauccgggggcugacccaggacgacaccgcgaccuacuucugcgcccgccagaaguucgcccggggcgaccaggggugguucuucgaccuguggggccgcgggacgcucaucgucgugagcuccgcc

SEQ ID NO: 10507 - RNA, 375 nt, Artificial Sequence
  derived and/or modified sequence opt1 from anti-HIV-1_HeavyChain
caggugcagcugguccagagcggcgccgaggugaagaagcccggggccuccgugaaggucagcugcaaggcguccggcuacaccuucaccggguacuacaugcacugggugcgccaggccccgggccaggggcucgaguggaucggcugggugaagacggucagcggcgccgugaacuucgggucccugaacuuccggcaccgcgugagccugacccgggaccgcgaccucuucaccgcccacauggacauccggggccugacccagggggacacggccaccuacuucugcgcgcgccagaaguucgcccggggcgaccaggggugguucuucgaccuguggggccgcggcacccucaucgucguguccagcgcc

SEQ ID NO: 10508 - RNA, 402 nt, Artificial Sequence
  derived and/or modified sequence opt1 from anti-HIV-1_HeavyChain
caggugcagcugguccagagcggcuccggggugaagaagcccggcgccagcgugcgggucuccugccgggccagcgaggaccucuucggggacgagaucaucuacgacgacgaggugauccacuggcugcgccaggugccgggccagcggcccgaguggaugggguggauccgccccaagaccggcgcgcggaaccaggcccgccaguuccagccccggaucucccugacccgcgaccgggcccucagcacggccuaccuggaccugaacucccucaccagcgccgacuccggcaccuacuucugcgcgcgccagaccuucaagccggacuucuacuucgccgaccagggguggagcuucaaccuguggggccgcggggcccacuucaucgucuccagcgcc

SEQ ID NO: 10509 - RNA, 381 nt, Artificial Sequence
  derived and/or modified sequence opt1 from anti-HIV-1_HeavyChain
caggugcagcugguccagagcggcgggggcgugaagaagcccggggccuccgccagcuucuccugccgcaccagcgaggacccguucgacaacgaguucuucgacuccgaguucaugcacugggugcggcucacccccggccagcgccccgaguggaugggguggaugaacccccggagcggcggcgucaacuacgcggggcaguuccgcccgcggauguccauguggcgcgaccgggagcugagcacggccuacauggagcugcgcgaccucaccuucgccgacaccggccuguacuucugcgcccggcgcaaggaggacgacuacgacugguacuacgaccugugggggcggggcgcccacaucaucguguccgcggcc

SEQ ID NO: 10510 - RNA, 384 nt, Artificial Sequence
  derived and/or modified sequence opt1 from anti-HIV-1_HeavyChain
caggugcagcugguccaggccggcgggggcgugaagaagcccggggccagcgugacccucuccugcaagaccgcggacgaggacgucuucgacgccgccuacaugcacugggugcgccaggccccgggccagacguucgaguggcugggguggaugaagcccgugaccggcgccgucaacuacgcgcggaaguuccagggccgcgugagcuucuaccggacccgcgagcuggggaucgccuacauggaccuccggaaccugcgcuucgacgacaccgccguguacuucugcgcccggaagacggcgggcgacgucuccggggacaagcgcggcuucuucuucgaccugugggggcggggcagccgcgugaucguguccagcgcc

SEQ ID NO: 10511 - RNA, 384 nt, Artificial Sequence
  derived and/or modified sequence opt1 from anti-HIV-1_HeavyChain
caggugcagcugguccagagcggcgccgaggugaagaagcccggggccuccgugacccucagcugcaagaccgcggacgaggacgucuucgacgccgccuacaugcacugggugcgccaggccccgggccagacguucgaguggcugggguggaugaagcccgugaccggcgccgucuccuacgcgcggaaguuccaggggcgcgugagcuucuacaugacccgggagcugggcauggccuacauggaccuccgcaaccugcgguucgacgacaccgccguguacuucugcgcccgcaagacggcgggcgacgucuccggggacaaccggggcuacuucuucgaccugugggggcgcggcagccgggugaucguguccagcgcc

SEQ ID NO: 10512 - RNA, 384 nt, Artificial Sequence
  derived and/or modified sequence opt1 from anti-HIV-1_HeavyChain
caggugcagcugguccagagcgaggccgaggugaagaagcccggcgccuccaugaccgugagcugcgagaccgcggacgaggacaucuucgacgccgccuacaugcacuggguccgccaggccccggggcagacguucgaguggcucggcuggaugaagcccgugaccggggccgugaacuacgcgcggaaguuccagggccgcaucuccuucuaccggacccgcgagcuggccaucgccuacauggaccugcgggaccuccgcuucgacgacaccgccgucuacuucugcgcgcggaagacggccggggacgugagcggcgacaaccgcggcuacuucuucgaccugugggggcggggcucccgcgugaucgucagcuccgcc

SEQ ID NO: 10513 - RNA, 420 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcuccugugggugcggcaggcgccgggccaggggcuggaguggaucggcugggugaagaucgucagcgggaccgugaacuucgccucccucgacuuccgcaaccggaucagccugucccgcgaccgggaccugagcaccgcccacauggacauccgcggccucacccaggacgacacggccaccuacuacugcgcccggcagaaguucgcgucccgcuacagcggcgaccagggguccuacuucgaccuguggggccgggggacccugaucaucgugagcuccgccagcaccaagggccccuccgucuucccccacgaccuc

SEQ ID NO: 10514 - RNA, 417 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucaucuacugggugcgccaggcgcccggccgggggcuggaguggaucggcugggugaagacggucagcgggaccgugaacuucggcuccagcgacuuccgcaaccggaucucccugacccgcgaccgggaccucuucaccgcccacauggacauccgcggccugacgcagggggacaccgccaccuacuucugcgcccggcagaaguucgagcgcggcgggcagggcugguacuucgaccugugggggcggggcacccucaucguggucagcuccgccagcacgaacggccccaucgggcugccgccccgcuccgcg

SEQ ID NO: 10515 - RNA, 423 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucgagucccuguacagcgacgaccagggguccuacuucgaccucuggggccgcgggacccugaucaucgugagcuccgcgagcaccaagggccccuccagcucccccacgaucugc

SEQ ID NO: 10516 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccccaacuuccggcaccgcgucucccugacccgggaccgcgaccucuucaccgcccacauggacauccgggggcugacccagggcgacacggccaccuacuucugcgcccgccagaaguucgagcgcgggggccaggggugguacuucgaccuguggggccggggcacccucaucguggugagcuccgcgagcaccaaggggcccuccgucuucccccacgaccugcgg

SEQ ID NO: 10517 - RNA, 411 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccccaacuuccggcaccgcgucucccugacccgggaccgcgaccucuucaccgcccacauggacauccgggggcugacccagggcgacacggccaccuacuucugcgcccgccagaaguucgagcgcgggggccaggggugguacuucgaccuguggggccggggcacccucaucguggugagcuccagccugcaccaggggcccuccggccugccccacgac

SEQ ID NO: 10518 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucuacgccgggggccaggggugguacuucgaccuguggggccgcggcacccucaucgugguguccagcgcguccaccaaggggcccagcgucuucccccacgaccugcgg

SEQ ID NO: 10519 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccccaacuuccggcaccgcgucucccugacccgggaccgcgaccucuucaccgcccacauggacauccgggggcugacccagggcgacacggccaccuacuacugcgcccgccagaaguucgagagccuguacuccgacgaccaggggagcuacuucgaccucuggggccgggggacccugaucaucguguccagcgcguccaccaagggccccagcguguucccccacgaccugcgc

SEQ ID NO: 10520 - RNA, 384 nt, Artificial Sequence
  derived and/or modified sequence opt1 from anti-HIV-1_HeavyChain
caggugcaccuggagcagagcggcuccggggucaagaagcccggcgccagcgugcgcguguccugcuggaccagcgaggacaucuucgagaaguccgagcucauccacuggguccggcaggccccggggcagggccuggaguggaucgggugggugaagaccgugacgggcgcggucaacuucggcagcuccgacuuccgccagcgggugagccugacccgcgaccgggaccucuucaccgcccacauggacauccgcgggcugacccagggcgacacggccaccuacuucugcgcccggcagaaguucgagucccgcuacaccgggggccaggggugguacuucgaccuguggggccggggcacccacaucguggucagcucc

SEQ ID NO: 10521 - RNA, 423 nt, Artificial Sequence
  derived and/or modified sequence opt1 from anti-HIV-1_HeavyChain
cagguguacauggagcaggccggcgccggggucaagaagcccggcgcgagcgugacccuguccugcaagaccgccgacgaggacguguucgacgccgccuacaugcacuggguccgccaggccccggggcagacguucgaguggcucggcuggaugaagcccgugaccggggcggugaacuacgcccggaaguuccagggccgcgucagcuucuaccggacccgcgagcugggcaucgccuacauggaccugcggaaccuccgcuucgacgacaccgccguguacuucugcgcgcggaagacggccggggacguguccggcgacaagcgcggguucuucuucgaccuguggggccgggggagccgcgucaucguguccagcgccuccaccaagggccccagcguguucccccacgaccugcgg

SEQ ID NO: 10522 - RNA, 414 nt, Artificial Sequence
  derived and/or modified sequence opt1 from anti-HIV-1_HeavyChain
caggcccaccuggagcagagcggcuccggggugaagaagcccggcaccagcguccgcguguccugcuggaccagcgaggacaucuucgagcggacggagcucauccacugggugcgccaggccccggggcagggccuggaguggaucgggugggucaagaccgugaccggcgcggugaacuucggcucccccaacuuccggcaccgcgucagccugacccgggaccgcgaccucuucacggcccacauggacauccgggggcugacccagggcgacaccgccaccuacuucugcgcccgccagaaguucgcccgcggggaccagggcugguucuucgaccugugggggcggggcacgcucaucgugguguccagcgcguccaccaagggccccagcgucuuccccaccaucugc

SEQ ID NO: 10523 - RNA, 411 nt, Artificial Sequence
  derived and/or modified sequence opt1 from anti-HIV-1_HeavyChain
caggugcagcugguccagagcggcgccgaggugaagaagcccggggccuccgugaaggucagcugcaaggcguccggcuacaccuucaccagcuacuacaugcacugggugcgccaggccccggggcagggccucgaguggaucgggugggugaagcccgucacgggcgccgugaacuucggcucccccaacuuccggcaccgcgugagccugacccgggaccgcgaccuguucaccgcccacauggacauccgggggcucacccagggcgacacggccaccuacuucugcgcgcgccagaaguacuacgccgggggccaggggugguacuucgaccuguggggccggggcacccugaucgucguguccagcgccuccaccaaggggcccguggucuucccgacgaucugc

SEQ ID NO: 10524 - RNA, 381 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugaacuacgcgcggaaguuccagggccgcgucagcuucuaccggacccgcgagcuggggaucgccuacauggaccugcggaaccuccgcuucgacgacaccgccguguacuucugcgcccggaagacggcgggcgacguguccggggacaagcgcggcuucuucuucgaccugugggggcggggcagccgcgucaucguguccagc

SEQ ID NO: 10525 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucggguggaucaagacggucaccggcgccgugaacuucggcucccuggacuuccggcaccgcaucagccucacccgggaccgcgaccuguucaccgcccacauggacauccgggggcugacgcagggcgacaccgccaccuacuucugcgcccgccagaaguucgagucccgguacaccgggggccaggggugguacuucgaccucuggggccgcggcacgcacaucguggucagcucc

SEQ ID NO: 10526 - RNA, 420 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucaucuacugggugcgccaggcgccgggccgggggcuggaguggaucggcugggugaagacggucagcgggaccgugaacuucggcuccagcgacuuccgcaaccggaucucccugacccgcgaccgggaccucagcaccgcccacauggacauccgcggccugacgcaggacgacaccgccaccuacuucugcgcccggcagaaguucgagcgcgggggccaggggugguacuucgaccuguggggccgggggacccucaucguggucuccagcgccuccacggagggccccagccgcuccuucccccagauccugcgg

SEQ ID NO: 10527 - RNA, 414 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucuacgccgggggccaggggugguacuucgaccuguggggccgcggcacccucaucugcguguccagcgcgagcccccgggcccaccgcuccagcccccgguccgcc

SEQ ID NO: 10528 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccuggacuuccggcaccgcaucucccucacccgggaccgcgaccuguucaccgcccacauggacauccgggggcugacccgcggcgacacggccaccuacuacugcgcccggcagaaguucgagagccgcuacaccgggggccaggggugguacuucgaccucuggggccggggcacccacaucgucguguccagc

SEQ ID NO: 10529 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccuggacuuccggcaccgcaucucccucacccgggaccgcgaccuguucaccgcccacauggacauccgggggcugacccagggcgacacggccaccuacuucugcgcccgccagaaguucgagagccgguacaccgggggccaggggugguacuucgaccucuggggccgcggcacccacaucaucgucuccagc

SEQ ID NO: 10530 - RNA, 423 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacgagcaucuucaucggcugcgaccggccgcucgacaaggacugguccgggcugggcgggagcaagcugucccucgcgcccagcaucuucgccucccuggacuuccgcaaccggaucagccugucccgcgaccgggaccucagcaccgccuacauggacauccgcggccugacccaggacgacaccgccacguacuucugcgcccggcagaaguucgcgucccgcuacagcggcgaccagggguccuacuucgaccuguggggccgggggacccucaucguggugagcuccgccagcaccaagggccccagcgucuucccccacgaccug

SEQ ID NO: 10531 - RNA, 399 nt, Artificial Sequence
  derived and/or modified sequence opt1 from anti-HIV-1_HeavyChain
cgcgaguaccuggagcagagcggcgggggcgugaagaagcucggggccuccguccgggugagcugccgcgccuccgaggaccuguucggcgacgaggugaucuacgacgacgagcugauccacuggcuccggcagguccccgggcagcgcccggaguggaugggcuggauccggcccaagaccggcgcgcgcaaccaggcccggcaguuccagccccgcaucaaccugagccgggaccgcgcccugaacaccgccuaccucgaccuguccagccugacguccgccgacagcgcgaccuacuucugcgcccggcagaccuucaagcccgacuucuacuucgccgaccaggggugguccuucaaccucuggggccgcggggcccgggugaucgugagcucc

SEQ ID NO: 10532 - RNA, 384 nt, Artificial Sequence
  derived and/or modified sequence opt1 from anti-HIV-1_HeavyChain
caggugcaccugguccagagcggcgccgaggugaagaagcccggguccagcgugcgcgucuccugcuggaccagcgaggacaucuucgagcggaccgagcucauccacugggugcgccaggccccgggccaggggcuggaguggaucggcugggugaagacggucaccggggcggugaacuucggcucccccaacuuccggcaccgcgugagccugacccgggaccgcgaccucuucaccgcccacauggacauccggggccugacgcagggggacaccgccaccuacuucugcgcccgccagaaguucgagucccgguacagcggcgaccagggguccuacuucgaccuguggggccgcgggacccucaucaucgucagcucc

SEQ ID NO: 10533 - RNA, 414 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagaucguguccggcgccgugaacuucggcagccccaacuuccggcagcgcgucucccugacgcgggaccgcgaccucuucaccgcccacauggacauccgggggcugacccagggcgacaccgccacguacuucugcgcccgccagaaguucgagcgcgggggccagggguggaucuucgaccuguggggccggggcacccucaucgcggugagcuccgccagcaccaaggggcccuccguguuccccaccaucugc

SEQ ID NO: 10534 - RNA, 441 nt, Artificial Sequence
  derived and/or modified sequence opt1 from anti-HIV-1_HeavyChain
cgcgaguuccuggagcagagcggcgggggcgugaagaagcucggggccucccugcgggucagcugccgcgccuccgaggaccuguucggcgacgaguucaucuacgacgacgaggugauccacuggcuccgccaggugcccgggcagcggccggaguggaugggcuggauccggcccaagaccggcgcgcgcaaccaggccacccaguuccagccccggaucagccugacgcgcgaccgggcccuguccaccgccuaccucgaccugaacagccugaccuccgccgacagcgggaccuacuucugcgcgcgccagacguucaagcccgacuucuacuucgccgaccagggcugguccuucaaccucugggggcggggcgcccacuucaucgucagcuccgccagcaccaaggggccguccguguucccccacgacagcgcg

SEQ ID NO: 10535 - RNA, 399 nt, Artificial Sequence
  derived and/or modified sequence opt1 from anti-HIV-1_HeavyChain
cgcgaguaccuggagcagagcggcgggggcgugaagaagcucggggccucccugcgggucagcugccgcgccuccgaggaccuguucggcgacgagaucaucuacgacgacgaggugauccacuggcuccgccaggugcccgggcagcggccggaguggaugggcuggauccggcccaagaccggcgcgcgcaaccaggcccggcaguuccagccccgcaucagccugacccgggaccgcgcccuguccacggccuaccucgaccugaacagccugaccuccgccgacagcgggaccuacuucugcgcgcggcagaccuucaagcccgacuucuacuucgccgaccagggcugguccuucaaccucugggggcgcggcgcccacuucaucgucagcucc

SEQ ID NO: 10536 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccuggacuuccggcaccgcaucucccucacccgggaccgcgaccuguucaccgcccacauggacauccgggggcugacccagggcgacacggccaccuacuucugcgcccgccagaaguucgagagccgguacaccgggggccaggggugguacuucgaccucuggggccgcggcacccacaucgucguguccagc

SEQ ID NO: 10537 - RNA, 381 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugagcuacgcgcggaaguuccagggccgcgucuccuucuacaugacccgggagcuggggauggccuacauggaccugcgcaaccuccgguucgacgacaccgccguguacuucugcgcccgcaagacggcgggcgacgugagcggggacaaccggggcuacuucuucgaccugugggggcgcggcucccgggucaucgugagcucc

SEQ ID NO: 10538 - RNA, 414 nt, Artificial Sequence
  derived and/or modified sequence opt1 from anti-HIV-1_HeavyChain
caggcccaccuggagcagagcggcaccggggugaagaagcccggcgccuccguccgcgugagcugcuggaccuccgaggacaucuucgagaaguccgagcucauccacugggugcggcaggcgccggggcagggccuggaguggaucgggugggucaagaucgugagcggcgccgugaacuucggcagccccaacuuccgccagcgggucucccugacgcgcgaccgggaccucuucaccgcccagauggacauccgcgggcugacccagggcgacaccgccacguacuucugcgcccggcagaaguucgagcgcgggggccagggguggaucuucgaccuguggggccggggcacccucaucgcggugagcuccgccagcaccaaggggcccuccguguucccccacgaccug

SEQ ID NO: 10539 - RNA, 399 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccugagcaccgcccacauggacauccgggggcucacccaggacgacaccgccacguacuucugcgcgcgccagaaguucgcccggggcgaccaggggugguucuucgaccuguggggccgcgggacccugaucgugguguccagcgccuccaccaagggcccgagcggc

SEQ ID NO: 10540 - RNA, 414 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccacgaccgggaccucuucaccgcccacauggacauccgcgggcugacgcagggcgacaccgccaccuacuucugcgcccggcagaaguucuacgccgggggccaggggugguacuucgaccuguggggccgcggcacccucaucugcguguccagcgcguccacgaaggggcccagcggccugcccccgcggucc

SEQ ID NO: 10541 - RNA, 426 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccugagcaccgcccacauggacauccgggggcucacccaggacgacaccgccacguacuucugcgcgcgccagaaguucgagucccuguacagcgacgaccagggcuccuacuucgaccugugggggcggggcacccucaucaucgugagcuccgccagcaccaaggggccguccguguucccccacgaccugcgc

SEQ ID NO: 10542 - RNA, 414 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccccaacuuccggcaccgcgucucccugacccgggaccgcgaccucuucaccgcccacauggacauccgggggcugacccagggcgacacggccaccuacuacugcgcccgccagaaguucgagcgcgggggccaggggugguacuucgaccuguggggccggggcacccucaucguggugagcuccgcgagcaccaaggggcccuccgucuuccccacgaucuac

SEQ ID NO: 10543 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccuggacuuccggcaccgcaucucccucacccgggaccgcgaccuguucaccgcccacauggacauccgggggcugacccagggcgacacggccaccuacuacugcgcccgccagaaguucgagagccgguacaccgggggccaggggugguacuucgaccucuggggccgcggcacccacaucgucguguccagc

SEQ ID NO: 10544 - RNA, 414 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagggguccgagcucauccacugggugcggcaggcgccgggccaggggcuggaguggaucggcugggucaagaccgugacgggcgccgugaacuucgggagcgccuacuuccgccaccgggucucccugacccgcgaccgggaccucuucaccgcccacauggacauccgcggccugacccagggggacacggccaccuacuacugcgcgcggcagaaguucuacaagggcgggcagggcugguacuucgaccuguggggccgcgggacccucaucguggugagcuccgccagcaccaagggccccuccgucuuccccacgaucugc

SEQ ID NO: 10545 - RNA, 399 nt, Artificial Sequence
  derived and/or modified sequence opt1 from anti-HIV-1_HeavyChain
cgcgaguaccuggagcagagcggcgggggcgugaagaagcccggggccuccguccgggugagcugccgcgccuccgaggaccucuucggcgacgagaucaucuacgacgacgaggugauccacuggcugcggcaggucccggggcagcgccccgaguggaugggcuggauccggcccaagaacggcgggcgcaaccaggcgcggcaguuccagccccgcaucagccugacccgggaccgcgcccucaacaccgccuaccuggaccugaacucccucacgagcgccgacuccggcaccuacuucugcgcccggcagaccuucaagccggacuucuacuucgcggaccagggguggagcuucaaccuguggggccgcggggcccgggugaucguguccagc

SEQ ID NO: 10546 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccugagcaccgcccacauggacauccgggggcucacccaggacgacaccgccacguacuucugcgcgcgccagaaguucgcccggggcgaccaggggugguucuucgaccuguggggccgcgggacccugaucgugguguccagc

SEQ ID NO: 10547 - RNA, 420 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugagcuacgcgcggaaguuccagggccgcgucuccuucuacaugacccgggagcuggggauggccuacauggaccugcgcaaccuccgguucgacgacaccgccguguacuucugcgcccgcaagacggcgggcgacgugagcggggacaaccggggcuacuucuucgaccugugggggcgcggcucccgggucaucgugagcuccgccagcaccaagggccccuccguguuccccaccaucugc

SEQ ID NO: 10548 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagggguccgagcucauccacugggugcggcaggcgccgggccaggggcuggaguggaucggcugggucaagaccgugacgggcgccgugaacuucgggagcgccuacuuccgccaccgggucucccugacccgcgaccgggaccucuucaccgcccacauggacauccgcggccugacccagagcgacacggccaccuacuucugcgcgcggcagaaguucuacgccgggggccaggggugguacuucgaccuguggggccgcggcacccucaucgugguguccagcgccuccaccaaggggcccagcgucuucccccacgaccugcgg

SEQ ID NO: 10549 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucaucuacugggugcgccaggcgccgggccgggggcuggaguggaucggcugggugaagacggucagcgggaccgugaacuucggcuccagcgacuuccgcaaccggaucucccugacccgcgaccgggaccucagcaccgcccacauggacauccgcggccugacgcaggacgacaccgccaccuacuucugcgcccggcagaaguucgagucccuguacagcgacgaccagggguccuacuucgaccucuggggccgcgggacccugaucaucgugagcuccgccagccccaagggccccuccgggcugcccccgcggagcgcg

SEQ ID NO: 10550 - RNA, 411 nt, Artificial Sequence
  derived and/or modified sequence opt1 from anti-HIV-1_HeavyChain
caggugcagcugguccagagcggcgccgaggugaagaagcccggggccuccgugaaggucagcugcaaggcguccggcuacaccuucaccacguacgggaucagcugggugcgccaggccccgggccaggggcucgaguggaucggcugggugaagaccgucaccggcgccgugaacuucgggcaccagaucuccgaccgggugagccugacccgcgaccgggaccuguucacggcccacauggacauccgcggccucacccagggggacaccgccaccuacuucugcgcgcggcagaaguucuacgccggcgggcagggcugguacuucgaccuguggggccgcgggacgcugaucgucguguccagcgccuccaccaagggccccagcguguucccccacgaccuccgg

SEQ ID NO: 10551 - RNA, 417 nt, Artificial Sequence
  derived and/or modified sequence opt1 from anti-HIV-1_HeavyChain
caggcccagcuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcuccagcgacuuccggcagcgcgucucccugacccgggaccgcgaccucuucaccgcccacauggacauccgggggcugacgcagggcgacaccgccaccuacuucugcgcccgccagaaguucuacgccgggggccaggggugguacuucgaccuguggggccggggcacccucaucguggugagcuccgcgagcacgaaggggcccuccgucuucccccacgaccugcgc

SEQ ID NO: 10552 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacgcagggcgacaccgccaccuacuacugcgcccgccagaaguucgagcgcgggggccaggggugguacuucgaccuguggggccggggcacccucaucgugguguccagc

SEQ ID NO: 10553 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuacugcgcccggcagaaguucgagucccgcuacaccgggggccaggggugguacuucgaccuguggggccggggcacccacaucguggugagcucc

SEQ ID NO: 10554 - RNA, 414 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacgcagggcgacaccgccaccuacuucugcgcccgccagaaguucgagcgcgggggccaggggugguacuucgaccuguggggccggggcacccucaucgugguguccagcgcguccacgaaggggcccagcgucuuccccaccaucugc

SEQ ID NO: 10555 - RNA, 381 nt, Artificial Sequence
  derived and/or modified sequence opt1 from anti-HIV-1_HeavyChain
caggugcagcugguccagagcggcgccgaggugcagaagcccggggccuccgugaccgucagcugcaaggcguccggcuacacccucaucagcuacgggaucuccugggugcgccaggccccgggccaggggcccgaguggaugggcuggauccggcccaagacgggcgcccgcaaccaggcccggcaguuccagccccgcaucagccugacccgggaccgcgcccuguccaccgcguaccucgaccugaacagccugaccuccgccgacagcgggacguacuucugcgcccggcagaccuucaagccggacuucuacuucgccgaccagggcugguccuucaaccucugggggcgcggcgcgcacuucaucgugagcucc

SEQ ID NO: 10556 - RNA, 414 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacauccuccggaagaaggagcugauccacugggugcgccaggcgccggggcagggccuggaguggaucgggugggucaagaccgugacgggcaccgugaacuucggcuccagcgacuuccggcagcgcgucucccucacccgggaccgcgaccuguucaccgcccacauggacauccgggggcugacgcagggcgacaccgccaccuaccucugcgcccgccagaaguucgagcgcgggggccagggguggaucuucgaccuguggggccggggcacccugaucgccgugagcuccgcgagcacgaaggggcccuccguguucccccacgaccuc

SEQ ID NO: 10557 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccuggacuuccggcaccgcaucucccucacccgggaccgcgaccuguucaccgcccacauggacauccgggggcugacccagggcgacacggccaccuacuucugcgcccgccagaaguucgagagccgguacaccgggggccaggggugguacuucgaccucuggggccgcggcacccacaucgucguguccagcgcguccacgaacgggcccaucggccugccccaccggagcgcc

SEQ ID NO: 10558 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgggaaguccgagcucauccacugggugcggcaggcgccgggccaggggcuggaguggaucggcugggucaagaccgugacgggcgccgugaacuucgggagcuccgacuuccgccagcgggucagccugacccgcgaccgggaccucuucaccgcccacauggacauccgcggccugacccagggggacacggccaccuacuucugcgcccggcagaaguucgagucccuguacagcgacgaccagggcuccuacuucgaccucugggggcgcggcacccugaucaucgugagcucc

SEQ ID NO: 10559 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagaucguguccggcgccgugaacuucggcagccccaacuuccggcagcgcgucucccugacgcgggaccgcgaccucuucaccgcccacauggacauccgggggcugacccagggcgacaccgccacguacuucugcgcccgccagaaguucgagcgcgggggccaggggugguacuucgaccuguggggccggggcacccucaucguggugagcuccgcgagcaccaaggggcccuccggccugccccacgggagcgcc

SEQ ID NO: 10560 - RNA, 423 nt, Artificial Sequence
  derived and/or modified sequence opt1 from anti-HIV-1_HeavyChain
caggugcaguacggccgcgaggccggggccggcaugaagaagcccggggcgagcaugaccgucuccugcaagaccgccgacgaggacaucuucgacgccgccuacaugcaccgggugcgccaggccccgggccagacguucgaguggcugggguggaugaagcccgugaccggcgcggucaacuacgcccggcaguuccagggccgcgugagcuucuaccggacccgcgagcucgggaucgccuacauggaccugcgggaccugaaguucgacgacaccgccguguacuucugcgcgcgcaagacgaagggcgacgucuccggggacgaccggggcuucuucuucgaccucugggggcgcggcacccgggugaucgugagcuccgccagcaccaagggccccuccgucuuccccaccaucuac

SEQ ID NO: 10561 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccuggacuuccggcaccgcaucagccucacccgggaccgcgaccuguucaccgcccacauggacauccgggggcugacgcagggcgacaccgccaccuacuucugcgcccgccagaaguucgagucccgguacaccgggggccaggggugguacuucgaccucuggggccgcggcacgcacaucgucgugagcuccgcgagcaccaaggggcccuccguguucccccacgaccugcgg

SEQ ID NO: 10562 - RNA, 423 nt, Artificial Sequence
  derived and/or modified sequence opt1 from anti-HIV-1_HeavyChain
caggugcagcugguccagagcgaggccgagcucaagaagcccggcgccuccgugagcguguccugcaaggcgagcggguacuccuucaccagcuacggcaucuccuggguccgccaggugccggggcagggccuggaguggaucgccuggauccggcccaagaccggggcccgcaaccaggcccggcaguuccagccccgcaucagccugacgcgggaccgcgcccucuccaccgcguaccuggaccugaacagccucaccuccgccgacagcggcaccuacuucugcgcccggcagacguucaagcccgacuucuacuucgccgaccagggcugguccuucaaccugugggggcgcggcgcgcacuucaucgugagcuccgccagcaccaaggggccguccgucuucccccacgaccugcgg

SEQ ID NO: 10563 - RNA, 414 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacgcagggcgacaccgccaccuacuacugcgcccgccagaaguucgagcgcgggggccaggggugguacuucgaccuguggggccggggcacccucaucgugguguccagcgcguccacgaaggggcccagcgucuucccccacgaccug

SEQ ID NO: 10564 - RNA, 381 nt, Artificial Sequence
  derived and/or modified sequence opt1 from anti-HIV-1_HeavyChain
caggugcagcugguccagagcggcgccgaggugcagaagcccggggccuccgugaccgucagcugcaaggcguccggcuacacccucaucagcuacgggaucuccugggugcgccaggccccgggccaggggcccgaguggaugggcuggauccggcccaagacgggcgcccgcaaccaggcccggcaguuccagccccgcaucagccugacccgggaccgcgcccuguccaccgcguaccucgaccugaacagccugaccuccgccgacagcgggacguacuacugcgcccggcagaccuucaagccggacuucuacuucgccgaccagggcugguccuucaaccucugggggcgcggcgcgcacuucaucgugagcucc

SEQ ID NO: 10565 - RNA, 414 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccuguucaccgcccacauggacauccgggggcucacccaggacgacaccgccacguacuucugcgcgcgccagaaguucgcccggggcgaccaggggugguucuucgaccuguggggccgcgggacccugaucguggugagcuccgccagcaccaagggcccguccgucuucccccagaucugc

SEQ ID NO: 10566 - RNA, 378 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacgcagggcgacaccgccaccuacuucugcgcccgccagaaguucgagcgcgggggccaggggugguacuucgaccuguggggccggggcacccucaucugcguguccagcgcg

SEQ ID NO: 10567 - RNA, 438 nt, Artificial Sequence
  derived and/or modified sequence opt1 from anti-HIV-1_HeavyChain
cagggcuaccuggcccagagcgggggcggggugaagaagcccggcaccuccgccagcuucuccugccgcaccagcgacgacaucuacgacaacgaguucuucgacuccgcguucaugcacuggguccggcucaucccggggcagcgccccgaguggaugggcuggaugaacccccggagcggcgccgugaacuacgcccgccagcugcagccccggguguccauguaccgcgaccgggaccugagcacggccuaccucgaccugaacucccugaccagcgccgacuccgggaccuacuucugcgcgcgccagaccuucaagccggacuucuacuucgccgaccagggcuggagcuucaaccucugggggcggggcgcccacuucaucgucuccagcgccuccacgaaggggcccagcgugcugccccacgaccugcgc

SEQ ID NO: 10568 - RNA, 414 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucacgcacugggugcgccaggcgccggggcagggccuggaguggaucgggugggucaagaucguguccggcgccgugaacuucggcagccccaacuuccggcagcgcgucucccugacccgggaccgcgaccucuucaccgcccacauggacauccgggggcugacccagggcgacacggccaccuacuucugcgcccgccagaaguucgagcgcgggggccagggguggaucuucgaccuguggggccggggcacccucaucgcggugagcuccgccagcaccaaggggcccuccguguucccccggagcgcc

SEQ ID NO: 10569 - RNA, 414 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaagaaggagcucauccacugggugcggcaggcgccggggcagggccuggaguggaucgggugggucaagaccgugacgggcgccgugaacuucggcuccagcgacuuccgccagcgggucucccugacccgcgaccgggaccucuucaccgcccacauggacauccgcgggcugacccagggcgacacggccaccuacuucugcgcccggcagaaguucuacgccgggggccaggggugguacuucgaccuguggggccgcggcacccucaucguggugagcuccgcgagcaccaaggggcccuccgucuucccccacgaccug

SEQ ID NO: 10570 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagccuggacuuccgccaccggaucucccucacccgcgaccgggaccuguucaccgcccacauggacauccgcgggcugacccagggcgacacggccaccuacuacugcgcccggcagaaguucgagagccgcuacaccgggggccaggggugguacuucgaccucuggggccggggcacccacaucgucguguccagc

SEQ ID NO: 10571 - RNA, 414 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuacugcgcccggcagaaguucuacgccgggggccaggggugguacuucgaccuguggggccgcggcacccucaucgugguguccagcgcguccaccaaggggcccagcgucuuccccacgaucugc

SEQ ID NO: 10572 - RNA, 384 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccugagcaccgcccacauggacauccgggggcucacccaggacgacaccgccacguacuucugcgcgcgccagaaguucgagucccuguacagcgacgaccagggcuccuacuucgaccugugggggcggggcacccucaucaucgugagcucc

SEQ ID NO: 10573 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagggguccgagcucauccacugggugcggcaggcgccgggccaggggcuggaguggaucggcugggucaagaccgugacgggcgccgugaacuucgggagcgccuacuuccgccaccgggucucccugacccgcgaccgggaccucuucaccgcccacauggacauccgcggccugacccagggggacacggccaccuacuucugcgcgcggcagaaguucgagagccgcuacaccggcgggcagggcugguacuucgaccuguggggccgggggacccacaucgugguguccagcgccuccacgaagggccccagcgucuucccccacgaccuccgc

SEQ ID NO: 10574 - RNA, 408 nt, Artificial Sequence
  derived and/or modified sequence opt1 from anti-HIV-1_HeavyChain
caggugcagcugguccacagcggcgccgaggugaagaagcccggggccuccaugaaggugagcugcaagaccuccggcuacagcuucaccggguacuacaugcacuggguccgccaggcgccgggccaggggcucgaguggaugggcuggaucaaccccuccagcaacgacacgaacuacgcccagaaguuccagggccgggugaccaugacccgcgacaccuccaucaacacggccuacauggagcugagccggcugcgcuccggggacaccgccaucuacuucugcgcccggcagaaguucuacgcgggcgggcagggcugguacuucgaccucugggggcgcggcacccugaucguggucagcuccgccagcaccaagggccccuccguguuccccacgaucugc

SEQ ID NO: 10575 - RNA, 381 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugagcuacgcgcggcgcuuccagggccgggucuccuucuacaugacccgcgagcuggggauggccuacauggaccugcggaaccuccgcuucgacgacaccgccguguacuucugcgcccggaagacggcgggcgacgugagcggggacaaccgcggcuacuucuucgaccugugggggcggggcucccgcgucaucgugagcucc

SEQ ID NO: 10576 - RNA, 414 nt, Artificial Sequence
  derived and/or modified sequence opt1 from anti-HIV-1_HeavyChain
cagggcacccuggagcagagcugguccgaggugaagaagcucggggccagcguccgcguguccugcuggaccagcgaggacaucuucaagacggagcugauccacugggugcggcaggcccccggccaggggcuggaguggaucggcgggaugaaggcggucuccggcgccgugaacuacggcagccucgacuuccgccaccgggugucccugaccccggaccgcgaccugagcaccgcccacauggacauccgggggcucacccaggacgacacggccaccuacuucugcgcccgccagaaguucgcgcggggcgaccaggggugguucuucgaccuguggggccgcgggacccugaucgucguguccagcgccuccaccaagggccccagcguguucccccacgaccuccgg

SEQ ID NO: 10577 - RNA, 423 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgcccgggcagggccuggaguggaucgggugggucaagaccgugacgggcgccgugaacuucgccagccuggacuuccgcaaccggaucucccucagccgcgaccgggaccuguccaccgccuacauggacauccgcggccugacccaggacgacaccgccacguacuucugcgcgcggcagaaguucgccagccgcuacuccggggaccagggcagcuacuucgaccucugggggcggggcacccugaucugcgucuccagcgccuccacccgcgcccaccggcugccgccccgcagcgcg

SEQ ID NO: 10578 - RNA, 414 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacgcagggcgacaccgccaccuacuucugcgcccgccagaaguucgcgcgcggggaccagggcugguucuucgaccugugggggcggggcacccucaucgugguguccagcgccagcccccgggcccaccgcuccagcccccgguccgcc

SEQ ID NO: 10579 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucuacgccgggggccaggggugguacuucgaccuguggggccgcggcacccucaucgugguguccagcgcguccaccaaggggcccagcgucuucccccacgacuccgcc

SEQ ID NO: 10580 - RNA, 414 nt, Artificial Sequence
  derived and/or modified sequence opt1 from anti-HIV-1_HeavyChain
caggcccaccuggugcagagcggcuccggggucaagaagcccggcgccagcgugcgcguguccugcuggaccagcgaggacaucuucaaguccgagcucauccacuggguccggcaggcgccggggcagggccuggaguggaucgggugggugaagaccgugacgggcgccgucaacuucggcagcuccgacuuccgccagcgggugagccugacccgcgaccgggaccucuucaccgcccacauggacauccgcgggcugacccagggcgacacggccaccuacuucugcgcccggcagaaguucuacgccgggggccaggggugguacuucgaccuguggggccgcggcacccucaucguggucuccagcgcguccaccaaggggcccagcguguucccccacgaccugcgg

SEQ ID NO: 10581 - RNA, 414 nt, Artificial Sequence
  derived and/or modified sequence opt1 from anti-HIV-1_HeavyChain
caggcccagcuggagcagagcggcuccggggugaagaagcccggcgccagcguccgcguguccugcuggaccagcgaggacaucuucaagaccgagcucauccacugggugcggcaggcgccggggcagggccuggaguggaucgggugggucaagacggugaccggcgccgugaacuucggcucccccaacuuccgccaccgggucagccugacccgcgaccgggaccucuucaccgcccacauggacauccgcgggcugacgcagggcgacaccgccaccuacuucugcgcccggcagaaguucgagcgcgggggccaggggugguacuucgaccuguggggccggggcacccucaucgugguguccagcgcguccacgaaggggcccagcgucuucccccacgaccugcgc

SEQ ID NO: 10582 - RNA, 417 nt, Artificial Sequence
  derived and/or modified sequence opt1 from anti-HIV-1_HeavyChain
caggcccaccuggagcagagcggccgcgaggugaagaagcccggggccuccguccgggugagcugcuggaccuccgaggacaucuucgagaaguccgagcucauccacugggugcgccaggcgccgggccaggggcuggaguggaucggcugggucaagaccgugacgggggccgugaacuucggcagcagcgacuuccggcagcgcgucucccugacccgggaccgcgaccucuucaccgcccacauggacauccggggccugacccagggggacacggccaccuacuucugcgcccgccagaaguucuacgcgggcgggcagggcugguacuucgaccugugggggcggggcacccucaucguggugagcuccgccagcaccaagggccccuccgucuucccccacgaccugcgc

SEQ ID NO: 10583 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccccaacuuccggcaccgcaucucccugacccgggaccgcgaccucuucaccgcccacauggacauccgggggcugacccagggcgacacggccaccuacuacugcgcccgccagaaguucgagagccgguacaccgggggccaggggugguacuucgaccuguggggccgcggcacccacaucgucguguccagc

SEQ ID NO: 10584 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagggguccgagcucauccacugggugcggcaggcgccgggccaggggcuggaguggaucggcugggucaagaccgugacgggcgccgugaacuucgggagcgccuacuuccgccaccgggucucccugacccgcgaccgggaccucuucaccgcccacauggacauccgcggccugacccagggggacacggccaccuacuacugcgcgcggcagaaguucuacaagggcgggcagggcugguacuucgaccuguggggccgcgggacccucaucguggugagcucc

SEQ ID NO: 10585 - RNA, 381 nt, Artificial Sequence
  derived and/or modified sequence opt1 from anti-HIV-1_HeavyChain
caggugcagcugguccagagcggcgccgaggugaagaagcccggggccuccgugaaggucagcugcaaggcguccggcuacaccuucaccgacuacuaccuccacugggugcgccaggccccggggcagggccuggacugggugggguggaucaaccccaacagcggcggcacgaacuacgcccagaaguuccaggggcgggucgccaugacccgcgacaccucccugagcuccguguaccucgaccugaacagccugaccuccgccgacagcggcacguacuucugcgcgcggcagaccuucaagcccgacuucuacuucgccgaccaggggugguccuucaaccucuggggccgcggggcccacuucaucgugagcucc

SEQ ID NO: 10586 - RNA, 414 nt, Artificial Sequence
  derived and/or modified sequence opt1 from anti-HIV-1_HeavyChain
caggccgaccuggagcagagcggcuccggggugaagaagcccggcgccagcguccgcguguccugcuggaccagcgaggacaucuucgagcggaccaacuacgugcacuggguccgccaggcgccggggcggggccucgaguggaucgggugguccaagacggugaccggcgccgugaacuucggcagccccaacuuccgccaccgggucucccugacccgcgaccgggaccuguucaccgcccacauggacauccgcgggcucacgcagggcgacaccgccaccuacuucugcgcccggcagaaguucgagcgcgggggccaggggugguacuucgaccuguggggccggggcacccugaucguggugagcuccgcgagcacgaaggggcccuccgucuucccccacgaccuc

SEQ ID NO: 10587 - RNA, 381 nt, Artificial Sequence
  derived and/or modified sequence opt1 from anti-HIV-1_HeavyChain
cagguguacauggagcaggccggcgggggcaugaagaagcccggggccagcaugaccgucuccugcaagaccgcggacgaggacaucuucgacgccgccuacaugcacugggugcgccaggccccgggccagacguucgaguggcugggguggaugaagcccgugaccggcgccgucaacuacgcgcggcaguuccagggccgcgugagcuucuaccggacccgcgagcucgggaucgccuacauggaccugcgggaccugaaguucgacgacaccgccguguacuucugcgcccgcaagacgaagggcgacgucuccggggacgaccggggcuucuucuucgaccucugggggcgcggcacccgggugaucgugagcucc

SEQ ID NO: 10588 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucaucuacugggugcgccaggcgccgggccgggggcuggaguggaucggcugggugaagacggucagcgggaccgugaacuucggcuccagcgacuuccgcaaccggaucucccugacccgcgaccgggaccucagcaccgcccacauggacauccgcggccugacgcaggacgacaccgccaccuacuucugcgcccggcagaaguucgagucccuguacagcgacgaccagggguccuacuucgaccucuggggccgcgggacccugaucaucgugagcucc

SEQ ID NO: 10589 - RNA, 414 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccaaccugauccacugggugcgccaggcgcccgggcagggccuggaguggaucgggugggucaaggccguguccggcgccgugaacuacggcagccucgacuuccggcaccgcgucucccugacgcgggaccgcgaccugagcaccgcccacauggacauccgggggcucacccaggacgacaccgccacguacuucugcgcgcgccagaaguucgcccggggcgaccaggggugguucuucgaccuguggggccgcgggacccugaucgugguguccagcgccuccaccaagggcccgagcgucuucccccacgaccuc

SEQ ID NO: 10590 - RNA, 381 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcgggcgaggacguguucgacgccgccuacaugcacuggguccgccaggccccggggcagacguucgaguggcucggcuggaugaagcccgugaccggcgccgugaacuacgcgcggaaguuccaggggcgcgucagcuucuaccggacccgcgagcugggcaucgccuacauggaccugcggaaccuccgcuucgacgacaccgccguguacuucugcgcccggaagacggcgggggacguguccggcgacaagcgcggguucuucuucgaccuguggggccggggcagccgcgucaucguguccagc

SEQ ID NO: 10591 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucaucuacugggugcgccaggcgccgggccgggggcuggaguggaucggcugggugaagacggucagcgggaccgugaacuucggcuccagcgacuuccgcaaccggaucucccugacccgcgaccgggaccucagcaccgcccacauggacauccgcggccugacgcaggacgacaccgccaccuacuucugcgcccggcagaaguucgagucccuguacagcgacgaccagggguccuacuucgaccucuggggccgcgggacccugaucacggugagcucc

SEQ ID NO: 10592 - RNA, 429 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgcccgggcagggccuggaguggaucgggugggucaagaccgugacgggcgccgugaacuucggcagccuggacuuccggcaccgcaucucccucacccgggaccgcgaccuguucaccgcccacauggacauccgggggcugacccagggcgacacggccaccuacuucugcgcccgccagaaguucgagagccgguacaccgggggccaggggugguacuucgaccucuggggccgcggcacccacaucgucguguccagcgcguccacgaaggggcccagcggccugccgcccaccaucugccgg

SEQ ID NO: 10593 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucgcgcgcggggaccagggcugguucuucgaccugugggggcggggcacccucaucgugguguccagcgccuccaccaagggccccagcgucuucccccacgaccugcgc

SEQ ID NO: 10594 - RNA, 417 nt, Artificial Sequence
  derived and/or modified sequence opt1 from anti-HIV-1_HeavyChain
caggcccaccuggagcagagcggcuccggggugaagaagcccggcaccagcguccgcguguccugcuggaccagcgaggacaucuucgagcggacggagcucauccacugggugcgccaggccccggggcagggccuggaguggaucgggugggucaagaccgugaccggcgcggugaacuucggcucccccaacuuccggcaccgcgucagccugacccgggaccgcgaccucuucacggcccacauggacauccgggggcugacccagggcgacaccgccaccuacuucugcgcccgccagaaguucgagcgcgggggccaggggugguacuucgaccuguggggccggggcacgcucaucgugguguccagcgccuccaccaaggggcccagcgucuucccccacgaccugcgg

SEQ ID NO: 10595 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggggcgcgaccucuucaccgcccacauggacauccggggccugacgcagggggacaccgccaccuacuacugcgcccgccagaaguucgagcggggcgggcagggcugguacuucgaccuguggggccgcgggacccucaucgugguguccagcgcguccacgaagggccccagcgucuucccccacgaccugcgg

SEQ ID NO: 10596 - RNA, 411 nt, Artificial Sequence
  derived and/or modified sequence opt1 from anti-HIV-1_HeavyChain
caggcccaccugggcgccaacuggagcggggugaagaagcucggcgcguccguccgcgugagcugcuggaccuccgaggacaucuucgagcggaccgagcugauccacugggugcgccaggcccccgggcagggccuggaguggaucgggugggucaaggccgugagcggcgccgugaacuacggcucccucgacuuccggcaccgcgucagccugacgcgggaccgcgaccuguccaccgcccacauggacauccgggggcucacccaggacgacaccgcgacguacuucugcgcccgccagaaguucgcccggggcgaccaggggugguucuucgaccuguggggccgcgggacccugaucguggugagcuccgccagcaccaagggcccguccgucuucccccagauc

SEQ ID NO: 10597 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucuacgccgggggccaggggugguacuucgaccuguggggccgcggcacccucaucgugguguccagc

SEQ ID NO: 10598 - RNA, 423 nt, Artificial Sequence
  derived and/or modified sequence opt1 from anti-HIV-1_HeavyChain
caggcccagcuggagcagagcggcgugggggucaagaagcccggcgccuccgugcgcgugagcugccucgcguccgaggacaucuucaagaccgagcugauccacuggguccggcaggccccggggcagggccuggaguggaucgggugggugaagaccgugacgggcgccgucaacuucggcagccagaucuuccgccaccggaucucccucacccgcgaccgggaccuguucaccgcccacauggacauccgcgggcugacccagggcgacacggccaccuacuucugcgcgcggcagaaguucgagagccgcuacaccgggggccaggggugguacuucgaccucuggggccggggcacccacaucgugguguccagcgccuccacgaaggggcccagcgucuucccccacgaccugcgc

SEQ ID NO: 10599 - RNA, 411 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucgcccaccagaucagcgaccgcgucucccugacccgggaccgcgaccucuucaccgcccacauggacauccggggccugacccagggggacacggccaccuacuucugcgcgcgccagaaguucuacgccggcgggcagggcugguacuucgaccugugggggcggggcacccucaucguggugagcuccgccagcaccaagggccccuccgucuuccccacgaucugc

SEQ ID NO: 10600 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagcgguccgagcucauccacugggugcgccaggcgccggggcagggccuggaguggaucgggugggucaagaccgugacgggcgccgugaacuucggcagccccaacuuccggcaccgcgucucccugacccgggaccgcgaccucuucaccgcccacauggacauccgggggcugacccagggcgacacggccaccuacuucugcgcccgccagaaguacuacgccgggggccaggggugguacuucgaccuguggggccggggcacccucaucugcgugagcucc

SEQ ID NO: 10601 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccccaacuuccggcaccgcgucucccugacccgggaccgcgaccucuucaccgcccacauggacauccgggggcugacccagggcgacacggccaccuacuucugcgcccgccagaaguucgagcgcgggggccaggggugguacuucgaccuguggggccggggcacccucaucguggugagcucc

SEQ ID NO: 10602 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcggggccuggaguggaucgggugggucaaggccguguccggcgccgugaacuacggcagccucgacuuccgccaccgggucucccugacgcgcgaccgggaccuguucaccgcccacauggacauccgcgggcucacccaggacgacaccgccacguacuucugcgcgcggcagaaguucgcccgcggcgaccaggggugguucuucgaccuguggggccgggggacccugaucguggugagcucc

SEQ ID NO: 10603 - RNA, 381 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgagggcguguucgacgccgccuacaugcacuggguccgccaggccccggggcagacguucgaguggcucggcuggaugaagcccgugaccggcgccgugaacuacgcgcggaaguuccaggggcgcgucagcuucuaccggacccgcgagcugggcaucgccuacauggaccugcggaaccuccgcuucgacgacaccgccguguacuucugcgcccggaagacggcgggggacguguccggcgacaagcgcggguucuucuucgaccuguggggccggggcagccgcgucaucguguccagc

SEQ ID NO: 10604 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagggguccgagcucauccacugggugcggcaggcgccgggccaggggcuggaguggaucggcugggucaagaccgugacgggcgccgugaacuucgggagcgccuacuuccgccaccgggucucccugacccgcgaccgggaccucuucaccgcccacauggacauccgcggccugacccagggggacacggccaccuacuucugcgcgcggcagaaguacuacgccggcgggcagggcugguacuucgaccuguggggccgcgggacccucaucguggugagcucc

SEQ ID NO: 10605 - RNA, 378 nt, Artificial Sequence
  derived and/or modified sequence opt1 from anti-HIV-1_HeavyChain
cagguguacauggagcagcccggcgucgaggugaccaagccgggggccagcgugacccuguccugcaagacggccgaggacgucuucgacgcggccuacaugcacugggugcgccaggcccccggccagaccuucgaguggcucggguggaucaagcccgugaccggcgccgucaacuacgcccggaaguuccaggggcgcgugagcuucuaccggacccgcgagcugggcaucgcguacauggaccugcggaaccuccgcuucgacgacacggccguguacuucugcgcccggaagaccgccggcgacgucuccggggacaagcgcggcuucuucuucgaccugugggggcggggcagccgcgugaucguguccagc

SEQ ID NO: 10606 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucgagcgcgggggccagggguggaucuucgaccuguggggccggggcacccucaucaucguguccagc

SEQ ID NO: 10607 - RNA, 384 nt, Artificial Sequence
  derived and/or modified sequence opt1 from anti-HIV-1_HeavyChain
caggcccaccuggugcagagcggcuccgaggucaagaagcccggggccuucgugcgcgugagcugcuggaccuccgaggacaucuucgaggagaccgagcucauccacuggguccggcaggcgccgggccaggggcuggaguggaucggcugggugaagacggugaccggggccgucaacuucggcagccuggacuuccgccaccggaucucccucacccgcgaccgggaccuguucaccgcccacauggacauccgcggccugacgcagggggacaccgccaccuacuucugcgcccggcagaaguucgagagccgcuacaccggcgggcagggcugguacuucgaccucugggggcggggcacgcacaucgugguguccagc

SEQ ID NO: 10608 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcaaggcgagcgaggacaucuucgagcggaccgagcucauccacugggugcgccaggccccggggcagggccuggaguggaucgggugggucaagaccgugacgggcgccgugaacuucggcucccccaacuuccggcaccgcgucagccugacccgggaccgcgaccucuucaccgcccacauggacauccgggggcugacccagggcgacacggccaccuacuucugcgcgcgccagaaguucgagcgcgggggccaggggugguacuucgaccuguggggccggggcacccucaucgugguguccagc

SEQ ID NO: 10609 - RNA, 375 nt, Artificial Sequence
  derived and/or modified sequence opt1 from anti-HIV-1_HeavyChain
caggcccaccuggagcagagcggcuccgaggugaagaagcccggggccagcguccgcguguccugcuggaccagcgaggacaucuucgagcggaccgagcucauccacugggugcgccaggcgccgggccaggggcuggaguggaucggcugggucaagacgguguccggggccgugaacuucggcagccccaacuuccggcaccgcgucucccugacccgggaccgcgaccucuucaccgcccacauggacauccggggccugacccagggggacacggccaccuacuucugcgcccgccagaaguucgagcggggcgggcagggcugguacuucgaccugugggggcgcggcacccucaucguggugagcucc

SEQ ID NO: 10610 - RNA, 375 nt, Artificial Sequence
  derived and/or modified sequence opt1 from anti-HIV-1_HeavyChain
caggcgcaccuggugcagagcggcuccggggucaagaagcccggcgccagcgugcgcguguccugcuggaccagcgaggacaucuucgagaaguccgagcucauccacuggguccggcaggcgccggggcagggccuggaguggaucgggugggugaagaccgugacgggcgccgucaacuucggcagcuccgacuuccgccagcgggugagccugacccgcgaccgggaccucuucaccgcccacauggacauccgcgggcugacccagggcgacacggccaccuacuucugcgcccggcagaaguucuacgccgggggccaggggugguacuucgaccuguggggccgcggcacccucaucguggucuccagc

SEQ ID NO: 10611 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccugagcaccgcccacauggacauccgggggcucacccaggacgacaccgccacguacuucugcgcgcgccagaaguucgagcggggcgggcagggcugguacuucgaccugugggggcgcggcacccugaucugcguguccagc

SEQ ID NO: 10612 - RNA, 375 nt, Artificial Sequence
  derived and/or modified sequence opt1 from anti-HIV-1_HeavyChain
caggcccaccuggagcagagcggcuccggggugaagaagccccgcgccagcguccggguguccugcuggaccagcgaggacaucuucgagaaguccgagcucauccacugggugcgccaggcgccgggccaggggcuggaguggaucggcugggucaagaccgugacgggggccgugaacuucggcagcuccgacuuccggcagcgcgucagccugacccgggaccgcgaccucuucaccgcccacauggacauccggggccugacccagggggacacggccaccuacuucugcgcccgccagaaguucuacgcgggcgggcagggcugguacuucgaccugugggggcggggcacccucaucgugguguccagc

SEQ ID NO: 10613 - RNA, 381 nt, Artificial Sequence
  derived and/or modified sequence opt1 from anti-HIV-1_HeavyChain
caggugcagcuggagcaggccggcgccggggucaagaagcccggcccgagcgugacccucuccugcaagaccgcggacgaggacguguucgacgccgccuacaugcacuggguccgccaggcccccgggcagacguucgaguggcugggcuggaugaagcccgugaccggggccgugagcuacgcgcggaaguuccagggccgcgucuccuucuacaugacccgggagcugggcauggccuacauggaccuccgcaaccugcgguucgacgacaccgccguguacuucugcgcccgcaagacggcgggggacgugagcggcgacaaccggggguacuucuucgaccuguggggccgcgggucccgggucaucgugagcucc

SEQ ID NO: 10614 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccccaacuuccggcagcgcgucucccugacccgggaccgcgaccucuucaccgcccacauggacauccgggggcugacccagggcgacacggccaccuacuucugcgcccgccagaaguucuacgccgggggccaggggugguacuucgaccuguggggccggggcacccucaucguggugagcucc

SEQ ID NO: 10615 - RNA, 381 nt, Artificial Sequence
  derived and/or modified sequence opt1 from anti-HIV-1_HeavyChain
cagguguucauggagcaggccggcgccgggaugaagaagcccggcgcgagcaugaccgucuccugcaagaccgccgacgaggacguguucgacgccgccuacaugcacugggugcgccaggccccggggcagacguucgaguggcugggcuggaugaagcccgucaccggggcggugaacuacgcccggaaguuccagggccgcgugagcuucuaccggacccgcgagcucggcaucgccuacauggaccugcggaaccugcgcuucgacgacaccgccgucuacuucugcgcgcggaagacggccggggacguguccggcgacaagcgcggguucuucuucgaccucuggggccgggggagccgcgugaucgucuccagc

SEQ ID NO: 10616 - RNA, 375 nt, Artificial Sequence
  derived and/or modified sequence opt1 from anti-HIV-1_HeavyChain
caggcccaccuggagcagagcggcuccggggugaagaagcccggcgccagcguccgcgcguccugcuggaccagcgaggacaucuucgagcggaccgagcucauccacugggugcgccaggccccggggcagggccuggaguggaucgggugggugaagaucgucuccggcgccgugaacuucggcagccccaacuuccggcagcgcgugucccugacgcgggaccgcgaccucuucaccgcccacauggacauccgggggcugacccagggcgacaccgccacguacuucugcgcgcgccagaaguucgagcgcgggggccagggguggaucuucgaccuguggggccggggcacccucaucgccgucagcucc

SEQ ID NO: 10617 - RNA, 381 nt, Artificial Sequence
  derived and/or modified sequence opt1 from anti-HIV-1_HeavyChain
cagguguacauggagcaggccggcgggggcaugaagaagcccggggccagcaugaccgucuccugcaagaccgcggacgaggacaucuucgacgccgccuacaugcacugggugcgccaggcccggggccagacguucgaguggcugggguggaugaagccggugaccggcgccgucaacuacgcgcgccaguuccagggccgggugagcuucuaccgcacccgggagcucgggaucgccuacauggaccugcgcgaccugaaguucgacgacaccgccguguacuucugcgcccggaagacgaagggcgacgucuccggggacgaccgcggcuucuucuucgaccucugggggcggggcacccgcgugaucgugagcucc

SEQ ID NO: 10618 - RNA, 384 nt, Artificial Sequence
  derived and/or modified sequence opt1 from anti-HIV-1_HeavyChain
caggcccaccuggagcagagcggcgccggggugaaggagcccggcgcguccguccgcgugagcugcugguccagcgaggacaucuucgagcggaccgagcucauccacugggugcgccaggccccggggcagggccuggaguggaucgggugggucaagaccgugacgggcgccgugaacuucggcucccuggacuuccggcaccgcaucagccucacccgggaccgcgaccugcugaccgcccacauggacauccgggggcucacccagggcgacacggccaccuacuucugcgcgcgccagaaguucgagucccgguacaccgggggccaggggugguacuucgaccuguggggccgcggcacccacaucgucgugagcucc

SEQ ID NO: 10619 - RNA, 384 nt, Artificial Sequence
  derived and/or modified sequence opt1 from anti-HIV-1_HeavyChain
caggugcagcugguccagagcggcuccgccaugaagaagcccggggccagcgugcgcguguccugcuggaccagcgaggacaucuucgagcggaccgagcucaucuacuggguccgccaggcgccgggccgggggcuggaguggaucggcugggugaagacgguguccgggaccgucaacuucggcagcuccgacuuccgcaaccggaucagccugacccgcgaccgggaccucuccaccgcccacauggacauccgcggccugacgcaggacgacaccgccaccuacuucugcgcccggcagaaguucgagagccuguacuccgacgaccaggggagcuacuucgaccucuggggccgcgggacccugaucaucguguccagc

SEQ ID NO: 10620 - RNA, 384 nt, Artificial Sequence
  derived and/or modified sequence opt1 from anti-HIV-1_HeavyChain
caggcccaccuggugcagagcgccuccggcgucaagcgccccggggcgagcgugcggguguccugcuggaccagcgaggacaucuucgagcgcaccgagcucaucuacuggguccggcaggccccgggccaggggcuggaguggaucggcugggugaagacgguguccggggccgucaacuucggcagccaggacuuccgccaccggaucucccugacccgcgaccgggaccucuucaccgcccacauggacauccgcggccugacccagggggacacggccaccuacuucugcgcgcggcagaaguucgagagccgcuacaccggcgggcagggcugguacuucgaccugugggggcggggcacccacaucgugguguccagc

SEQ ID NO: 10621 - RNA, 381 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugagcuacgcgcggaaguuccagggccgcgucuccuucuacaugacccgggagcuggggauggccuacauggaccugcgcaaccuccgguucgacgacaccgccguguacuucugcgcccgcaagacggcgggcgacgugagcggggacaagcggggcuucuucuucgaccugugggggcgcggcucccgggucaucgugagcucc

SEQ ID NO: 10622 - RNA, 372 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagggguacaugauccacugggugcggcaggcgccgggccaggggcucgaguggaucggcugggucaagaccgugacgggcgccgugaacuucggguccgccuacuuccgccaccgggucagccugacccgcgaccgggaccuguucaccgcccacauggacauccgcggccucacccagggggacacggccaccuacuucugcgcgcggcagaaguucuacaagggcgggcagggcugguacuucgaccuguggggccgcgggacccugaucgugguguccagc

SEQ ID NO: 10623 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcggggccuggaguggaucgggugggucaaggccguguccggcgccgugaacuacggcagccucgacuuccgccaccgggucucccugacgcgcgaccgggaccuguucaccgcccacauggacauccgcgggcucacccaggacgacaccgccacguacuucugcgcgcggcagaaguucgcccgcggcgaccaggggugguucuucgaccuguggggccgggggacccugaucugcgugagcucc

SEQ ID NO: 10624 - RNA, 375 nt, Artificial Sequence
  derived and/or modified sequence opt1 from anti-HIV-1_HeavyChain
caggcgcaccuggugcagagcggcuccggggucaagaaguccggcgccagcgugcgcgugagcugcuggaccuccgaggacaucuucgagaaguccgagcucauccacuggguccggcaggcgcccgggcagggccuggaguggaucgggugggugaagaccgugacgggcgccgucaacuucggcagcagcgacuuccgccagcgggugucccugacccgcgaccgggaccucuucaccgcccacauggacauccgcgggcugacccagggcgacacggccaccuacuucugcgcccggcagaaguucuacgccgggggccaggggugguacuucgaccuguggggccgcggcacccucaucguggucagcucc

SEQ ID NO: 10625 - RNA, 378 nt, Artificial Sequence
  derived and/or modified sequence opt1 from anti-HIV-1_HeavyChain
cagguguacauggagcgcgccggcgccggggucaagaagcccggcgcgagcgugacccuguccugcaagaccgccgacgaggacguguucggggccuacaugcacuggguccggcaggccccgggccagacguucgaguggcucggguggaugaagcccgugaccggcgccgugagcuacgcgcgcaaguuccagggccgggucuccuucuacaugacccgcgagcuggggauggccuacauggaccugcggaaccuccgcuucgacgacaccgccguguacuucugcgcccggaagacggcgggcgacgugagcggggacaaccgcggcuacuucuucgaccugugggggcggggcucccgcgucaucgugagcucc

SEQ ID NO: 10626 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagggguccgagcucauccacugggugcggcaggcgccgggccaggggcuggaguggaucggcugggucaagaccgugacgggcgccgugaacuucgggagcgccuacuuccgccaccgggucucccugacccgcgaccgggaccucuucaccgcccacauggacauccgcggccugacccagggggacacggccaccuacuucugcgcgcggcagaaguucuacaagggcgggcagggcugguacuucgaccuguggggccgcgggacccucaucguggugagcucc

SEQ ID NO: 10627 - RNA, 375 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucaucuacugggugcgccaggcgccgggccgggggcuggaguggaucggcugggugaagacggucagcgggaccgugaacuucggcuccagcgacuuccgcaaccgggugucccugacccgcgaccgggaccucuucaccgcccacauggacauccgcggccugacgcaggacgacaccgccaccuacuucugcgcccggcagaaguucgcccgcggggaccagggcugguucuucgaccugugggggcggggcacccucaucgucgugagcucc

SEQ ID NO: 10628 - RNA, 384 nt, Artificial Sequence
  derived and/or modified sequence opt1 from anti-HIV-1_HeavyChain
caggcccaccuggugcagagcggcuccggggucaagaagcccggcgccagcgugcgcguguccugcuggaccagcgaggacaucuucgagcggaccgagcucauccacuggguccgccaggcgccggggcagggccuggaguggaucgggugggugaagacgguggccggcgccgucaacuucuccagccuggacuuccggcaccgcaucucccucacccgggaccgcgaccuguucaccgcccacauggacauccggggccugacccagggggacacggccaccuacuucugcgcgcgccagaaguucgagagccgguacaccggcgggcagggcugguacuucgaccucugggggcgcggcacccacaucgugguguccagc

SEQ ID NO: 10629 - RNA, 384 nt, Artificial Sequence
  derived and/or modified sequence opt1 from anti-HIV-1_HeavyChain
caggcccaccuggagcagagcggcuccggggugaagaaguccggcgccagcgcgcgcgucagcugcugguccagcgaggacaucuucgagcggaccgagcucauccacugggugcgccaggcccccgggcagggccuggaguggaucgggugggugaagaccgucacgggcgccgugaacuucggcucccuggacuuccggcaccgcaucagccucacccgggaccgcgaccuguucaccgcccacauggacauccgggggcugacccagggcgacacggccaccuacuucugcgcgcgccagaaguucgagucccgguacaccgggggccaggggugguacuucgaccucuggggccgcggcacccacaucguggucagcucc

SEQ ID NO: 10630 - RNA, 369 nt, Artificial Sequence
  derived and/or modified sequence opt1 from anti-HIV-1_HeavyChain
cugcuccagcuggugcagagcggcgccgaggucaagaagcccggggccuccgugaaggugaccugcaaggcgagcggcuacaccuucacgggguacauccacuggguccgccaggccccgggccaggggcuggaguggaucggcugggugaaggccguguccggcgccgucaacuacgggagccucgacuuccggcaccgcgugucccugacccacgaccgggaccugagcaccgcccacauggacauccgcggccucacccaggacgacacggcgaccuacuucugcgcccggcagaaguucgcccgcggggaccagggcugguucuucgaccugugggggcggggcacccugaucguggucuccagc

SEQ ID NO: 10631 - RNA, 369 nt, Artificial Sequence
  derived and/or modified sequence opt1 from anti-HIV-1_HeavyChain
caggugcagcugguccagagcggcgccgaggugaagaagcccggggccuccgugaaggucagcugcaaggcguccggcugcaccuucaccggguacuacaugcacugggugcgccaggccccgggccaggggcucgaguggaugggcuggaucaaccccaacagcggcgggacgaacuacgcccagaaguuccagggccgggugaccaugacccgcgacaccuccaucagcacggccuacauggagcugucccggcugcgcagcgacgacaccgccgucuacuacugcgcgcggcagaaguucgcccgcggggaccagggcugguucuucgaccucugggggcggggcacccugaucgugguguccagc

SEQ ID NO: 10632 - RNA, 369 nt, Artificial Sequence
  derived and/or modified sequence opt1 from anti-HIV-1_HeavyChain
caggugcagcugguccagagcggcaccgagcuccgcaagcccggggccuccgugaaggugagcugcaaggccuccggcuacaccuucagcggguccuacauccacuggguccggcaggcgccgggccaggggcuggagugggugggcuggaucaaccccagcuccggcgccacgcagugcgccaagaaguuccaggacaaggugaccaugacccgcgacaccacgaacaacaccgucuacauggaggugaaccggcugaucagcgacgacaccgccaccuacuucugcgcccgccagaaguucgcgcgcggggaccagggcugguucuucgaccucugggggcggggcacgcugaucguggucuccagc

SEQ ID NO: 10633 - RNA, 372 nt, Artificial Sequence
  derived and/or modified sequence opt1 from anti-HIV-1_HeavyChain
caggugcugcucguccagagcggcgccgaggugaagaagcccggguccagcgugaaggucuccugcaagaccagcggcgacucccugaccaaguacgcccugcacugggcgcgccaggccccggggcagggccucgaguggaucgggugggugaagacggugaccggcgccgucaacuucggcagcuccgacuuccggcagcgcgugagccugacccgggaccgcgaccuguucaccgcccacauggacauccgggggcucacgcagggcgacaccgccaccuacuucugcgcgcgccagaaguucuacgccgggggccaggggugguacuucgaccuguggggccggggcacccugaucguggucuccagc

SEQ ID NO: 10634 - RNA, 372 nt, Artificial Sequence
  derived and/or modified sequence opt1 from anti-HIV-1_HeavyChain
caggugcagcugguccagagcggcaccgaggugaagacccccggggcguccgugaaggucagcugcaaggccuccggcuacacguucaccaacuacgacaucaacugggugcgccaggcgccggggcagggccucgaguggaucgggugggugaagaccgucaccggcgccgugaacuucggcagcuccgacuuccggcagcgcgugagccugacgcgggaccgcgaccuguucaccgcccacauggacauccgggggcucacccagggcgacaccgccacguacuucugcgcccgccagaaguucuacgccgggggccaggggugguacuucgaccuguggggccggggcacccugaucgucguguccagc

SEQ ID NO: 10635 - RNA, 372 nt, Artificial Sequence
  derived and/or modified sequence opt1 from anti-HIV-1_HeavyChain
caggugcagcugguccagagcggcgacgaggugaagaagcccggggccuccgugaaggucagcugcaaggccuccggcaagggguucccgaccagccucgugaccugggugcgccaggcgcccggccaggggcuggaguggaucggcugggucaaggccguguccggcgccgugaacuacgggagccuggacuuccggcaccgcgucucccucacgcgggaccgcgaccuguucaccgcccacauggacauccggggccugacccaggacgacaccgccacguacuucugcgcgcgccagaaguucgcccgcggggaccagggcugguucuucgaccucugggggcggggcacccugaucguggugagcucc

SEQ ID NO: 10636 - RNA, 372 nt, Artificial Sequence
  derived and/or modified sequence opt1 from anti-HIV-1_HeavyChain
caggugcagcugguccagagcggcgccgaggugaagaagcccggguccagcgugaaggucuccugcaagaccagcggcgacauccucaccaacuacgggcugaacugggugcgccaggccccgggccaggggcuggaguggaucggcugggugaaggcggucuccggcgccgugaacuacgggagccucgacuuccggcaccgcgugucccugacgcgggaccgcgaccugagcaccgcccacauggacauccggggccucacccaggacgacaccgccacguacuucugcgcccgccagaaguucgcgcgcggggaccagggcugguucuucgaccugugggggcggggcacccugaucgucguguccagc

SEQ ID NO: 10637 - RNA, 372 nt, Artificial Sequence
  derived and/or modified sequence opt1 from anti-HIV-1_HeavyChain
caggugcagcugguccagagcggcgccgaggugaagaagcccggggccuccgugcgcgucagcugcaagaccuccggcuacccguucagccgguacgggaucuccugggugcgccaggcgcccggccaggggcucguguggauggccugggucaaggccgugagcggcgccgugaacuacggcucccuggacuuccggcaccgcgucagccugacccgggaccgcgaccucuccacggcccacauggacauccgggggcugacccaggacgacaccgcgaccuacuucugcgcccgccagaaguucgcccggggcgaccaggggugguucuucgaccuguggggccgcgggacgcucaucguggugagcucc

SEQ ID NO: 10638 - RNA, 372 nt, Artificial Sequence
  derived and/or modified sequence opt1 from anti-HIV-1_HeavyChain
cgcgagcagcuggugcagagcggcgccgaggucaagaagcccggggccuccgugaaggugagcugcaagaccuccggcaacaccuucgggagcuacgacuucaacuggguccggcaggcgccgggccaggggcucgaguggaucggcugggugaagaucguguccggcgccgucaacuucgggagccccaacuuccgccagcgggugucccugacgcgcgaccgggaccuguucaccgcccacauggacauccgcggccucacccagggggacaccgccacguacuucugcgcccggcagaaguucgagcgcggcgggcagggcuggaucuucgaccuguggggccgggggacccugaucgcggugagcucc

SEQ ID NO: 10639 - RNA, 372 nt, Artificial Sequence
  derived and/or modified sequence opt1 from anti-HIV-1_HeavyChain
caggugcagcugguccagagcggcgccgaggugaagaagcccggggccuccgugaaggucagcugcaaggcguccggcuacaccuucaccagcuacuacaugcacugggugcgccaggccccggggcagggccucgaguggaucgggugggugaagacggucaccggcgccgugaacuucggcucccccaacuuccggcaccgcgugagccugacccgggaccgcgaccuguucaccgcccacauggacauccgggggcucacgcagggcgacaccgccaccuacuucugcgcgcgccagaaguacuacgccgggggccaggggugguacuucgaccuguggggccggggcacccugaucgucguguccagc

SEQ ID NO: 10640 - RNA, 372 nt, Artificial Sequence
  derived and/or modified sequence opt1 from anti-HIV-1_HeavyChain
caggugcagcugguccagagcggcgccgaggugaagaagcccggggccuccgugaaggucagcugcaaggcguccggcuacaccuucaccagcuacuacaugcacugggugcgccaggccccggggcagggccucgaguggaucgggugggugaagacggucaccggcaccgugaacuucggcucccugaacuuccggcagcgcgugagccugacccgggaccgcgaccucuucacggcccacauggacauccgggggcugacccagggcgacaccgccaccuacuucugcgcccgccagaaguucgagcgcgggggccaggggugguacuucgaccuguggggccggggcacgcucaucgucguguccagc

SEQ ID NO: 10641 - RNA, 372 nt, Artificial Sequence
  derived and/or modified sequence opt1 from anti-HIV-1_HeavyChain
caggugcagcugggccagagcggggccgagaugaagaagcccggcuccagcgucaagguguccugcaaggccagcgggggcaccuuccgccacuccccgaucagcugggugcggcaggcgcccgggcagggccucgaguggaucggcugggucaaggccguguccggggccgugaacuacggcagccuggacuuccgccaccgggucucccugacccgcgaccgggaccucagcacggcccacauggacauccgcgggcugacccaggacgacaccgccaccuacuucugcgcgcggcagaaguucgcccgcggcgaccaggggugguucuucgaccuguggggccggggcacgcucaucgugguguccagc

SEQ ID NO: 10642 - RNA, 369 nt, Artificial Sequence
  derived and/or modified sequence opt1 from anti-HIV-1_HeavyChain
caggugcagcugguccagagcggcgccgaggugcgcacccccggggccuccgugaaggucagcugcaaggcguccggcuacaacuucaucgccuaccacgugcacugggugcggcaggccccggggcagggccucaccuggaugggguggaucaaccccgacagcggcgacacggucuacgcccagaacuucguggaccgcgugaugaugacccggaacaccuccauccagaccgucuaccuggagcugaacgugcucacgcuggaggacaccgccaccuacuucugcgcgcgccagaaguucgcccggggcgaccaggggugguucuucgaccuguggggccgcgggacccucaucguggucagcucc

SEQ ID NO: 10643 - RNA, 372 nt, Artificial Sequence
  derived and/or modified sequence opt1 from anti-HIV-1_HeavyChain
caggugcagcugguccagagcggcgccgaggugaagaagcccggggccuccgugaaggucagcugcaaggcguccggcuacaccuucaccguguacuacaugcacugggugcgccaggccccggggcggggccucgaguggaucgggugggucaaggccgugagcggcgccgugaacuacggcucccuggacuuccgccaccgggucagccugacgcgcgaccgggaccucuucaccgcccacauggacauccgcgggcugacccaggacgacaccgcgacguacuucugcgcccggcagaaguucgcccgcggcgaccaggggugguucuucgaccuguggggccgggggacccucaucgugguguccagc

SEQ ID NO: 10644 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccuguucaccgcccacauggacauccgggggcucacccagggcgacaccgccacguacuucugcgcgcgccagaaguucgagcgcgggggccaggggugguacuucgaccuguggggccggggcacccugaucguggugagcucc

SEQ ID NO: 10645 - RNA, 372 nt, Artificial Sequence
  derived and/or modified sequence opt1 from anti-HIV-1_HeavyChain
caggugcagcugguccagagcggcgccgaggugaagaagcccggggccuccgugaaggucagcugcaaggcguccggcuacaccuucaucggguacuacaugcacugggugcgccaggccccgggccaggggcucgaguggaugggcugggugaagaccgucacgggcgccgugaacuucgggagccccaacuuccggcaccgcgugucccugacccgggaccgcgaccuguucaccgcccacauggacauccggggccucacccagggggacacggccaccuacuucugcgcgcgccagaaguucgagcggggcgggcagggcugguacuucgaccuguggggccgcgggacccugaucgucgugagcucc

SEQ ID NO: 10646 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccugaacuuccggcaccgcgucucccucacccgggaccgcgaccuguucaccgcccacauggacauccgggggcugacccagggcgacacggccaccuacuucugcgcccgccagaaguucgcgcgcggggaccagggcugguucuucgaccucugggggcggggcacccugaucguggugagcucc

SEQ ID NO: 10647 - RNA, 372 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucaaggaccggaucgaccacugggugcgccaggcgcccgggcagggccuggaguggaucgggugggucaaggccguguccggcgccgugaacuacggcagccuggacuuccggcaccgcgucucccucacccgggaccgcgaccuguucacggcccacauggacauccgggggcugacccaggacgacaccgccaccuacuucugcgcgcgccagaaguucgcccggggcgaccaggggugguucuucgaccucuggggccgcgggacgcugaucguggugagcucc

SEQ ID NO: 10648 - RNA, 375 nt, Artificial Sequence
  derived and/or modified sequence opt1 from anti-HIV-1_HeavyChain
caggugcagcuggcccagagcggcgccgaggucaagaagcucggggcguccgugcgcgugagcugcuggaccuccgaggacaucuucgagcggaccgagcugauccacuggguccgccaggcccccggccaggggcuggaguggaucggcugggugaaggccgugagcggggccgucaacuacggcucccucgacuuccggcaccgcgugagccugacgcgggaccgcgaccuguucaccgcccacauggacauccggggccucacccaggacgacaccgcgaucuacuucugcgcccgccagaaguucgcccgcggggaccagggcugguucuucgaccugugggggcggggcacgcugaucguggucuccagc

SEQ ID NO: 10649 - RNA, 372 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuccaaggcggagcucauccacugggugcggcaggccccggggcagggccuggaguggaucgggugggucaagaccgugagcggcgccgugaacuucggcucccccaacuuccgccaccgggucagccugacgcgcgaccgggaccucuucaccgcccacauggacauccgcgggcugacccagggcgacaccgccacguacuucugcgcgcggcagaaguucgagcgcgggggccaggggugguacuucgaccuguggggccggggcacccucaucgugguguccagc

SEQ ID NO: 10650 - RNA, 372 nt, Artificial Sequence
  derived and/or modified sequence opt1 from anti-HIV-1_HeavyChain
accgcccaccuggagcagagcggcuccggggugcgccggcccggcgccagcguccgcguguccugcuggaccagcggggacaucuucaaguccgagcucauccacugggugcggcaggcgccgggccaggggcuggaguggaucggcugggucaagacggugaccggcgccgugaacuucgggagcuccgacuuccgccagcgggucagccugacccgcgaccgggaccucuucaccgcccacauggacauccgcggccugacgcagggggacaccgccaccuacuucugcgcccggcagaaguucuacgcgggcgggcagggcugguacuucgaccuguggggccgcgggacccucaucgugguguccagc

SEQ ID NO: 10651 - RNA, 372 nt, Artificial Sequence
  derived and/or modified sequence opt1 from anti-HIV-1_HeavyChain
caggcccaccuggagcagagcggcuccggggugaagcgccccggcgccagcguccggguguccugcuggaccagcgaggacaucuucaacaccgagcucauccacugggugcgccaggcgccggggcagggccuggaguggaucgggugggucaagacgguguccggcgccgugaacuucggcagccugaacuuccggcaccgcgucucccucacccgggaccgcgaccuguucaccgcccacauggacauccgggggcugacccagggcgacacggccaccuacuucugcgcccgccagaaguucgcgcgcggggaccagggcugguucuucgaccucugggggcggggcacccugaucguggugagcucc

SEQ ID NO: 10652 - RNA, 372 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucaagaccgagcucauccacugggugcggcaggcgccggggcagggccuggaguggaucgggugggucaaggccguguccggcgccgugaacuacggcagccuggacuuccgccaccgggucucccucacgcgcgaccgggaccugagcaccgcccacauggacauccgcgggcugacccaggacgacaccgccacguacuucugcgcgcggcagaaguucgcccgcggcgaccaggggugguucuucgaccucuggggccgggggacccugaucgugguguccagc

SEQ ID NO: 10653 - RNA, 372 nt, Artificial Sequence
  derived and/or modified sequence opt1 from anti-HIV-1_HeavyChain
caggugcagcugguccagagcggcgccgaggugaagaagcccggggccuccgugcgcgucagcugcaaggcguccggcuacaccuucaccgccuacuacauccacugggugcggcaggccccggggcagggccucgaguggaucgggugggugaagacggucagcggcgccgugaacuucggcucccccaacuuccgccaccgggugagccugacccgcgaccgggaccuguucaccgcccacauggacauccgcgggcucacccagggcgacacggcgaccuacuucugcgcccggcagaaguucgagcgcgggggccaggggugguacuucgaccuguggggccggggcacccugaucgucguguccagc

SEQ ID NO: 10654 - RNA, 372 nt, Artificial Sequence
  derived and/or modified sequence opt1 from anti-HIV-1_HeavyChain
caggcccaccuggagcagagcggcuccgagagcaagaagcccggggccuccgugcgcgucagcugcugguccagcgaggacaucuucaagaccgagcucauccacugggugcggcaggcgccgggccaggggcuggaguggaucggcugggugaagaucgucuccggggccgugaacuucggcagccccaacuuccgccagcgggugucccugacccgcgaccgggaccucuucacggcccacauggacauccgcggccugacccagggggacaccgccaccuacuucugcgcccggcagaaguucgagcgcggcgggcagggcuggaucuucgaccugugggggcggggcacgcucaucgcggucagcucc

SEQ ID NO: 10655 - RNA, 375 nt, Artificial Sequence
  derived and/or modified sequence opt1 from anti-HIV-1_HeavyChain
caggcccaccuggagcagagcggcuccgaggugaagaagcccggggccagcguccgcguguccugcuggaccagcgaggacaucuucgagaaguccgagcucauccacugggugcggcaggcgccgggccaggggcuggaguggaucggcugggucaagaccgugacgggggccgugaacuucggcagcuccgacuuccgccagcgggucagccugacccgcgaccgggaccucuucaccgcccacauggacauccgcggccugacccagggggacacggccaccuacuucugcgcccggcagaaguucuacgcgggcgggcagggcugguacuucgaccugugggggcgcggcacccucaucgugguguccagc

SEQ ID NO: 10656 - RNA, 372 nt, Artificial Sequence
  derived and/or modified sequence opt1 from anti-HIV-1_HeavyChain
caggcccaccuggagcaggucugggccggcgugaagaagcucggggcgagcgugcgcguguccugcuggaccagcgaggacaucuucaagaccgagcugauccacuggguccggcaggcccccggccaggggcuggaguggaucggcugggugaaggccguguccggggccgucaacuacggcagccucgacuuccgccaccgggugucccugacgcgcgaccgggaccugagcaccgcccacauggacauccgcggccucacccaggacgacaccgcgacguacuucugcgcccggcagaaguucgcccgcggggaccagggcugguucuucgaccugugggggcggggcacccugaucguggucuccagc

SEQ ID NO: 10657 - RNA, 372 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagcgguccgagcucauccacugggugcgccaggcgccggggcagggccuggaguggaucgggugggucaagaccgugacgggcgccgugaacuucggcagcaacuuccggcagcgcgucucccugacccgggaccgcgaccucuucaccgcccacauggacauccgggggcugacccagggcgacacggccaccuacuucugcgcccgccagaaguucuacgccgggggccaggggugguacuucgaccuguggggccggggcacccucaucguggugagcucc

SEQ ID NO: 10658 - RNA, 375 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgccaccgggugagccucacccgcgaccgggaccuguccaccgcccacauggacauccgcggccugacgcaggacgacaccgccaccuacuucugcgcccggcagaaguucgcgcgcggcgaccaggggugguucuucgaccucuggggccgggggacccugaucgucgugagcucc

SEQ ID NO: 10659 - RNA, 375 nt, Artificial Sequence
  derived and/or modified sequence opt1 from anti-HIV-1_HeavyChain
caggcccaccuggagcagagcggcuccggggugaagaagcccggcaccagcguccgcguguccugcuggaccagcgaggacaucuucgagcggacggagcucauccacugggugcgccaggccccggggcagggccuggaguggaucgggugggucaagaccgugaccggcgcggugaacuucggcucccccaacuuccggcaccgcgucagccugacccgggaccgcgaccucuucacggcccacauggacauccgggggcugacccagggcgacaccgccaccuacuucugcgcccgccagaaguucgcccgcggggaccagggcugguucuucgaccugugggggcggggcacgcucaucgugguguccagc

SEQ ID NO: 10660 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgggggcaucuucgagcggaccgagcucauccacugggugcgccaggcgccggggcagggccuggaguggaucggcugggucaagacggugaccggggccgugaacuucggcucccccaacuuccggcaccgcgucagccugacccgggaccgcgaccucuucaccgcccacauggacauccgggggcugacgcagggcgacaccgccaccuacuucugcgcccgccagaaguucgagcgcgggggccagggcugguacuucgaccugugggggcggggcacccucaucgugguguccagc

SEQ ID NO: 10661 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccuggacuuccggcaccgcaucucccucacccgggaccgcgaccuguucaccgcccacauggacauccgggggcugacccaggacgacacggccaccuacuucugcgcccgccagaaguucgcgcggggcgaccaggggugguucuucgaccucuggggccgcgggacccugaucgucgugagcucc

SEQ ID NO: 10662 - RNA, 372 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucgagcgcgggggccagggguggaucuucgaccuguggggccggggcacccucaucgcgguguccagc

SEQ ID NO: 10663 - RNA, 375 nt, Artificial Sequence
  derived and/or modified sequence opt1 from anti-HIV-1_HeavyChain
caggcccaccuggagcagagcggcuccggggugaagcgccccggcgccagcguccggguguccugcuggaccagcgaggacaucuucgagaccacggagcucauccacugggugcgccaggcgccggggcagggccuggaguggaucgggugggucaagaccguguccggcgccgugaacuucggcagccugaacuuccggcaccgcgucucccucacccgggaccgcgaccuguucaccgcccacauggacauccgggggcugacgcagggcgacaccgccaccuacuucugcgcccgccagaaguucgcgcgcggggaccagggcugguucuucgaccucugggggcggggcacccugaucguggugagcucc

SEQ ID NO: 10664 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcagcgcgucucccugacgcgggaccgcgaccuguucaccgcccacauggacauccgggggcucacccagggcgacaccgccacguacuucugcgcgcgccagaaguucuacgccgggggccaggggugguacuucgaccuguggggccggggcacccugaucguggugagcucc

SEQ ID NO: 10665 - RNA, 372 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaaccugguccaccagaucagcgaccgcgugucccucacccgggaccgcgaccuguucaccgcccacauggacauccggggccugacccagggggacacggccaccuacuucugcgcccgccagaaguucuacgcgggcgggcagggcugguacuucgaccucugggggcggggcacccugaucguggucagcucc

SEQ ID NO: 10666 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgggcgggaccucuucaccgcccacauggacauccgcggccugacccagggggacacggccaccuacuucugcgcccggcagaaguucuacgcgggcgggcagggcugguacuucgaccuguggggccgcgggacccucaucgugguguccagc

SEQ ID NO: 10667 - RNA, 375 nt, Artificial Sequence
  derived and/or modified sequence opt1 from anti-HIV-1_HeavyChain
caggcccaccuggagcagagcggcgccggggugaagaagcccggcgcguccguccgcgugagcugcuggaccuccgaggacaucuucgagcggaccgagcucauccacugggugcgccaggccccggggcagggccuggaguggaucgggugggucaagacggugaccggcgccgugaacuucggcagccccaacuuccggcaccgcgucucccugacccgggaccgcgaccucuucaccgcccacauggacauccgggggcugacgcagggcgacaccgccaccuacuucugcgcgcgccagaaguucgagcgcgggggccaggggugguacuucgaccuguggggccggggcacccucaucguggugagcucc

SEQ ID NO: 10668 - RNA, 375 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucauccacugggugcggcaggcgccgggccaggggcuggaguggaucggcugggugaaggccgucagcggggccgugaacuacggcucccuggacuuccgccaccgggugagccucacccgcgaccgggaccuguccaccgcccacauggacauccgcggccugacccaggacgacacggccaccuacuucugcgcgcggcagaaguucgcccgcggggaccagggcugguucuucgaccucugggggcggggcacccugaucgucgugagcucc

SEQ ID NO: 10669 - RNA, 372 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucaagaccgagcucauccacugggugcggcaggcgccggggcagggccuggaguggaucgggugggucaagacgguguccggcgccgugaacuucggcagccccaacuuccgccaccgggucucccugacccgcgaccgggaccucuucaccgcccacauggacauccgcgggcugacccagggcgacacggccaccuacuucugcgcccggcagaaguucgagcgcgggggccaggggugguacuucgaccuguggggccggggcacccucaucguggugagcucc

SEQ ID NO: 10670 - RNA, 375 nt, Artificial Sequence
  derived and/or modified sequence opt1 from anti-HIV-1_HeavyChain
caggugcaccuggagcagagcggcuccggggucaagaagcucggcgccagcgugcgcguguccugcuggaccagcgaggacaucuucgagcggaccgagcugauccacuggguccgccaggcccccgggcagggccuggaguggaucgggugggugaaggcgguguccggcgccgucaacuacggcagccucgacuuccggcaccgcgugucccugacgcgggaccgcgaccuguucaccgcccacauggacauccgggggcucacccaggacgacaccgccacguacuucugcgcccgccagaaguucgcgcggggcgaccaggggugguucuucgaccuguggggccgcgggacccugaucguggucagcucc

SEQ ID NO: 10671 - RNA, 372 nt, Artificial Sequence
  derived and/or modified sequence opt1 from anti-HIV-1_HeavyChain
caggcccaccuggagcagagcgccuccggcgugaagcgccccggggcgagcguccggguguccugcuggaccagcgaggacaucuucgagcgcuccgagcucaucuacugggugcggcaggccccgggccaggggcuggaguggaucggcugggucaagaccgugagcggggccgugaaccuggcccccaacuuccgccagcgggucucccucacgcgcgaccgggaccuguucaccgcccacauggacauccgcggccugacccagggcgacaccgcgacguacuucugcgcccggcagaaguucgagcgcgggggccagggguggaucuucgaccucuggggccgggggacccugaucgccgugagcucc

SEQ ID NO: 10672 - RNA, 372 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucaaguccgagcucauccacugggugcggcaggcgccggggcagggccuggaguggaucgggugggucaagaccgugacgggcgccgugaacuucggcagcuccgacuuccgccagcgggucagccugacccgcgacggggaccucuucaccgcccacauggacauccggggccugacccagggggacacggccaccuacuucugcgcccgccagaaguucuacgcgggcgggcagggcugguacuucgaccuguggggccgggggacccucaucaucguguccagc

SEQ ID NO: 10673 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgagcgaccgggaccuguccaccgcccacauggacauccgcgggcucacccaggacgacaccgccacguacuucugcgcgcggcagaaguucgcccgcggcgaccaggggugguucuucgaccuguggggccgggggacccugaucguggugagcucc

SEQ ID NO: 10674 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuccaccgcccacauggacauccgcgggcugacccaggacgacacggccaccuacuucugcgcccggcagaaguucgcgcgcggcgaccaggggugguucuucgaccuguggggccgggggacccucaucguggugagcucc

SEQ ID NO: 10675 - RNA, 372 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucgagcgcgggggccaggggugguacuucgaccuguggggccggggcacccucaucgugguguccagc

SEQ ID NO: 10676 - RNA, 372 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggccaccagaucagcgaccgcgucucccugacccgggaccgcgaccucuucaccgcccacauggacauccgggggcugacccagggcgacacggccaccuacuucugcgcccgccagaaguucuacgccgggggccaggggugguacuucgaccuguggggccggggcacccucaucguggugagcucc

SEQ ID NO: 10677 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccaggacgacacggccaccuacuucugcgcccggcagaaguucgcgcgcggcgaccaggggugguucuucgaccuguggggccgggggacccucaucgugguguccagc

SEQ ID NO: 10678 - RNA, 372 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacauccugaagaccgagcugauccacugggugcggcaggcgcccgggcagggccucgaguggaucgggugggucaaggccguguccggcgccgugaacuacggcagccuggacuuccgccaccgggucucccugacgcgcgaccgggaccucuucaccgcccacauggacauccgcgggcugacccaggacgacaccgccacguacuucugcgcgcggcagaaguucgcccgcggcgaccaggggugguucuucgaccuguggggccgggggacccucaucguggugagcucc

SEQ ID NO: 10679 - RNA, 372 nt, Artificial Sequence
  derived and/or modified sequence opt1 from anti-HIV-1_HeavyChain
gugcgcagcgucgugcagugcgaggccggcgugaagaagcccggggccuccgucaagaucagcugcgcgaccuccggcuacgccuucacccuguacuaccuccacugggugcggcaggccccggggcagggccuggaguggaucgggugggugaagacggucaccggcgccgugaacuucggcagcgccuacuuccgccaccgggugucccugacccccgaccgcgaccucuucaccgcgcacauggacauccgggggcugacgcagggcgacaccgccaccuacuucugcgcccgccagaaguucuacaagggcgggcaggggugguacuucgaccuguggggccggggcacccucaucgucgugagcucc

SEQ ID NO: 10680 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugccuggacagcgaggacaucuucgagcggaccgagcugauccacugggugcgccaggcgcccgggcagggccucgaguggaucgggugggucaaggccguguccggcgccgugaacuacggcagccuggacuuccggcaccgcgucucccugacccgggaccgcgaccucuucacggcccacauggacauccgggggcugacccaggacgacaccgccaccuacuucugcgcgcgccagaaguucgcccggggcgaccaggggugguucuucgaccuguggggccgcgggacgcucaucguggugagcucc

SEQ ID NO: 10681 - RNA, 375 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugacccaggacgacacggccaccuacuucugcgcccggcagaaguucgcgcgcggcgaccaggggugguucuucgaccucuggggccgggggacccugaucguggucuccagc

SEQ ID NO: 10682 - RNA, 375 nt, Artificial Sequence
  derived and/or modified sequence opt1 from anti-HIV-1_HeavyChain
caggcccaccuggagcagagcggcuccggggugaagaagcucggcgccagcgucaaguccagcugcuggaccuccgaggacaucuucgagcgcaccgagcugauccacugggugcggcaggcgcccgggcagggccuggaguggaucgggugggugaaggccgucagcggcgccgugaacuacggcucccucgacuuccgccaccgggugagccugacgcgcgaccgggaccuguccaccgcccacauggacauccgcgggcucacccaggacgacaccgccacguacuucugcgcgcggcagaaguucgcccgcggcgaccaggggugguucuucgaccuguggggccgggggacccugaucgucgugagcucc

SEQ ID NO: 10683 - RNA, 375 nt, Artificial Sequence
  derived and/or modified sequence opt1 from anti-HIV-1_HeavyChain
caggcccaccuggagcagagcggcgccggggugaagaagcccggcgcguccguccgcgugagcugcuggaccuccgaggacaucuucgagcggaccgagcucauccacugggugcgccaggccccggggcagggccuggaguggaucgggugggucaagaucgugagcggcgccgugaacuucggcucccccaacuuccggcagcgcgucagccugacgcgggaccgcgaccucuucaccgcccacauggacauccgggggcugacccagggcgacaccgccacguacuucugcgcgcgccagaaguucgagcgcgggggccagggguggaucuucgaccuguggggccggggcacccucaucgccguguccagc

SEQ ID NO: 10684 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucggguggaugaagacggucaccggcgccgugaacuucggcucccccaacuuccggcaccgcgugagccugacccgggaccgcgaccucuucaccgcccacauggacauccgggggcugacgcagggcgacaccgccaccuacuucugcgcccgccagaaguucgagcgcgggggccaggggugguacuucgaccuguggggccggggcacccucaucgucguguccagc

SEQ ID NO: 10685 - RNA, 375 nt, Artificial Sequence
  derived and/or modified sequence opt1 from anti-HIV-1_HeavyChain
caggcccaccuggagcagagcggcuccgaggugaagaagcccggggccagcguccgcguguccugcuggaccagcgaggacaucuucgagcggaccgagcucauccacugggugcgccaggcgccgggccaggggcuggaguggaucggcugggucaagacggugaccggggccgugaacuucggcucccccaacuuccggcaccgcgucagccugacccgggaccgcgaccucuucaccgcccacauggacauccggggccugacgcagggggacaccgccaccuacuucugcgcccgccagaaguucgagcggggcgggcagggcugguacuucgaccugugggggcgcggcacccucaucgugguguccagc

SEQ ID NO: 10686 - RNA, 375 nt, Artificial Sequence
  derived and/or modified sequence opt1 from anti-HIV-1_HeavyChain
caggcccaccuggagcagagcggcgccggggugaagaagcucggcgcguccguccgcgugagcugcuggaccuccggggacaucuucgagcggaccgagcugauccacugggugcgccaggcccccggccaggggcuggaguggaucggcugggucaaggccgugagcggcgccgugaacuacgggucccucgacuuccggcagcgcgucagccugacgcgggaccgcgaccuguucaccgcccacaucgacauccggggccucacccagggggacaccgcgacguacuucugcgcccgccagaaguucgagcggggcgggcagggcuggaucuucgaccuguggggccgcgggacccugaucgccguguccagc

SEQ ID NO: 10687 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcugggcgagcgaggacaucuucgagcggaccgagcugauccacugggugcgccaggcccccgggcagggccuggaguggaucgggugggucaaggccguguccggcgccgugaacuacggcagccucgacuuccggcaccgcgucucccugacccgggaccgcgaccugagcacggcccacauggacauccgggggcucacccaggacgacaccgcgaccuacuucugcgcccgccagaaguucgcccggggcgaccaggggugguucuucgaccuguggggccgcgggacgcugaucgugguguccagc

SEQ ID NO: 10688 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcaccgugaacuucggcucccagaacuuccggcagcgcgucagccugacccgggaccgcgaccucuucacggcccacauggacauccgggggcugacccagggcgacaccgccaccuacuucugcgcccgccagaaguucgagcgcgggggccagggguggaucuucgaccuguggggccggggcacgcucaucgccguguccagc

SEQ ID NO: 10689 - RNA, 375 nt, Artificial Sequence
  derived and/or modified sequence opt1 from anti-HIV-1_HeavyChain
caggcccaccuggagcagagcggcuccggggugaagcgccccggcgccagcguccggguguccugcuggaccagcgaggacaucuucgagaccacggagcucauccacugggugcgccaggcgccggggcagggccuggaguggaucgggugggucaagaccgugaccggcgccgugaacuucggcucccccaacuuccggcaccgcgucagccugacccgggaccgcgaccucuucacggcccacauggacauccgggggcugacccagggcgacaccgccaccuacuucugcgcccgccagaaguucgagcgcgggggccaggggugguacuucgaccuguggggccggggcacgcucaucgugguguccagc

SEQ ID NO: 10690 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacauccuccggaaguccgagcugauccacugggugcgccaggcgccggggcagggccuggaguggaucgggugggucaagaccgugacgggcgccgugaacuucggcagcuccgacuuccggcagcgcgucagccucacccgggaccgcgaccuguucaccgcccacauggacauccgggggcugacccagggcgacacggccaccuacuucugcgcccgccagaaguucuacgccgggggccaggggugguacuucgaccucuggggccggggcacccugaucgugguguccagc

SEQ ID NO: 10691 - RNA, 372 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucaagaccgagcucauccacugggugcggcaggcgccggggcagggccuggaguggaucgggugggucaagacggugaccggcaccgugaacuucggcucccugaacuuccgccagcgggucagccucacccgcgaccgggaccuguucacggcccacauggacauccgcgggcugacccagggcgacaccgccaccuacuucugcgcccggcagaaguucuacgccgggggccaggggugguacuucgaccucuggggccgcggcacgcugaucgugguguccagc

SEQ ID NO: 10692 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccuguucaccgcccacauggacauccgggggcucacccaggacgacaccgccacguacuucugcgcgcgccagaaguucgcccggggcgaccaggggugguucuucgaccuguggggccgcgggacccugaucguggugagcucc

SEQ ID NO: 10693 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcuccagcgacuuccggcagcgcgucucccugacccgggaccgcgaccucuucaccgcccacauggacauccgggggcugacgcagggcgacaccgccaccuacuucugcgcccgccagaaguucuacgccgggggccaggggugguacuucgaccuguggggccggggcacccucaucguggugagcucc

SEQ ID NO: 10694 - RNA, 375 nt, Artificial Sequence
  derived and/or modified sequence opt1 from anti-HIV-1_HeavyChain
caggugcagcugguccagagcggcgccgaggugaagaagcccggggccuccgugcgcgucagcugcuggaccuccgaggacaucuucgagcggagcgagcucaucuacugggugcgccaggcgccgggccgggggcuggaguggaucggcuggaucaagcugguguccggggccgucaacuucggcagcguggacuuccgcgaccgggugucccucacccgcgaccgggaccuguucacggcccacauggacauccgcggccugacccaggacgacaccgccaccuacuucugcgcccggcagaaguucgcgcgcggggaccagggcugguucuucgaccucugggggcggggcacgcugaucgucgugagcucc

SEQ ID NO: 10695 - RNA, 375 nt, Artificial Sequence
  derived and/or modified sequence opt1 from anti-HIV-1_HeavyChain
caggcccaccuggagcagagccgcuccggcgugaagaagcccggggccagcguccggguguccugcuggaccagcgaggacaucuucgagcgcaccgagcucauccacugggugcggcaggcgccgggccaggggcuggaguggaucggcugggucaaggccguguccggggccgugaacuucggcagccccaacuuccgccaccgggucucccugacgcgcgaccgggaccucagcaccgcccacauggacauccgcggccugacccaggacgacaccgccacguacuucugcgcgcggcagaaguucgcccgcggggaccagggcugguucuucgaccugugggggcggggcacccucaucgugguguccagc

SEQ ID NO: 10696 - RNA, 375 nt, Artificial Sequence
  derived and/or modified sequence opt1 from anti-HIV-1_HeavyChain
cagagcuaccuggagcaguccggcagcgcgaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccuguucaccgcccacauggacauccgcggccugacccagggcgacacggccaccuacuucugcgcccggcagaaguucuacgccgggggccaggggugguacuucgaccucuggggccgcgggacccugaucguggucagcucc

SEQ ID NO: 10697 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaagaccgagcucauccacugggugcggcaggcgccggggcagggccuggaguggaucgggugggucaaggccguguccggcgccgugaacuacggcagccuggacuuccgccaccgggucucccucacgcgcgaccgggaccuguucaccgcccacauggacauccgcgggcugacccaggacgacaccgccacguacuucugcgcgcggcagaaguucgcccgcggcgaccaggggugguucuucgaccucuggggccgggggacccugaucguggugagcucc

SEQ ID NO: 10698 - RNA, 372 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucuacgccgggggccaggggugguacuucgaccuguggggccgcggcacccucaucgugguguccagc

SEQ ID NO: 10699 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccccaacuuccggcaccgcgucucccugacccgggaccgcgaccucuucaccgcccacauggacauccgggggcugacccaggacgacacggccaccuacuucugcgcccgccagaaguucgcgcggggcgaccaggggugguucuucgaccuguggggccgcgggacccucaucguggugagcucc

SEQ ID NO: 10700 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagaucguguccggcgccgugaacuucggcagccccaacuuccggcagcgcgucucccugacgcgggaccgcgaccucuucaccgcccacauggacauccgggggcugacccagggcgacaccgccacguacuucugcgcccgccagaaguucgcgcgcggggaccagggcugguucuucgaccugugggggcggggcacccucaucguggugagcucc

SEQ ID NO: 10701 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccuguucaccgcccacauggacauccgggggcucacccagggcgacaccgccacguacuucugcgcgcgccagaaguucuacgccgggggccaggggugguacuucgaccuguggggccggggcacccugaucguggugagcucc

SEQ ID NO: 10702 - RNA, 375 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugacccagggcgacacggccaccuacuucugcgcccggcagaaguucgagcgcgggggccaggggugguacuucgaccucuggggccgggggacccugaucguggucuccagc

SEQ ID NO: 10703 - RNA, 375 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgccagcgggugagccucacccgcgaccgggaccuguucaccgcccacauggacauccgcggccugacgcagggcgacaccgccaccuacuucugcgcccggcagaaguucgagcgcgggggccagggguggaucuucgaccucuggggccgggggacccugaucgcggucuccagc

SEQ ID NO: 10704 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcaccgugaacuucggcucccugaacuuccggcagcgcgucagccucacccgggaccgcgaccuguucacggcccacauggacauccgggggcugacccagggcgacaccgccaccuacuucugcgcccgccagaaguucgagcgcgggggccagggguggaucuucgaccucuggggccggggcacgcugaucgccguguccagc

SEQ ID NO: 10705 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacgcagggcgacaccgccaccuacuucugcgcccgccagaaguucgagcgcgggggccaggggugguacuucgaccuguggggccggggcacccucaucgugguguccagc

SEQ ID NO: 10706 - RNA, 375 nt, Artificial Sequence
  derived and/or modified sequence opt1 from anti-HIV-1_HeavyChain
cgccacaccguggagcagagcggcuccggggucaagaagcccggcgccagcgugcggguguccugcuggaccagcgaggacaucuucgagcgcacggagcugauccacuggguccggcaggccccggggcagggccucgaguggaucgggugggugaagaccguguccggcgcggucaacuucggcagccccaacuuccgccaccgggugucccugacccgcgaccgggaccuguucaccgcccacauggacauccgcgggcucacgcagggcgacaccgccaccuacuucugcgcccggcagaaguucgagcgcgggggccaggggugguacuucgaccuguggggccggggcacccugaucguggucagcucc

SEQ ID NO: 10707 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucgagcgcgggggccaggggugguacuucgaccuguggggccggggcacccucaucgugguguccagc

SEQ ID NO: 10708 - RNA, 375 nt, Artificial Sequence
  derived and/or modified sequence opt1 from anti-HIV-1_HeavyChain
cgccacaccugggagcagagcggcuccggggugaagaagcugggcgccagcguccggguguccugcuggaccagcgaggacaucuucgagcgcacggagcucauccacugggugcggcaggcccccgggcagggccuggaguggaucggguggaugaaggcggucuccggcgccgugaacuacggcagccuggacuuccgccaccgggugucccucacccgcgaccgggaccugagcaccgcccacaucgacauccgcgggcugacccaggacgacacggccaccuacuucugcgcccggcagaaguucgcgcgcggcgaccaggggugguucuucgaccucuggggccgggggacccugaucgucguguccagc

SEQ ID NO: 10709 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaagacggugaccggcgccgugaacuucggcuccccgaacuuccggcaccgcgucagccucacccgggaccgcgaccuguucaccgcccacauggacauccgggggcugacgcagggcgacaccgccaccuacuucugcgcccgccagaaguucgagcgcgggggccaggggugguacuucgaccucuggggccggggcacccugaucgugguguccagc

SEQ ID NO: 10710 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacgcagggcgacaccgccaccuacuucugcgcccgccagaaguucgagcgcgggggccagggguggaucuucgaccuguggggccggggcacccucaucgcgguguccagc

SEQ ID NO: 10711 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccaccgggucagccugacccgcgaccgggaccucuucaccgcccacauggacauccgcgggcugacccagggcgacacggccaccuacuucugcgcccggcagaaguacuacgccgggggccaggggugguacuucgaccuguggggccgcggcacccucaucgugguguccagc

SEQ ID NO: 10712 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggggauccgcggccugacccagggggacacggccaccuacuucugcgcccggcagaaguucuacgcgggcgggcagggcugguacuucgaccuguggggccgcgggacccucaucgugguguccagc

SEQ ID NO: 10713 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucuuccugacccgcgaccgggaccucuucaccgcccacauggacauccgcgggcugacccagggcgacacggccaccuacuucugcgcccggcagaaguucuacgccgggggccaggggugguacuucgaccuguggggccgcggcacccucaucguggugagcucc

SEQ ID NO: 10714 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaaggccguguccggcgccgugaacuacggcagccuggacuuccggcaccgcgucucccucacgcgggaccgcgaccugagcaccgcccacauggacauccgggggcugacccaggacgacaccgccacguacuucugcgcgcgccagaaguucgcccggggcgaccaggggugguucuucgaccucuggggccgcgggacccugaucgugguguccagc

SEQ ID NO: 10715 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagccaggacuuccgcgaccgguucucccugacccgcgaccgggaccucuucaccgcccacauggacauccgcgggcugacccagggcgacacggccaccuacuucugcgcccggcagaaguucuacgccgggggccaggggugguacuucgaccuguggggccgcggcacccucaucgucgugagcucc

SEQ ID NO: 10716 - RNA, 375 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacgcgaccggccucaucuacugggugcggcaggccccggggcagggccuggaguggaucgggugggugaagaucgucagcggcacggugaacuucgccucccuggacuuccgccagcgggugagccucacccgcgaccgggaccuguucaccgcccacauggacauccgcggccugacccagggggacacggccaccuacuucugcgcgcggcagaaguucuacgccggcgggcagggcugguacuucgaccucugggggcgcggcacccugaucgucguguccagc

SEQ ID NO: 10717 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccugagcaccgccuacauggacauccgggggcucacccaggacgacaccgccacguacuucugcgcgcgccagaaguucgcccggggcgaccaggggugguucuucgaccuguggggccgcgggacccugaucgugguguccagc

SEQ ID NO: 10718 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccuguucaccgcccacauggacauccgggggcucacccaggacgacaccgccaucuaccugugcgcgcgccagaaguucgcccggggcgaccaggggugguucuucgaccuguggggccgcgggacgcucaucguggugagcucc

SEQ ID NO: 10719 - RNA, 375 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugacccagggcgacacggccaccuacuucugcgcccggcagaaguucgagcgcgggggccagggguggaucuucgaccucuggggccgggggacccugaucgcgguguccagc

SEQ ID NO: 10720 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagccccaacuuccgccaccgggucucccugacccgcgaccgggaccucuucaccgcccacauggacauccgcgggcugacccagggcgacacggccaccuacuucugcgcccggcagaaguucgagcgcgggggccaggggugguacuucgaccuguggggccggggcacccucaucguggugagcucc

SEQ ID NO: 10721 - RNA, 375 nt, Artificial Sequence
  derived and/or modified sequence opt1 from anti-HIV-1_HeavyChain
caggcgcaccccgagcagagcggcuccggggugaagaagccgggcgccagcguccgcguguccugcuggaccagcgaggacaucuucgagaaguccgagcugauccacugggugcggcaggcgcccgggcagggccucgaguggaucgggugggucaagaccgugacgggcgccgugaacuucggcagcuccgacuuccgccagcgggucagccugacccgcgaccgggaccuguucaccgcccacauggacauccgcgggcucacccagggcgacacggccaccuacuucugcgcccggcagaaguucuacgccgggggccaggggugguacuucgaccuguggggccgcggcacccugaucgugguguccagc

SEQ ID NO: 10722 - RNA, 375 nt, Artificial Sequence
  derived and/or modified sequence opt1 from anti-HIV-1_HeavyChain
cgcgcgcaccuggagcagagcggcuccggggugcggaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucuacgccgggggccaggggugguacuucgaccuguggggccgcggcacccucaucgugguguccagc

SEQ ID NO: 10723 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccccaacuuccggcaccgcgucucccugacccgggaccgcgaccucuucaccgcccacauggacauccgggggcugacccagggcgacacggccaccuacuucugcgcccgccagaaguucgagcgcgggggccagggguggaucuucgaccuguggggccggggcacccucaucgcggugagcucc

SEQ ID NO: 10724 - RNA, 375 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagaaguccgagcucauccacugggugcggcaggcgccgggccaggggcuggaguggaucggcugggugaagaccgucacgggggccgugaacuucggcagcagcgacuuccgccagcgggugucccugacccgcgaccgggaccucuucaccgcccacauggacauccgcggccugacccagggggacacggccaccuacuucugcgcccggcagaaguucuacgcgggcgggcagggcugguacuucgaccugugggggcgcggcacccucaucgucgugagcucc

SEQ ID NO: 10725 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucuacgccgggggccaggggugguacuucgaccuguggggccgcggcacccacaucgugguguccagc

SEQ ID NO: 10726 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagaucguguccggcgccgugaacuucggcagccccaacuuccggcagcgcgucucccugacgcgggaccgcgaccucuucaccgcccacauggacauccgggggcugacccagggcgacaccgccacguacuucugcgcccgccagaaguucgagcgcgggggccagggguggaucuucgaccuguggggccggggcacccucaucgcggugagcucc

SEQ ID NO: 10727 - RNA, 375 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccuccagcgacuuccgccaccgggugucccugacccgcgaccgggaccucagcaccgcccacauggacauccgcggccugacgcaggacgacaccgccaccuacuucugcgcccggcagaaguucgcgcgcggcgaccaggggugguucuucgaccuguggggccgggggacccucaucgucguguccagc

SEQ ID NO: 10728 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagaucguguccggcgccgugaacuucggcagccccaacuuccggcagcgcgucucccugacgcgggaccgcgaccucuucaccgcccacauggacauccgggggcugacccagggcgacaccgccacguacuucugcgcccgccagaaguucuacgccgggggccaggggugguacuucgaccuguggggccggggcacccucaucguggugagcucc

SEQ ID NO: 10729 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagcgguccgagcucauccacugggugcgccaggcgccggggcagggccuggaguggaucgggugggucaagaccgugacgggcgccgugaacuucggcagccccaacuuccggcagcgcgucucccugacccgggaccgcgaccucuucaccgcccacauggacauccgggggcugaccgagggcgacacggccaccuacuucugcgcccgccagaaguucuacgccgggggccaggggugguacuucgaccuguggggccggggcacccucaucguggugagcucc

SEQ ID NO: 10730 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgccaacuacggcagccucgacuuccggcaccgcgugucccugacgcgggaccgcgaccuguucaccgcccacauggacauccgggggcucacccaggacgacaccgcgacguacuucugcgcccgccagaaguucgcccggggcgaccaggggugguucuucgaccuguggggccgcgggacccugaucgucgugagcucc

SEQ ID NO: 10731 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugagcggcgccgugaacuucggcucccccaacuuccgccaccgggucagccugacgcgcgaccgggaccucuucaccgcccacauggacauccgcgggcugacccagggcgacaccgccacguacuucugcgcccggcagaaguucgagcgcgggggccaggggugguacuucgaccuguggggccggggcacccucaucgugguguccagc

SEQ ID NO: 10732 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuucggcagcccgaacuuccggcaccgcgucucccucacgcgggaccgcgaccuguucaccgcccacauggacauccgggggcugacccagggcgacaccgccacguacuucugcgcgcgccagaaguucgagcgcgggggccaggggugguacuucgaccucuggggccggggcacccugaucguggugagcucc

SEQ ID NO: 10733 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagaucguguccggcgccgugaacuucggcagccccaacuuccggcagcgcgucucccugacgcgggaccgcgaccucuucaccgcccacauggacauccgggggcugacccagggcgacaccgccacguaccugugcgcccgccagaaguucgagcgcgggggccagggguggaucuucgaccucuggggccggggcacccugaucgcggugagcucc

SEQ ID NO: 10734 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugagcggcgccgugaacuucggcucccccaacuuccggcaccgcgucagccugacgcgggaccgcgaccucuucaccgcccacauggacauccgggggcugacccagggcgacaccgccacguacuucugcgcccgccagaaguucgagcgcgggggccaggggugguacuucgaccuguggggccggggcacccucaucgugguguccagc

SEQ ID NO: 10735 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcaccgugaacuucggcucccugaacuuccggcagcgcgucagccucacccgggaccgcgaccuguucacggcccacauggacauccgggggcugacccagggcgacaccgccaccuacuucugcgcccgccagaaguucuacgccgggggccaggggugguacuucgaccucuggggccggggcacgcugaucgugguguccagc

SEQ ID NO: 10736 - RNA, 375 nt, Artificial Sequence
  derived and/or modified sequence opt1 from anti-HIV-1_HeavyChain
caggcccaccuggagcagagcgccuccggcgugaagcgccccggggcgagcguccggguguccugcuggaccagcgaggacaucuucgagcgcuccgagcucaucuacugggugcggcaggccccgggccaggggcuggaguggaucggcugggucaagaccgugagcggggccgugaacuucggcuccacggacuuccgcgagcgggucagccugacccgcgaccgggaccucuucaccgcccacauggacauccgcggccugacccagggggacacggccaccuacuucugcgcgcggcagaaguucgcccgcggcgaccaggggugguucuucgaccuguggggccgggggacccucaucgugguguccagc

SEQ ID NO: 10737 - RNA, 375 nt, Artificial Sequence
  derived and/or modified sequence opt1 from anti-HIV-1_HeavyChain
caggugcaccuggagcagagcggcuccggggucaagaagcccggcgccagcgugcgcguguccugcuggaccagcgaggacaucuucgagcgguccgagcucauccacuggguccgccaggccccggggcagggccuggaguggaucgggugggugaagaccgugacgggcgcggucaacuucggcagccccaacuuccggcaccgcgugucccugacccgggaccgcgaccucuucaccgcccacauggacauccgggggcugacccagggcgacacggccaccuacuucugcgcccgccagaaguacuacgccgggggccaggggugguacuucgaccuguggggccggggcacccucaucguggucagcucc

SEQ ID NO: 10738 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacaucugcgggcugacccagggcgacacggccaccuacuucugcgcccgccagaaguucuacgccgggggccaggggugguacuucgaccuguggggccggggcacccucaucgugguguccagc

SEQ ID NO: 10739 - RNA, 375 nt, Artificial Sequence
  derived and/or modified sequence opt1 from anti-HIV-1_HeavyChain
caggcccaccuggagcagagcggcuccggggugaagaagcccgaggccagcguccgcguguccugcuggaccagcgaggacaucuucgagaaguccgagcucauccacugggugcggcaggcgccgggccaggggcuggaguggaucggcugggucaagaccgugacgggggccgugaacuucggcagcuccgacuuccgccagcgggucagccugacccgcgaccgggaccucuucaccgcccacauggacauccgcggccugacccagggggacacggccaccuacuucugcgcccggcagaaguucuacgcgggcgggcagggcugguacuucgaccugugggggcgcggcacccucaucgugguguccagc

SEQ ID NO: 10740 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcagcgcgucagccugacccgggaccgcgaccucuucaccgcccacauggacauccgggggcugacgcagggcgacaccgccaccuacuucugcgcccgccagaaguucgagcgcgggggccagggguggaucuucgaccuguggggccggggcacccucaucgcgguguccagc

SEQ ID NO: 10741 - RNA, 375 nt, Artificial Sequence
  derived and/or modified sequence opt1 from anti-HIV-1_HeavyChain
caggcccaccuggagcagagcgccuccggcgugaagcgccccggggcgagcguccggguguccugcuggaccagcgaggacaucuucgagcgcaccgagcucaucuacugggugcggcaggccccgggccaggggcuggaguggaucggcugggucaagacgguguccggggccgugaacuucggcagccaggacuuccgcgaccgguucucccugacccgcgaccgggaccucuucaccgcccacauggacauccgcggccugacccagggggacacggccaccuacuucugcgcgcggcagaaguucgagcgcggcgggcagggcugguacuucgaccugugggggcggggcacccucaucgucgugagcucc

SEQ ID NO: 10742 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaucgugagcggcgccgugaacuucggcucccccaacuuccgccagcgggucagccugacccgcgaccgggaccucuucacggcccacauggacauccgcgggcugacccagggcgacaccgccaccuacuucugcgcccggcagaaguucgagcgcgggggccagggguggaucuucgaccuguggggccggggcacgcucaucgcgguguccagc

SEQ ID NO: 10743 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccccuucaccgcccacauggacauccgggggcucacgcagggcgacaccgccaccuacuucugcgcccgccagaaguucgagcgcgggggccaggggugguacuucgaccuguggggccggggcacccugaucgugguguccagc

SEQ ID NO: 10744 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgggcucauccacugggugcggcaggcgccgggccaggggcuggaguggaucggcugggucaagaccgugacgggcgccgugaacuucgggagcuccgacuuccgccagcgggucagccugacccgcgaccgggaccucuucaccgcccacauggacauccgcggccugacccagggggacacggccaccuacuucugcgcccggcagaaguucuacgcgggcgggcagggcugguacuucgaccuguggggccgcgggacccucaucgugguguccagc

SEQ ID NO: 10745 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaaggccgugagcggcaccgugaacuacggcucccuggacuuccgccaccgggucagccucacgcgcgaccgggaccuguucaccgcccacauggacauccgcgggcugacccaggacgacaccgccacguacuucugcgcccggcagaaguucgcgcgcggcgaccaggggugguucuucgaccucuggggccgggggacccugaucgugguguccagc

SEQ ID NO: 10746 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagggguccgagcucauccacugggugcggcaggcgccgggccaggggcuggaguggaucggcugggucaagaccgugacgggcgccgugaacuucgggagcgccuacuuccgccaccgggucucccugacccgcgaccgggaccucuucaccgcccacauggacauccgcggccugacccagggggacacggccaccuacuucugcgcgcggcagaaguucuacgccggcgggcagggcugguacuucgaccuguggggccgcgggacccucaucguggugagcucc

SEQ ID NO: 10747 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccuggacuuccggcaccgcaucucccucacccgggaccgcgaccuguucaccgcccacauggacauccgggggcugacccagggcgacacggccaccuacuucugcgcccgccagaaguucuacgccgggggccaggggugguacuucgaccucuggggccggggcacccugaucgucgugagcucc

SEQ ID NO: 10748 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaaggccgugagcggcgccgugaacuacggcucccuggacuuccggcaccgcgucagccucacccgggaccgcgaccuguccacggcccacauggacauccgggggcugacccaggacgacaccgccacccacuucugcgcgcgccagaaguucgcccggggcgaccaggggugguucuucgaccucuggggccgcgggacgcugaucguggugagcucc

SEQ ID NO: 10749 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgaggggaccgagcucauccacugggugcggcaggcgccgggccaggggcuggaguggaucggcugggucaagaucguguccggcgccgugaacuucgggagccccaacuuccgccagcgggucucccugacgcgcgaccgggaccucuucaccgcccacauggacauccgcggccugacccagggggacaccgccacguacuucugcgcccggcagaaguucgagcgcggcgggcagggcuggaucuucgaccuguggggccgggggacccucaucgcggugagcucc

SEQ ID NO: 10750 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcagcgcgucagccugacccgggaccgcgaccucuucaccgcccacauggacauccgggggcugacgcagggcgacaccgccaccuacuucugcgcccgccagaaguucuacgccgggggccaggggugguacuucgaccuguggggccggggcacccucaucgugguguccagc

SEQ ID NO: 10751 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagggguccgagcucauccacugggugcggcaggcgccgggccaggggcuggaguggaucggcugggucaagaccgugacgggcgccgugaacuucgggagccccaacuuccgccaccgggucucccugacccgcgaccgggaccucuucaccgcccacauggacauccgcggccugacccagggggacacggccaccuacuucugcgcccggcagaaguucgagcgcggcgggcagggcugguacuucgaccuguggggccgggggacccucaucguggugagcucc

SEQ ID NO: 10752 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccccaacuuccggcaccgcgucucccugacccgggaccgcgaccucuucaccgcccacauggacauccgggggcugacccagggcgacacggccaccuacuucugcgcccgccagaaguucgcgcgcggggaccagggcugguucuucgaccugugggggcggggcacccucaucguggugagcucc

SEQ ID NO: 10753 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggggaucuucgagcggaccgagcucauccacugggugcgccaggcgccgggccaggggcuggaguggaucggcugggucaagaucguguccggcgccgugaacuucgggagccccaacuuccggcagcgcgucucccugacgcgggaccgcgaccucuucgccgcccacauggacauccggggccugacccagggggacaccgccaccuacuucugcgcgcgccagaaguucgagcggggcgggcagggcuggaucuucgaccuguggggccgcgggacgcucaucgccgugagcucc

SEQ ID NO: 10754 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcgggcggagcugauccacugggugcgccaggcccccgggcagggccuggaguggaucgggugggucaaggccguguccggcgccgugaacuacggcagccucgacuuccggcaccgcgucucccugacccgggaccgcgaccuguucacggcccacauggacauccgggggcucacccaggacgacaccgcgaucuacuucugcgcccgccagaaguucuacgccggcgggcagggcugguacuucgaccugugggggcggggcacccugaucguggugagcucc

SEQ ID NO: 10755 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagcccgaacuuccggcagcgcgucucccucacgcgggaccgcgaccuguucaccgcccacauggacauccgggggcugacccagggcgacaccgccacguacuucugcgcgcgccagaaguucgagcgcgggggccagggguggaucuucgaccucuggggccggggcacccugaucgccgugagcucc

SEQ ID NO: 10756 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuacggcucccugaacuuccggagccgcaucucccucacccgggaccgcgaccuguucaccgcccacauggacauccgggggcugacggagggcgacaccgccaccuacuucugcgcccgccagaaguucuacgccgggggccaggggugguacuucgaccucuggggccggggcacccugaucgucgugagcucc

SEQ ID NO: 10757 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugagcggcgccgugaacuucggcucccccaacuuccgccagcgggucagccugacgcgcgaccgggaccucuucaccgcccacauggacauccgcgggcugacccagggcgacaccgccacguacuucugcgcccggcagaaguucgagcgcgggggccagggguggaucuucgaccuguggggccggggcacccucaucgcgguguccagc

SEQ ID NO: 10758 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggauccggugggucaaggccguguccggggccgugaacuacggcagccucgacuuccgccaccgggucucccugacgcgcgaccgggaccugagcaccgcccacauggacauccgcggccucacccaggacgacaccgccacguacuucugcgcgcggcagaaguucgcccgcggggaccagggcugguucuucgaccugugggggcggggcacccugaucgugguguccagc

SEQ ID NO: 10759 - RNA, 375 nt, Artificial Sequence
  derived and/or modified sequence opt1 from anti-HIV-1_HeavyChain
caggcgcaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaagacggugaccggcgccgugaacuucggcuccagcgacuuccggcagcgcgucucccucacccgggaccgcgaccuguucaccgcccagauggacauccgggggcugacgcagggcgacaccgccaccuacuucugcgcccgccagaaguucuacgccgggggccaggggugguacuucgaccucuggggccggggcacccugaucguggugagcucc

SEQ ID NO: 10760 - RNA, 372 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucgcccaccagaucagcgaccgcgucucccugacccgggaccgcgaccucuucaccgcccacauggacauccggggccugacccagggggacacggccaccuacuucugcgcgcgccagaaguucuacgccggcgggcagggcugguacuucgaccugugggggcggggcacccucaucguggugagcucc

SEQ ID NO: 10761 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaaggugguguccggcgccgucaacuucggcagccccaacuuccggcagcgcgugucccugacgcgggaccgcgaccucuucaccgcccacauggacauccgggggcugacccagggcgacaccgccacguacuucugcgcccgccagaaguucgagcgcgggggccagggguggaucuucgaccuguggggccggggcacccucaucgcggugagcucc

SEQ ID NO: 10762 - RNA, 375 nt, Artificial Sequence
  derived and/or modified sequence opt1 from anti-HIV-1_HeavyChain
caggugcaccuggagcagagcggcuccggggucaagaagcccggcgccagcgugcgcguguccugcuggaccagcgaggacaucuucgagaaguccgagcucauccacuggguccggcaggccccggggcagggccuggaguggaucgggugggugaagaccgugacgggcgcggucaacuucggcagcuccgacuuccgccagcgggugagccugacccgcgaccgggaccucuucaccgcccacauggacauccgcgggcugacccagggcgacacggccaccuacuucugcgcccggcagaaguucuacgccgggggccaggggugguacuucgaccuguggggccgcggcacccucaucguggucuccagc

SEQ ID NO: 10763 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccuggacuuccggcaccgcaucucccucacccgggaccgcgaccuguucaccgcccacauggacauccgggggcugacccagggcgacacggccaccuacuucugcgcccgccagaaguucgagcgcgggggccagggguggaucuucgaccucuggggccggggcacccugaucgcggucagcucc

SEQ ID NO: 10764 - RNA, 375 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgccuacauggacauccgcggccugacccaggacgacacggccaccuacuucugcgcccggcagaaguucgcgcgcggcgaccaggggugguucuucgaccucuggggccgggggacccugaucguggucuccagc

SEQ ID NO: 10765 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacgcagggcgacaccgccaccuaccugugcgcccgccagaaguucgagcgcgggggccaggggugguacuucgaccucuggggccggggcacccugaucgugguguccagc

SEQ ID NO: 10766 - RNA, 372 nt, Artificial Sequence
  derived and/or modified sequence opt1 from anti-HIV-1_HeavyChain
cgccacaccugggagcagagcggcuccggggugaagaagcccggcgccagcguccggguguccugcuggaccagcgaggacaucuucaaguccgagcugauccacugggugcgccaggccccggggcagggccucgaguggaucgggugggucaagacggugaccggcgcggugaacuucggcagcuccgacuuccggcagcgcgucagccugacccgggaccgcgaccuguucaccgcccacauggacauccgggggcucacgcagggcgacaccgccaccuacuucugcgcccgccagaaguucuacgccgggggccaggggugguacuucgaccuguggggccggggcacccugaucgugguguccagc

SEQ ID NO: 10767 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacggagggcgacaccgccaccuacuucugcgcccgccagaaguucuacgccgggggccaggggugguacuucgaccuguggggccggggcacccucaucgugguguccagc

SEQ ID NO: 10768 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcuccgccuacuuccggcaccgcgucagccugacccgggaccgcgaccucuucaccgcccacauggacauccgggggcugacgcagggcgacaccgccaccuacuucugcgcgcgccagaaguucuacaagggcgggcaggggugguacuucgaccuguggggccggggcacccucaucgugguguccagc

SEQ ID NO: 10769 - RNA, 375 nt, Artificial Sequence
  derived and/or modified sequence opt1 from anti-HIV-1_HeavyChain
caggcccaccuggagcagagcggccccggggugaagaagcucggcgccuccguccgcgugagcugcuggaccuccgaggacaucuucgagcggaccgagcugauccacugggugcgccaggcgccggggcagggccuggaguggaucgggugggucaaggccgugagcggcgccgugaacuacggcucccucgacuuccggcaccgcgucagccugacgcgggaccgcgaccuguucaccgcccacauggacauccgggggcucacccaggacgacaccgccacguacuucugcgcgcgccagaaguucgcccggggcgaccaggggugguucuucgaccuguggggccgcgggacccugaucgugguguccagc

SEQ ID NO: 10770 - RNA, 375 nt, Artificial Sequence
  derived and/or modified sequence opt1 from anti-HIV-1_HeavyChain
cgcgcccaccuggagcagagcggcuccggggugaagaagcccggcgccagcguccggguguccugcuggaccagcgaggacaucuucgagcgcaccgagcucauccacugggugcggcaggcgccggggcagggccuggaguggaucgggugggucaagaucguguccggcgccgugaacuucggcagccccaacuuccgccagcgggucucccugacgcgcgaccgggaccucuucaccgcccacauggacauccgcgggcugacccagggcgacaccgccacguacuucugcgcccggcagaaguucgagcgcgggggccagggguggaucuucgaccuguggggccggggcacccucaucgcggugagcucc

SEQ ID NO: 10771 - RNA, 375 nt, Artificial Sequence
  derived and/or modified sequence opt1 from anti-HIV-1_HeavyChain
caggcgcaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaagacggugaccggcgccgugaacuucggcuccagcgacuuccggcagcgcgucucccucacccgggaccgcgaccuguucaccgcccacauggacauccgggggcugacgcagggcgacaccgccaccuacuucugcgcccgccagaaguucuacgccgggggccaggggugguacuucgaccucuggggccggggcacccugaucguggugagcucc

SEQ ID NO: 10772 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaaggccgugagcggcgccgugaacuacggcucccuggacuuccggcaccgcgucagccucacccgggaccgcgaccuguucacggcccacauggacauccgggggcugacccaggacgacaccgccaucuacuucugcgcgcgccagaaguucgcccggggcgaccaggggugguucuucgaccucuggggccgcgggacccugaucgugguguccagc

SEQ ID NO: 10773 - RNA, 375 nt, Artificial Sequence
  derived and/or modified sequence opt1 from anti-HIV-1_HeavyChain
caggcccaccuggagcagagcggcuccggggugaagaaggucggcgccagcgugcgcguguccugcuggaccagcgaggacaucuucgagcggaccgagcucauccacuggguccgccaggcgcccgggcagggccuggaguggaucgggugggugaaggccguguccggcgccgucaacuacggcagccuggacuuccggcaccgcgugucccucacgcgggaccgcgaccuguucaccgcccacauggacauccgggggcugacccaggacgacaccgccaucuacuucugcgcgcgccagaaguucgcccggggcgaccaggggugguucuucgaccucuggggccgcgggacgcugaucguggucagcucc

SEQ ID NO: 10774 - RNA, 375 nt, Artificial Sequence
  derived and/or modified sequence opt1 from anti-HIV-1_HeavyChain
caggugcagcugguccagagcggcgccgagcucaagaagcccggguccagcgugcgcguguccugcuggaccagcgaggacaucuucgagggcuccgagcugauccacuggguccggcaggccccggggcagggccuggaguggaucgggugggugaagaccgugacgggcgcggucaacuucggcagcgccuacuuccgccaccgggugucccucacccgcgaccgggaccuguucaccgcccacauggacauccgcgggcugacccagggcgacacggccaccuacuucugcgcccggcagaaguucuacaagggcgggcaggggugguacuucgaccucuggggccgcggcacccugaucguggucagcucc

SEQ ID NO: 10775 - RNA, 375 nt, Artificial Sequence
  derived and/or modified sequence opt1 from anti-HIV-1_HeavyChain
caggcccaccuggagcagagcggcuccggggugaagaagcccggcgucagcgugcgcguguccugcuggaccagcgaggacaucuucgagcggaccgagcucauccacuggguccgccaggccccggggcagggccuggaguggaucgggugggugaagaucguguccggcgcggucaacuucggcagccccaacuuccggcagcgcgugucccugacgcgggaccgcgaccucuucaccgcccacauggacauccgggggcugacccagggcgacaccgccacguacuucugcgcccgccagaaguucgagcgcgggggccagggguggaucuucgaccuguggggccggggcacccucaucgccgugagcucc

SEQ ID NO: 10776 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggugguguccggcgccgucaacuacggcagccucgacuuccggcaccgcgugucccugacgcgggaccgcgaccuguucaccgcccacauggacauccgggggcucacccaggacgacaccgccacguacuucugcgcccgccagaaguucgcgcggggcgaccaggggugguucuucgaccuguggggccgcgggacccugaucguggucagcucc

SEQ ID NO: 10777 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccuguucaccgcccacauggacauccgggggcucacccaggacgacaccgccgcguacuucugcgcccgccagaaguucgcccggggcgaccaggggugguucuucgaccuguggggccgcgggacgcugaucguggugagcucc

SEQ ID NO: 10778 - RNA, 375 nt, Artificial Sequence
  derived and/or modified sequence opt1 from anti-HIV-1_HeavyChain
caggcgcaccuggagcagagcggcuccggggugcgcaagcccggcgccagcguccggguguccugcuggaccagcgaggacaucuucgagaaguccgagcucauccacugggugcgccaggcgccggggcagggccuggaguggaucgggugggucaagaccgugacgggcgccgugaacuucggcagcuccgacuuccggcagcgcgucagccugacccgggaccgcgaccucuucaccgcccacauggacauccgggggcugacccagggcgacacggccaccuacuucugcgcccgccagaaguucuacgccgggggccaggggugguacuucgaccuguggggccggggcacccucaucgugguguccagc

SEQ ID NO: 10779 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcaccgugaacuucggcucccugaacuuccggcagcgcgucagccucacccgggaccgcgaccuguucacggcccacauggacauccgggggcugacccagggcgacaccgccaccuacuucugcgcccgccagaaguucuacaagggcgggcaggggugguacuucgaccucuggggccggggcacgcugaucgugguguccagc

SEQ ID NO: 10780 - RNA, 375 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucauccacugggugcgccaggcgccgggccaggggcuggaguggaucggcugggugaaggccgucagcggggccgugaacuacggcucccuggacuuccggcaccgcgugagccucacgcgggaccgcgaccuguucaccgcccacauggacauccggggccugacccaggacgacaccgccacguacuucugcgcgcgccagaaguucgcccgcggggaccagggcugguucuucgaccucugggggcggggcacccugaucgucguguccagc

SEQ ID NO: 10781 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccuggacuuccggcaccgcgucucccucacccgggaccgcgaccuguucaccgcccacauggacauccgggggcugacccagggcgacacggccaccuacuucugcgcccgccagaaguucgcgcgcggggaccagggcugguucuucgaccucugggggcggggcacccugaucguggugagcucc

SEQ ID NO: 10782 - RNA, 375 nt, Artificial Sequence
  derived and/or modified sequence opt1 from anti-HIV-1_HeavyChain
caggcccaccuggagcagagcggcuccggggugaagcgccccggcgccagcguccggguguccugcuggaccagcgaggacaucuucgagaccacggagcucauccacugggugcgccaggcgccggggcagggccuggaguggaucgggugggucaagaccguguccggcgccgugaacuucggcagccugaacuuccggcaccgcgucucccucacccgggaccgcgaccuguucaccgcccacauggacauccgggggcugacgcagggcgacaccgccaccuacuucugcgcccgccagaaguucuacaagggcgggcaggggugguacuucgaccucuggggccggggcacccugaucguggugagcucc

SEQ ID NO: 10783 - RNA, 375 nt, Artificial Sequence
  derived and/or modified sequence opt1 from anti-HIV-1_HeavyChain
caggcccaccuggagcagagcgccuccggcgugcgccggcccggggcgagcguccgcguguccugcuggaccagcgaggacaucuucgagcgguccgagcucaucuacugggugcgccaggccccgggccgggggcuggaguggaucggcuggaucaagcuggucagcggggccgugaacuucggcuccguggacuuccgcgaccgggucagccucacccgcgaccgggaccuguucacggcccacauggacauccgcggccugacccagggggacaccgccaccuacuucugcgcgcggcagaaguucuacgccggcgggcagggcugguacuucgaccucugggggcgcggcacgcugaucgugguguccagc

SEQ ID NO: 10784 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaucgugagcggcgccgugaacuucggcucccccaacuuccggcagcgcgucagccugacccgggaccgcgaccucuucacggcccacauggacauccgggggcugacccagggcgacaccgccaccuacuucugcgcccgccagaaguucgagcgcgggggccagggguggaucuucgaccuguggggccggggcacgcucaucgcgguguccagc

SEQ ID NO: 10785 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaagacgguguccggcgccgugaacuucggcagcccgaacuuccggcaccgcgucucccucacccgggaccgcgaccuguucaccgcccacauggacauccgggggcugacccagggcgacacggccaccuacuucugcgcccgccagaaguucgagcgcgggggccaggggugguacuucgaccucuggggccggggcacccugaucguggugagcucc

SEQ ID NO: 10786 - RNA, 375 nt, Artificial Sequence
  derived and/or modified sequence opt1 from anti-HIV-1_HeavyChain
caggcccaccuggagcagagcggcuccggggugaagcgccccggcgccagcguccggguguccugcuggaccagcgaggacaucuucgagaaguccgagcucauccacugggugcgccaggcgccggggcagggccuggaguggaucgggugggucaagaccgugacgggcgccgugaacuucggcagcuccgacuuccggcagcgcgucagccugacccgggaccgcgaccucuucaccgcccacauggggauccggggccugacccagggggacacggccaccuacuucugcgcccgccagaaguucuacgcgggcgggcagggcugguacuucgaccuguggggccgggggacccucaucgugguguccagc

SEQ ID NO: 10787 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaaggccguguccggcgccgugaacuacggcagccuggacuuccggcaccgcgucucccucacgcgggaccgcgaccuguucaccgcccacauggacauccgggggcugacccaggacgacaccgccaucuacuucugcgcgcgccagaaguucgcccggggcgaccaggggugguucuucgaccucuggggccgcgggacgcugaucguggugagcucc

SEQ ID NO: 10788 - RNA, 375 nt, Artificial Sequence
  derived and/or modified sequence opt1 from anti-HIV-1_HeavyChain
cagagccaccuggagcaguccggcagcgccaugaagaagcucggggccuccgugcgcguccccugcuggaccagcgaggacaucuucgagcggaccgagcugauccacugggugcgccaggcgccgggccaggggcuggaguggaucggcugggugaaggccgucuccggggccgugaacuacggcagccucgacuuccggcaccgcgugucccugacgcgggaccgcgaccuguucaccgcccacauggacauccggggccucacccaggacgacaccgccacguacuucugcgcgcgccagaaguucgcccgcggggaccagggcugguucuucgaccugugggggcggggcacccugaucgucgugagcucc

SEQ ID NO: 10789 - RNA, 375 nt, Artificial Sequence
  derived and/or modified sequence opt1 from anti-HIV-1_HeavyChain
caggugcaccuggagcagagcggcuccggggucaagaagcccggcgccagcgugcgcguguccugcuggaccagcgaggacaucuucgagcggaccgagcucauccacuggguccgccaggccccggggcagggccuggaguggaucgggugggugaagaucguguccggcgcggucaacuucggcagccccaacuuccggcagcgcgugucccugacgcgggaccgcgaccucuucaccgcccacauggacauccgggggcugacccagggcgacaccgccacguacuucugcgcccgccagaaguucgagcgcgggggccagggguggaucuucgaccuguggggccggggcacccucaucgccgugagcucc

SEQ ID NO: 10790 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaaggccguguccggcgccgugaacuacggcagccuggacuuccggcaccgcgucucccucacgcgggaccgcgaccuguucaccgcccacauggacauccgggggcugacccaggacgacaccgccacguacuucugcgcgcgccagaaguucgcccggggcgaccaggggugguucuucgaccucuggggccgcgggacccugaucguggugagcucc

SEQ ID NO: 10791 - RNA, 375 nt, Artificial Sequence
  derived and/or modified sequence opt1 from anti-HIV-1_HeavyChain
caggcccaccuggagcagagcgccuccggcgugcgccggcccggggcgagcguccgcguguccugcuggaccagcgaggacaucuucgagcgguccgagcucaucuacugggugcgccaggccccgggccgggggcuggaguggaucggcugggucaagaccgugagcggggccgugaacuucggcucccccaacuuccgccaccgggucagccugacgcgcgaccgggaccucuucaccgcccacauggacauccgcggccugacccagggggacaccgccacguacuucugcgcgcggcagaaguucgagcgcggcgggcagggcugguacuucgaccugugggggcggggcacccucaucgugguguccagc

SEQ ID NO: 10792 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcagcgcgucagccugacccgggaccgcgaccucuucaccgcccacauggacauccgggggcugacgcagggcgacaccgccaccuacuucugcgcccgccagaaguucgagcgcgggggccaggggugguacuucgaccuguggggccggggcacccucaucgugguguccagc

SEQ ID NO: 10793 - RNA, 375 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucaucuacugggugcgccaggcgccgggccgggggcuggaguggaucggcugggugaagacggucagcgggaccgugaacuucggcuccagcgacuuccgcaaccggaucucccugacccgcgaccgggaccucagcaccgcccacauggacauccgcggccugacgcaggacgacaccgccaccuacuucugcgcccggcagaaguucuacgccgggggccaggggugguacuucgaccuguggggccgcgggacccucaucguggucuccagc

SEQ ID NO: 10794 - RNA, 375 nt, Artificial Sequence
  derived and/or modified sequence opt1 from anti-HIV-1_HeavyChain
caggugcagcuggagcagagcggcuccggggucaagaagcccggcgccagcgugcgcguguccugcuggaccagcgaggacaucuucgagaaguccgagcucauccacuggguccggcaggccccggggcagggccuggaguggaucgggugggugaagaccgugacgggcgcggucaacuucggcagcuccgacuuccgccagcgggugagccugacccgcgaccgggaccucuucaccgcccacauggacauccgcgggcugacccagggcgacacggccaccuacuucugcgcccggcagaaguucuacgccgggggccaggggugguacuucgaccuguggggccgcggcacccucaucguggucuccagc

SEQ ID NO: 10795 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcggggccuggaguggaucgggugggucaaggccguguccggcgccgugaacuacggcagccuggacuuccgccaccgggucucccucacgcgcgaccgggaccuguucaccgcccacauggacauccgcgggcugacccaggacgacaccgccacguacuucugcgcgcggcagaaguucgcccgcggcgaccaggggugguucuucgaccucuggggccgggggacccugaucguggugagcucc

SEQ ID NO: 10796 - RNA, 375 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucauccacugggugcgccaggcgccgggccaggggcuggaguggaucggcugggugaagacggucaccggggccgugaacuucggcagccccaacuuccggcaccgcgugucccugacccgggaccgcgaccucuucaccgcccacauggacauccggggccugacgcagggggacaccgccaccuacuucugcgcccgccagaaguucgagcggggcgggcagggcugguacuucgaccugugggggcgcggcacccucaucgucgugagcucc

SEQ ID NO: 10797 - RNA, 375 nt, Artificial Sequence
  derived and/or modified sequence opt1 from anti-HIV-1_HeavyChain
caggcccaccuggagcagagcgccuccggcgugaagcgccccggggcgagcguccggguguccugcuggaccagcgaggacaucuucgagcgcuccgagcucaucuacugggugcggcaggccccgggccaggggcuggaguggaccggcugggucaagacggugagcggggccgugaacuucggcuccaccgacuuccgcgagcgggucagccugacccgcgaccgggaccucuucaccgcccacauggacauccgcggccugacgcagggggacaccgccaccuacuucugcgcgcggcagaaguucgcccgcggcgaccaggggugguucuucgaccuguggggccgggggacccucaucgugguguccagc

SEQ ID NO: 10798 - RNA, 375 nt, Artificial Sequence
  derived and/or modified sequence opt1 from anti-HIV-1_HeavyChain
caggugcaccuggagcagagcggcuccggggucaagaagcucggcgccagcgugcgcguguccugcuggaccagcgaggacaucuucgagcggaccgagcugauccacuggguccgccaggcccccgggcggggccuggaguggaucgggugggugaaggcgguguccggcgccgucaacuacggcagccucgacuuccgccaccgggugucccugacgcgcgaccgggaccuguucaccgcccacauggacauccgcgggcucacccaggacgacaccgccacguacuucugcgcccggcagaaguucgcgcgcggcgaccaggggugguucuucgaccuguggggccgggggacccugaucguggucagcucc

SEQ ID NO: 10799 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagcgguccgagcucauccacugggugcgccaggcgccggggcagggccuggaguggaucgggugggucaagaccgugacgggcgccgugaacuucggcagccccaacuuccggcaccgcgucucccugacccgggaccgcgaccucuucaccgcccacauggacauccgggggcugacccagggcgacacggccaccuacuucugcgcccgccagaaguacuacgccgggggccaggggugguacuucgaccuguggggccggggcacccucaucguggugagcucc

SEQ ID NO: 10800 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacgcagggcgacaccgccaccuacuucugcgcccgccagaaguucuacgccgggggccaggggugguacuucgaccuguggggccggggcacccucaucgugguguccagc

SEQ ID NO: 10801 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgggacggccaccuacuucugcgcccggcagaaguucuacgcgggcgggcagggcugguacuucgaccuguggggccgcgggacccucaucgugguguccagc

SEQ ID NO: 10802 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccccaacuuccggcaccgcgucucccugacccgggaccgcgaccucuucaccgcccacauggacaucugcgggcugacccagggcgacacggccaccuacuucugcgcccggcagaaguucgagcgcgggggccaggggugguacuucgaccuguggggccggggcacccucaucguggugagcucc

SEQ ID NO: 10803 - RNA, 375 nt, Artificial Sequence
  derived and/or modified sequence opt1 from anti-HIV-1_HeavyChain
caggcccaccuggagcagagcggcuccggggugcgcaaggucggcgccagcgugcggguguccugcuggaccagcgaggacaucuucgagcgcaccgagcucauccacuggguccggcaggcgcccgggcagggccuggaguggaucgggugggugaaggccguguccggcgccgucaacuacggcagccuggacuuccgccaccgggugucccucacgcgcgaccgggaccuguucaccgcccacauggacauccgcgggcugacccaggacgacaccgccaucuacuucugcgcgcggcagaaguucgcccgcggcgaccaggggugguucuucgaccucuggggccgggggacgcugaucguggucagcucc

SEQ ID NO: 10804 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacgcagggcgacaccgccaccuacuucugcgcccgccagaaguacuacgccgggggccaggggugguacuucgaccuguggggccggggcacccucaucgugguguccagc

SEQ ID NO: 10805 - RNA, 375 nt, Artificial Sequence
  derived and/or modified sequence opt1 from anti-HIV-1_HeavyChain
caggugcagcugguccagagcggcgccgaggugaagaagcccggggccuccgugcgcgucagcugcuggaccuccgaggacaucuucgagcggaccgagcucauccacugggugcgccaggcgccgggccaggggcuggaguggaucggcugggugaagacggucaccggggccgugaacuucggcagccccaacuuccggcaccgcgugucccugacccgggaccgcgaccucuucaccgcccacauggacauccggggccugacgcagggggacaccgccaccuacuucugcgcccgccagaaguucgagcggggcgggcagggcugguacuucgaccugugggggcgcggcacccucaucgucgugagcucc

SEQ ID NO: 10806 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggccugagcgacuuccgccagcgggucucccucacccgcgaccgggggcuguucaccgcccacauggacauccgcggccugacccagggggacacggccaccuacuucugcgcccggcagaaguucuacgcgggcgggcagggcugguacuucgaccucuggggccgcgggacccugaucguggugagcucc

SEQ ID NO: 10807 - RNA, 375 nt, Artificial Sequence
  derived and/or modified sequence opt1 from anti-HIV-1_HeavyChain
caggcccaccuggagcagagcggcuccggggugaagaagcccggcaccagcguccgcguguccugcuggaccagcgaggacaucuucgagcggacggagcucauccacugggugcgccaggccccggggcagggccuggaguggaucgggugggucaagaccgugaccggcgcggugaacuucggcucccccaacuuccggcagcgcgucagccugacccgggaccgcgaccucuucacggcccacauggacauccgggggcugacccagggcgacaccgccaccuacuucugcgcccgccagaaguucgagcgcgggggccagggguggaucuucgaccuguggggccggggcacgcucaucgccguguccagc

SEQ ID NO: 10808 - RNA, 375 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugacccaggacgacacggccaccuacuucugcgcccggcagaaguucgagcgcggcgggcagggcugguacuucgaccucugggggcggggcacccugaucguggucuccagc

SEQ ID NO: 10809 - RNA, 375 nt, Artificial Sequence
  derived and/or modified sequence opt1 from anti-HIV-1_HeavyChain
caggugcagcugguccagagcggcgccgaggugaagaagcccggggccuccgugcgcgucagcugcuggaccuccgaggacaucuucgagggcagcgagcucauccacugggugcggcaggcgccggggcagggccuggaguggaucgggugggugaagaccgucacgggcgccgugaacuucggcuccgccuacuuccgccaccgggugagccugacccgcgaccgggaccucuucaccgcccacauggacauccgcgggcugacccagggcgacacggccaccuacuucugcgcgcggcagaaguucuacaagggcgggcaggggugguacuucgaccuguggggccgcggcacccucaucgucguguccagc

SEQ ID NO: 10810 - RNA, 375 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccuccagcgacuuccgcaaccggaucucccugagccgcgaccgggaccucuccaccgcccacauggacauccgcggccugacccaggacgacacggccaccuacuucugcgcccggcagaaguucgagcgcggcgggcagggcuggaucuucgaccugugggggcggggcacccucaucgcggugagcucc

SEQ ID NO: 10811 - RNA, 375 nt, Artificial Sequence
  derived and/or modified sequence opt1 from anti-HIV-1_HeavyChain
caggugcagcugguccagagcggcaccgaggugaagaagcccggggcguccgugcgcgucagcugcaaggccuccggcuacaccuucgagaaguccgagcucauccacugggugcggcaggcgccggggcagggccuggaguggaucgggugggugaagacggucaccggcgccgugaacuucggcagcagcgacuuccgccagcgggugucccugacccgcgaccgggaccucuucaccgcccacauggacauccgcgggcugacgcagggcgacaccgccaccuacuucugcgcccggcagaaguucuacgccgggggccaggggugguacuucgaccuguggggccgcggcacccucaucgucgugagcucc

SEQ ID NO: 10812 - RNA, 375 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucaucuacugggugcgccaggcgccgggccgggggcuggaguggaucggcugggugaagacggucagcgggaccgugaacuucggcuccagcgacuuccgcaaccggaucucccugacccgcgaccgggaccucagcaccgcccacauggacauccgcggccugacgcaggacgacaccgccaccuacuucugcgcccggcagaaguucgagcgcgggggccagggguggaucuucgaccuguggggccgggggacccucaucgccguguccagc

SEQ ID NO: 10813 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaaggccgugagcggcgccgugaacuacggcucccuggacuuccggcaccgcgucagccucacccgggaccgcgaccuguccacggcccacauggacauccgggggcugacccaggacgacaccgccaccuacuucugcgcgcgccagaaguucgcccggggcgaccaggggugguucuucgaccucuggggccgcgggacgcugaucguggugagcucc

SEQ ID NO: 10814 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccaggacgacacggccaucuacuucugcgcccggcagaaguucgcgcgcggcgaccaggggugguucuucgaccuguggggccgggggacccucaucgugguguccagc

SEQ ID NO: 10815 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccuggacuuccggcaccgcaucagccucacccgggaccgcgaccuguucaccgcccacauggacauccgggggcugacgcagggcgacaccgccaccuacuucugcgcccgccagaaguucuacgccgggggccaggggugguacuucgaccucuggggccggggcacccugaucgucguguccagc

SEQ ID NO: 10816 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucgugcacuggguccggcaggcgccggggcagggccuggaguggaucgggugggugaagaccgugacgggcgccgucaacuucggcagcuccgacuuccgccagcgggugagccugacccgcgaccgggaccucuucaccgcccacauggacauccgcgggcugacccagggcgacacggccaccuacuucugcgcccggcagaaguucgagcgcgggggccagggguggaucuucgaccuguggggccggggcacccucaucgcgguguccagc

SEQ ID NO: 10817 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccuguucaccgcccacauggacauccgggggcucacccagggcgacaccgccacguacuucugcgcgcgccagaaguucgcccgcggggaccagggcugguucuucgaccugugggggcggggcacccugaucguggugagcucc

SEQ ID NO: 10818 - RNA, 375 nt, Artificial Sequence
  derived and/or modified sequence opt1 from anti-HIV-1_HeavyChain
caggcgcaccgcgagcagagcggcuccggggugaagaagcccggcgccagcguccggguguccugcuggaccagcgaggacaucuucgagcgcaccgagcugauccacugggugcggcaggcgccggggcagggccucgaguggaucgggugggucaagacggugaccggcgccgugaacuucggcuccagcgacuuccgccagcgggucucccugacccgcgaccgggaccuguucaccgcccacauggacauccgcgggcucacgcagggcgacaccgccaccuacuucugcgcccggcagaaguucuacgccgggggccaggggugguacuucgaccuguggggccgcggcacccugaucguggugagcucc

SEQ ID NO: 10819 - RNA, 372 nt, Artificial Sequence
  derived and/or modified sequence opt1 from anti-HIV-1_HeavyChain
caggcccaccuggagcagagcggcuccggggugaagaagcccggcgccagcguccgcguguccugccucgcgagcgaggacaucuucaagaccgagcugauccacugggugcggcaggccccggggcagggccuggaguggaucgggugggucaagaucguguccggcgccgugaacuucggcagccccaacuuccgccagcgggucucccucacccgcgaccgggaccuguucacggcccacauggacauccgcgggcugacccagggcgacaccgccaccuacuucugcgcgcggcagaaguucgagcgcgggggccagggguggaucuucgaccucuggggccggggcacgcugaucgccgugagcucc

SEQ ID NO: 10820 - RNA, 375 nt, Artificial Sequence
  derived and/or modified sequence opt1 from anti-HIV-1_HeavyChain
caggcccaccuggagcagagcggcuccggggugaagaaggucggcgccagcgugcgcguguccugcuggaccagcgaggacaucuucgagcggaccgagcucauccacuggguccgccaggcgcccgggcagggccuggaguggaucgggugggugaaggccguguccggcgccgucaacuacggcagccuggacuuccggcaccgcgugucccucacgcgggaccgcgaccuguucaccgcccacauggacauccgggggcugacccaggacgacaccgccaucuacuucugcgcgcgccagaaguucgagcggggcgggcagggcuggaucuucgaccucugggggcgcggcacgcugaucgccgugagcucc

SEQ ID NO: 10821 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucgcgcgcggggaccagggcugguucuucgaccugugggggcggggcacccucaucgugguguccagc

SEQ ID NO: 10822 - RNA, 375 nt, Artificial Sequence
  derived and/or modified sequence opt1 from anti-HIV-1_HeavyChain
caggcccaccuggagcagagcgccuccggcgugaagcgccccggggcgagcguccggguguccugcuggaccagcgaggacaucuucgagcgcuccgagcucaucuacugggugcggcaggccccgggccaggggcuggaguggaucggcugggucaagaccgugacgggggccgugaacuucggcagcuccgacuuccgccagcgggucagccugacccgcgaccgggaccucuucaccgcccacauggacauccgcggccugacccagggggacacggccaccuacuucugcgcgcggcagaaguucuacgccggcgggcagggcugguacuucgaccugugggggcgcggcacccucaucgugguguccagc

SEQ ID NO: 10823 - RNA, 375 nt, Artificial Sequence
  derived and/or modified sequence opt1 from anti-HIV-1_HeavyChain
caggcgcaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaagacggugaccggcgccgugaacuucggcuccccgaacuuccggcaccgcgucagccucacccgggaccgcgaccuguucaccgcccacauggacauccgggggcugacgcagggcgacaccgccaccuacuucugcgcccgccagaaguacuacgccgggggccaggggugguacuucgaccucuggggccggggcacccugaucgugguguccagc

SEQ ID NO: 10824 - RNA, 375 nt, Artificial Sequence
  derived and/or modified sequence opt1 from anti-HIV-1_HeavyChain
caggugcagcugguccagagcggcuccggggugaagaagcccggcgccagcgugcgcgucuccugcuggaccagcgaggacaucuucgagcggaccgagcucauccacugggugcgccaggccccggggcagggccuggaguggaucgggugggugaagaucgucuccggcgcggugaacuucggcagccccaacuuccggcagcgcgugucccugacgcgggaccgcgaccucuucaccgcccacauggacauccgggggcugacccagggcgacaccgccacguacuucugcgcccgccagaaguucgagcgcgggggccagggguggaucuucgaccuguggggccggggcacccucaucgccgucagcucc

SEQ ID NO: 10825 - RNA, 375 nt, Artificial Sequence
  derived and/or modified sequence opt1 from anti-HIV-1_HeavyChain
cgccacaccugggagcagagcggcuccggggugaagaagcccggcgccagcguccggguguccugcuggaccagcgaggacaucuucgagcgcacggagcugauccacugggugcggcaggccccggggcagggccucgaguggaucgggugggucaagaucguguccggcgcggugaacuucggcagccccaacuuccgccagcgggucucccugacccgcgaccgggaccuguucaccgcccacauggacauccgcgggcucacccagggcgacacggccaccuacuucugcgcccggcagaaguucgagcgcgggggccagggguggaucuucgaccuguggggccggggcacccugaucgccgugagcucc

SEQ ID NO: 10826 - RNA, 372 nt, Artificial Sequence
  derived and/or modified sequence opt1 from anti-HIV-1_HeavyChain
cgccacaccugggagcagagcggcuccggggugaagaagcccggcgccagcguccggguguccugcuggaccagcgaggacaucuucgagcgcacggagcugauccacugggugcggcaggccccggggcagggccucgaguggaucgggugggucaagaccgugaccggcgcggugaaccuggcccccaacuuccgccaccgggucucccugacccgcgaccgggaccucuucacggcccacauggacauccgcggccugacccagggggacaccgccaccuacuucugcgcccggcagaaguucgagcgcggcgggcagggcugguacuucgaccugugggggcggggcacgcucaucguggugagcucc

SEQ ID NO: 10827 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagggguccgagcucauccacugggugcggcaggcgccgggccaggggcuggaguggaucggcugggucaagaccgugacgggcgccgugaacuucgggagcuccgacuuccgccagcgggucagccugacccgcgaccgggaccucuucaccgcccacauggacauccgcggccugacccagggggacacggccaccuacuucugcgcccggcagaaguucuacgcgggcgggcagggcugguacuucgaccuguggggccgcgggacccucaucgugguguccagc

SEQ ID NO: 10828 - RNA, 375 nt, Artificial Sequence
  derived and/or modified sequence opt1 from anti-HIV-1_HeavyChain
cagagccaccuggagcaguccggcagcgcgaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccuccagcgacuuccgcaaccggaucucccugagccgcgaccgggaccucuccaccgcccacauggacauccgcggccugacccagggcgacacggccaccuacuucugcgcccggcagaaguacuacgccgggggccaggggugguacuucgaccuguggggccgcgggacccucaucguggucagcucc

SEQ ID NO: 10829 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaagaucguguccggcgccgugaacuucggcagcccgaacuuccggcagcgcgucucccucacgcgggaccgcgaccuguucaccgcccacauggacauccgggggcugacccagggcgacaccgccacguacuucugcgcccgccagaaguucgagcgcgggggccagggguggaucuucgaccucuggggccggggcacccugaucgcggugagcucc

SEQ ID NO: 10830 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucuacaagggcgggcaggggugguacuucgaccuguggggccgcggcacccucaucgugguguccagc

SEQ ID NO: 10831 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacgcagggcgacaccgccaccuacuucugcgcccgccagaaguucgcgcgcggggaccagggcugguucuucgaccugugggggcggggcacccucaucgugguguccagc

SEQ ID NO: 10832 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcggggccuggaguggaucgggugggucaaggccguguccggcgccgugaacuacggcagccucgacuuccgccaccgggucucccugacgcgcgaccgggaccuguucaccgcccacauggacauccgcgggcucacccagggcgacaccgccacguacuucugcgcgcggcagaaguucgagcgcgggggccaggggugguacuucgaccuguggggccggggcacccugaucguggugagcucc

SEQ ID NO: 10833 - RNA, 375 nt, Artificial Sequence
  derived and/or modified sequence opt1 from anti-HIV-1_HeavyChain
caggcccgccccggcaccagcggguccggcgugaagaagccgggggccagcguccggguguccugcuggagcuccgaggacaucuucgagcgcaccgagcugauccacugggugcggcaggcgcccggccaggggcucgaguggaucggcugggucaagacggugaccggcgccgugaacuucgggagccuggacuuccgccagcgggucucccugacccgcgaccgggaccucuucaccgcccacauggacauccgcggccugacgcagggggacaccgccaccuacuucugcgcccggcagaaguucgagcgcggcgggcagggcuggaucuucgaccuguggggccgggggacccucaucgcggugagcucc

SEQ ID NO: 10834 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacggagggcgacaccgccaccuacuucugcgcccgccagaaguucgagcgcgggggccagggguggaucuucgaccuguggggccggggcacccucaucgcgguguccagc

SEQ ID NO: 10835 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaaggccaucuccggcgccgugaacuacggcagccuggacuuccggcaccgcgugucccucacgcgggaccgcgaccuguucaccgcccacauggacauccgggggcugacccaggacgacaccgccacguacuucugcgcgcgccagaaguucgcccggggcgaccaggggugguucuucgaccucuggggccgcgggacccugaucgucgugagcucc

SEQ ID NO: 10836 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacagcggcucccccaacuuccgccaccgggucagccugacccgcgaccgggaccucuucaccgcccacauggacauccgcgggcugacccagggcgacacggccaccuacuucugcgcccggcagaaguucgagcgcgggggccaggggugguacuucgaccuguggggccggggcacccucaucgugguguccagc

SEQ ID NO: 10837 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcgggcggagcucauccacugggugcgccaggccccggggcagggccuggaguggaucgggugggucaagaccguguccggcgccgugaacuucggcagccugaacuuccggcaccgcgucucccucacgcgggaccgcgaccuguucaccgcccacauggacauccgggggcugacccagggcgacaccgccacguacuucugcgcgcgccagaaguucgcccgcggggaccagggcugguucuucgaccucugggggcggggcacccugaucguggugagcucc

SEQ ID NO: 10838 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccugagcaccgcccacauggacauccgggggcucacccaggacgacaccgccacguacuucugcgcgcgccagaaguucgcccggggcgaccaggggugguucuucgaccuguggggccgcgggacccuggugaccguguccagc

SEQ ID NO: 10839 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccugaacuuccggcaccgcgucagccucacccgggaccgcgaccuguucaccgcccacauggacauccgggggcugacgcagggcgacaccgccaccuacuucugcgcccgccagaaguucgagcgcgggggccaggggugguacuucgaccucuggggccggggcacccugaucgugguguccagc

SEQ ID NO: 10840 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuccaccgcccacauggacauccgggggcugacgcaggacgacaccgccaccuacuucugcgcccgccagaaguucgcgcggggcgaccaggggugguucuucgaccuguggggccgcgggacccucaucguggugagcucc

SEQ ID NO: 10841 - RNA, 375 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaccgucaccggggccgugaacuucggcagccccaacuuccgccaccgggugucccugacccgcgaccgggaccucuucacggcccacauggacauccgcggccugacccagggggacaccgccaccuacuucugcgcccggcagaaguacuacgcgggcgggcagggcugguacuucgaccugugggggcgcggcacgcucaucgucgugagcucc

SEQ ID NO: 10842 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggccuccggcgccgugaacuucggcagccccaacuuccggcaccgcgugucccugacccgggaccgcgaccucuucaccgcccacauggacauccgggggcugacccagggcgacacggccaccuacuucugcgcgcgccagaaguucgagcgcgggggccaggggugguacuucgaccuguggggccggggcacccucaucgucgugagcucc

SEQ ID NO: 10843 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccuguucaccgcccacauggacauccgggggcucacccaggacgacaccgccacguacuucugcgcgcgccagaaguucgagcggggcgggcagggcugguacuucgaccugugggggcgcggcacccugaucguggugagcucc

SEQ ID NO: 10844 - RNA, 375 nt, Artificial Sequence
  derived and/or modified sequence opt1 from anti-HIV-1_HeavyChain
caggcccaccuggagcagagcgccuccggcgugaagcgccccggggcgagcguccggguguccugcuggaccagcgaggacaucuucgagcgcuccgagcucaucuacugggugcggcaggccccgggccaggggcuggaguggaucggcugggucaagaccgugagcggggccgugaacuucggcuccacggacuuccgcgagcgggucagccugacccgcgaccgggaccucuucaccgcccacauggacauccgcggccugacccagggggacacggccaccuacuucugcgcgcggcagaaguucgagcgcggcgggcagggcugguacuucgaccugugggggcggggcacccucaucgugguguccagc

SEQ ID NO: 10845 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcguggucaacuacggcagccucgacuuccggcaccgcgugucccugacgcgggaccgcgaccugagcaccgcccacauggacauccgggggcucacccaggacgacaccgccacguacuucugcgcccgccagaaguucgcgcggggcgaccaggggugguucuucgaccuguggggccgcgggacccugaucguggucuccagc

SEQ ID NO: 10846 - RNA, 375 nt, Artificial Sequence
  derived and/or modified sequence opt1 from anti-HIV-1_HeavyChain
caggcccaccuggagcagagcggcuccggggugaagaaggucggcgccagcgugcgcguguccugcuggaccagcgaggacaucuucgagcggaccgagcucauccacuggguccgccaggcgcccgggcagggccuggaguggaucgggugggugaagacgguguccggcgccgucaacuucggcagcccgaacuuccggcaccgcgugucccugacccgggaccgcgaccucuucaccgcccacauggacauccgggggcugacccagggcgacacggccaccuacuucugcgcccgccagaaguucgagcgcgggggccaggggugguacuucgaccuguggggccggggcacccucaucguggucagcucc

SEQ ID NO: 10847 - RNA, 375 nt, Artificial Sequence
  derived and/or modified sequence opt1 from anti-HIV-1_HeavyChain
caggccuaccuggagcagagcggcuccaucaugaagaagcccggggccagcgugcgcgucuccugcuggaccagcgaggacaucuucgaccggaccgagcucauccacugggugcgccaggcgccgggccaggggcuggaguggaucggcugggugaagacggucaccggggccgugaacuucggcuccagcgacuuccggcagcgcgugucccugacccgggaccgcgaccucuucaccgcccacauggacauccggggccugacgcagggggacaccgccaccuacuucugcgcccgccagaaguucuacgcgggcgggcagggcugguacuucgaccugugggggcggggcacccucaucgucgugagcucc

SEQ ID NO: 10848 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagaaguccgagcucauccacugggugcggcuggcgccggggcagggccuggaguggaucgggugggucaagaccgugacgggcgccgugaacuucggcagcuccgacuuccgccagcgggucagccucacccgcgaccgggaccuguucaccgcccacauggacauccgcgggcugacccagggcgacacggccaccuacuucugcgcccggcagaaguucuacgccgggggccaggggugguacuucgaccucuggggccgcggcacccugaucgugguguccagc

SEQ ID NO: 10849 - RNA, 375 nt, Artificial Sequence
  derived and/or modified sequence opt1 from anti-HIV-1_HeavyChain
gaggcccaccuggagcagagcggcuccggggugaagaagcccggcgccagcguccgcguguccugcuggaccagcgaggacaucuucgagcggaccgagcucacgcacugggugcgccaggcgccggggcagggccuggaguggaucgggugggucaagaccgugaccggcgccgugaacuucggcucccccaacuuccggcagcgcgucagccugacccgggaccgcgaccucuucacggcccacauggacauccgggggcugacccagggcgacaccgccaccuacuucugcgcccgccagaaguucgagcgcgggggccagggguggaucuucgaccuguggggccggggcacgcucaucgcgguguccagc

SEQ ID NO: 10850 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuacgagcggaccgagcucauccacugggugcgccaggcgccggggcagggccuggaguggaucgggugggucaaggccguguccggcgccgugaacuacggcagccuggacuuccggcaccgcgucucccucacgcgggaccgcgaccuguucaccgcccacauggacauccgggggcugacccaggacgacaccgccaucuacuucugcgcgcgccagaaguucgcccggggcgaccaggggugguucuucgaccucuggggccgcgggacgcugaucguggugagcucc

SEQ ID NO: 10851 - RNA, 375 nt, Artificial Sequence
  derived and/or modified sequence opt1 from anti-HIV-1_HeavyChain
caggugcaccuggagcagagcggcuccggggucaagaagcccggcgccagcgugcgcguguccugcuggaccagcgaggacaucuucgagcggaccgagcucauccacuggguccgccaggccccggggcagggccuggaguggaucgggugggugaagacggugaccggcgcggucaacuucggcucccccaacuuccggcaccgcgugagccugacccgggaccgcgaccucuucaccgcccacauggacauccgggggcugacgcagggcgacaccgccaccuacuucugcgcccgccagaaguucgagcgcgggggccaggggugguacuucgaccuguggggccggggcacccucaucguggucuccagc

SEQ ID NO: 10852 - RNA, 375 nt, Artificial Sequence
  derived and/or modified sequence opt1 from anti-HIV-1_HeavyChain
caggcccaccuggagcagagcggcuccggggugaagaaggucggcgccagcgugcgcguguccugcuggaccagcgaggacaucuucgagcggaccgagcucauccacuggguccgccaggcgcccgggcagggccuggaguggaucgggugggugaaggccguguccggcgccgucaacuacggcagccuggacuuccggcaccgcgugucccucacgcgggaccgcgaccugagcaccgcccacauggacauccgggggcugacccaggacgacaccgccacguacuucugcgcgcgccagaaguucgcccggggcgaccaggggugguucuucgaccucuggggccgcgggacccugaucguggucuccagc

SEQ ID NO: 10853 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgcccgggcagggccuggaguggaucgggugggucaagacgguguccggcgccgugaacuucggcccgcccaacuuccggcaccgcgucagccugacccgggaccgcgaccucuucaccgcccacauggacauccgggggcugacccagggcgacacggccaccuacuucugcgcccgccagaaguucgagcgcgggggccaggggugguacuucgaccuguggggccggggcacccucaucgugguguccagc

SEQ ID NO: 10854 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccugagcaccgcccacauggacauccgggggcucacccaggacgacaccgccacguacuucugcgcgcgccagaaguucgagcggggcgggcagggcuggaucuucgaccugugggggcgcggcacccugaucgccguguccagc

SEQ ID NO: 10855 - RNA, 375 nt, Artificial Sequence
  derived and/or modified sequence opt1 from anti-HIV-1_HeavyChain
caggcgcaccuggagcagagcggcuccggggugcgcaagcccggcgccagcguccggguguccugcuggaccagcgaggacaucuucgagcgcaccgagcucauccacugggugcggcaggcgccggggcagggccuggaguggaucgggugggucaagacggugaccggcgccgugaacuucggcuccagcgacuuccgccagcgggucucccugacccgcgaccgggaccucuucaccgcccacauggacauccgcgggcugacgcagggcgacaccgccaccuacuucugcgcccggcagaaguucuacgccgggggccaggggugguacuucgaccuguggggccgcggcacccucaucguggugagcucc

SEQ ID NO: 10856 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcggggccuggaguggaucgggugggucaaggccguguccggcgccgugaacuacggcagcccgaacuuccgccaccgggucucccucacgcgcgaccgggaccuguucaccgcccacauggacauccgcgggcugacccagggcgacaccgccacguacuucugcgcgcggcagaaguucgagcgcgggggccaggggugguacuucgaccucuggggccggggcacccugaucguggugagcucc

SEQ ID NO: 10857 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccccaacuuccggcaccgcgucucccugacccgggaccgcgaccucuucaccgcccacauggacauccgggggcugacccagggcgacacggccaccuacuucugcgcccgccagaaguucgagcgcgggggccaggggugguacuucgaccuguggggccggggcgcgcucaucguggugagcucc

SEQ ID NO: 10858 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcgccuacuuccgccaccgggucucccugacccgcgaccgggaccucuucaccgcccacauggacauccgcgggcugacccagggcgacacggccaccuacuucugcgcgcggcagaaguucuacaagggcgggcaggggugguacuucgaccuguggggccgcggcacccucaucguggugagcucc

SEQ ID NO: 10859 - RNA, 375 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucaucuacugggugcgccaggcgccgggccgggggcuggaguggaucggcugggugaagacggucagcgggaccgugaacuucggcucccuggacuuccgccaccgggugagccucacccgcgaccgggaccuguccaccgcccacauggacauccgcggccugacgcaggacgacaccgccaccuacuucugcgcccggcagaaguucgcccgcggggaccagggcugguucuucgaccucugggggcggggcacccugaucgucgugagcucc

SEQ ID NO: 10860 - RNA, 375 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccuccagcgacuuccgcaaccggaucucccugagccgcgaccgggaccucuccaccgcccacauggacauccgcggccugacccaggacgacacggccaccuacuucugcgcccggcagaaguucuacgcgggcgggcagggcugguacuucgaccugugggggcgcggcacccucaucguggucagcucc

SEQ ID NO: 10861 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccgugacgggcgccgugaacuucggcuccagcgacuuccggcagcgcgucucccucacccgggaccgcgaccuguucaccgcccacauggacauccgggggcugacccagggcgacacggccaccuacuucugcgcgcgccagaaguucuacgccgggggccaggggugguacuucgaccucuggggccggggcacccugaucguggugagcucc

SEQ ID NO: 10862 - RNA, 375 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucaucuacugggugcgccaggcgccgggccgggggcuggaguggaucggcugggugaagacggucagcggggccgugaacuucggcuccagcgacuuccgccagcgggugucccugacccgcgaccgggaccucuucaccgcccacauggacauccgcggccugacccagggggacacggccaccuacuucugcgcccggcagaaguucuacgcgggcgggcagggcugguacuucgaccugugggggcgcggcacccucaucgucgugagcucc

SEQ ID NO: 10863 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacgcagggcgacgccgccaccuacuucugcgcgcgccagaaguucgagcgcgggggccaggggugguacuucgaccuguggggccggggcacccucaucgugguguccagc

SEQ ID NO: 10864 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcggggccuggaguggaucgggugggucaaggccguguccggcgccgugaacuacggcagccucgacuuccgccaccgggucucccugacgcgcgaccgggaccuguucaccgcccacauggacauccgcgggcucacccaggacgacaccgccacguacuucugcgcgcggcagaaguucuacgccggcgggcagggcugguacuucgaccugugggggcgcggcacccugaucguggugagcucc

SEQ ID NO: 10865 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagaucguguccggcgccgugaacuucggcagccccaacuuccggcagcgcgucucccugacgcgggaccgcgaccucuucgccgcccacauggacauccgggggcugacccagggcgacaccgccaccuacuucugcgcgcgccagaaguucgagcgcgggggccagggguggaucuucgaccuguggggccggggcacgcucaucgccgugagcucc

SEQ ID NO: 10866 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcuggcccagggcgacacggccaccuacuucugcgcgcgccagaaguucgagcgcgggggccaggggugguacuucgaccuguggggccggggcacccucaucgugguguccagc

SEQ ID NO: 10867 - RNA, 375 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccuccagcgacuuccgcaaccggaucucccugagccgcgaccgggaccucuccaccgcccacauggacauccgcggccugacccaggacgacacggccaccuacuucugcgcccggcagaaguucgagcgcggcgggcagggcugguacuucgaccugugggggcggggcacccucaucguggucagcucc

SEQ ID NO: 10868 - RNA, 375 nt, Artificial Sequence
  derived and/or modified sequence opt1 from anti-HIV-1_HeavyChain
cagagccaccuggagcaguccggcagcgcgaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccgggugagccucacccgcgaccgggaccuguucaccgcccacauggacauccgcggccugacgcagggcgacaccgccaccuacuucugcgcccggcagaaguucuacgccgggggccaggggugguacuucgaccucuggggccgcgggacccugaucgucguguccagc

SEQ ID NO: 10869 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagaucguguccggcgccgugaacuucggcagccccaacuuccggcaccgcgucucccugacgcgggaccgcgaccucuucaccgcccacauggacauccgggggcugacccagggcgacaccgccacguacuucugcgcccgccagaaguucgagcgcgggggccaggggugguacuucgaccuguggggccggggcacccucaucguggugagcucc

SEQ ID NO: 10870 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagaaguccgagcucauccacugggugcggcgcgcgccggggcagggccuggaguggaucgggugggucaagaccgugacgggcgccgugaacuucggcagcuccgacuuccggcagcgcgucagccugacccgggaccgcgaccucuucaccgcccacauggacauccgggggcugacccagggcgacacggccaccuacuucugcgcccgccagaaguucuacgccgggggccaggggugguacuucgaccuguggggccggggcacccucaucgugguguccagc

SEQ ID NO: 10871 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcagcgcgucucccugacgcgggaccgcgaccuguucaccgcccacauggacauccgggggcucacccagggcgacaccgccacguacuucugcgcgcgccagaaguucgagcgcgggggccagggguggaucuucgaccuguggggccggggcacccugaucgccgugagcucc

SEQ ID NO: 10872 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccuggacuuccggcaccgcaucucccucacccgggaccgcgaccuguucaccgcccacauggacauccgggggcugacccagggcgacacggccaccuacuucugcgcccgccagaaguucuacaagggcgggcaggggugguacuucgaccucuggggccggggcacccugaucgucgugagcucc

SEQ ID NO: 10873 - RNA, 375 nt, Artificial Sequence
  derived and/or modified sequence opt1 from anti-HIV-1_HeavyChain
caggcccaccuggagcagagcggcuccggggugaagaagcccggcaccagcguccgcguguccugcuggaccagcgaggacaucuucgagaaguccgagcucauccacugggugcggcaggccccggggcagggccuggaguggaucgggugggucaagacggugaccggcgcggugaacuucggcagcuccgacuuccgccagcgggucagccugacccgcgaccgggaccucuucaccgcccacauggacauccgcgggcugacgcagggcgacaccgccaccuacuucugcgcccggcagaaguucuacgccgggggccaggggugguacuucgaccuguggggccgcggcacccucaucgugguguccagc

SEQ ID NO: 10874 - RNA, 375 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugacccaggacgacacggccaccuacuucugcgcccggcagaaguucuacgcgggcgggcagggcugguacuucgaccucugggggcgcggcacccugaucguggucuccagc

SEQ ID NO: 10875 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgggcugauccacugggugcgccaggcgcccggccaggggcuggaguggaucggcugggucaaggccguguccggcgccgugaacuacgggagccucgacuuccggcaccgcgucucccugacgcgggaccgcgaccuguucaccgcccacauggacauccggggccucacccaggacgacaccgccacguacuucugcgcgcgccagaaguucgcccgcggggaccagggcugguucuucgaccugugggggcggggcacccugaucguggugagcucc

SEQ ID NO: 10876 - RNA, 375 nt, Artificial Sequence
  derived and/or modified sequence opt1 from anti-HIV-1_HeavyChain
caggcccaccuggagcagagcggcuccggggugaagaagcccggcaccagcguccgcguguccugcuggaccagcgaggacguguucgagcggacggagcucauccacuggguccgccaggccccggggcagggccuggaguggaucgggugggugaagaccgugaucggcgcggucaacuucggcucccccaacuuccggcaccgcgugagccugacccgggaccgcgaccucuucaccgcccacauggacauccgggggcugacgcagggcgacaccgccaccuacuucugcgcccgccagaaguucgagcgcgggggccaggggugguacuucgaccuguggggccggggcacccucaucguggucuccagc

SEQ ID NO: 10877 - RNA, 372 nt, Artificial Sequence
  derived and/or modified sequence opt1 from anti-HIV-1_HeavyChain
caggcccaccuggagcagagcggcgccggggugaagaagcccggcgcguccguccgcgugagcugcuggaccuccgaggacaucuucaagaccgagcucauccacugggugcggcaggccccggggcagggccuggaguggaucgggugggucaagaucgugagcggcgccgugaacuucggcucccccaacuuccgccagcgggucagccugacgcgcgaccgggaccucuucaccgcccacauggacauccgcgggcugacccagggcgacaccgccacguacuucugcgcgcggcagaaguucgagcgcgggggccagggguggaucuucgaccuguggggccggggcacccucaucgccguguccagc

SEQ ID NO: 10878 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccccgacuuccggcaccgcgucucccugacccgggaccgcgaccucuucaccgcccacauggacauccgggggcugacccagggcgacacggccaccuacuucugcgcccgccagaaguucgcgcgcggggaccagggcugguucuucgaccugugggggcggggcacccucaucguggugagcucc

SEQ ID NO: 10879 - RNA, 375 nt, Artificial Sequence
  derived and/or modified sequence opt1 from anti-HIV-1_HeavyChain
caggcccaccuggagcagagcggcuccggggugaagcgccccggcgccagcguccggguguccugcuggaccagcgaggacaucuucgagaccacggagcucauccacugggugcgccaggcgccggggcagggccuggaguggaucgggugggucaagaccguguccggcgccgugaacuucggcagccugaacuuccggcaccgcaucucccucacccgggaccgcgaccuguucaccgcccacauggacauccgggggcugacgcagggcgacaccgccaccuacuucugcgcccgccagaaguucgcgcgcggggaccagggcugguucuucgaccucugggggcggggcacccugaucgucgugagcucc

SEQ ID NO: 10880 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccugagcaccgcccacauggacauccgggggcucacccaggacgacaccgccaucuacuucugcgcgcgccagaaguucgcccggggcgaccaggggugguucuucgaccuguggggccgcgggacgcugaucgugguguccagc

SEQ ID NO: 10881 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggacggggugggucaaggccguguccggcgccgugaacuacggcagccucgacuuccggcaccgcgucucccugacccgggaccgcgaccugagcaccgcccacauggacauccgggggcucacccaggacgacacggccaccuacuucugcgcgcgccagaaguucgcccggggcgaccaggggugguucuucgaccuguggggccgcgggacccugaucgugguguccagc

SEQ ID NO: 10882 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccuguucaccgcccacauggacauccgggggccgacccaggacgacaccgccacguacuucugcgcgcgccagaaguucgcccggggcgaccaggggugguucuucgaccucuggggccgcgggacccugaucguggugagcucc

SEQ ID NO: 10883 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccugagcaccgcccacauggacauccgggggcucacccagggcgacaccgccacguacuucugcgcgcgccagaaguucgagcgcgggggccaggggugguacuucgaccuguggggccggggcacccugaucgugguguccagc

SEQ ID NO: 10884 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccccaacuuccggcaccgcgucucccugacccgggaccgcgaccucuucaccgcccacauggacauccgggggcugacccagggcgacacggccaccuacuucugcgcccgccagaaguucgagcgcgggggccaggggugguacuucgaccuguggggccggggcacccucaucguggugagcucc

SEQ ID NO: 10885 - RNA, 375 nt, Artificial Sequence
  derived and/or modified sequence opt1 from anti-HIV-1_HeavyChain
cgccacaccuggaacgagagcggcuccggggugaagaagcccggcgccagcguccggguguccugcuggaccagcgaggacaucuucgagcgcacggagcugauccacugggugcggcaggccccggggcagggccucgaguggaucgggugggucaagaccgugaccggcaccgugaacuucggcucccugaacuuccgccagcgggucagccugacgcgcgaccgggaccucuucaccgcgcacauggacauccgcgggcugacccagggcgacaccgccacguacuucugcgcccggcagaaguucuacgccgggggccaggggugguacuucgaccuguggggccgcggcacccucaucgugguguccagc

SEQ ID NO: 10886 - RNA, 375 nt, Artificial Sequence
  derived and/or modified sequence opt1 from anti-HIV-1_HeavyChain
caggcccaccuggagcagagcggcgccggggugaagcgccccggcgcguccguccgggugagcugcuggaccuccgaggacaucuucgagaccacggagcucauccacugggugcgccaggccccggggcagggccuggaguggaucgggugggucaagaccgugagcggcgccgugaacuucggcucccccaacuuccggcaccgcgucagccugacccgggaccgcgaccucuucaccgcccacauggacauccgggggcugacgcagggcgacaccgccaccuacuucugcgcgcgccagaaguucgagcgcgggggccaggggugguacuucgaccuguggggccggggcacccucaucgugguguccagc

SEQ ID NO: 10887 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaaggccguguccggcgccgugaacuucggcagccccaacuuccggcaccgcgucucccugacgcgggaccgcgaccucuucaccgcccacauggacauccgggggcugacccagggcgacaccgccacguacuucugcgcgcgccagaaguucgagcgcgggggccaggggugguacuucgaccuguggggccggggcacccucaucguggugagcucc

SEQ ID NO: 10888 - RNA, 375 nt, Artificial Sequence
  derived and/or modified sequence opt1 from anti-HIV-1_HeavyChain
caggcccaccugggcaccauccucgggcuggagagcaagaagcccggcgccuccgugcgcgucagcugcuggaccuccgaggacaucuucgagcggacggagcugauccacugggugcgccaggcgccggggcagggccucgaguggaucgggugggugaagaccgucaccggcgccagcauccuggcccccaacuuccggcaccgcgugucccugacccgggaccgcgaccucuucacggcccacauggacauccggggccugacccagggggacaccgccaccuacuucugcgcgcgccagaaguucgagcggggcgggcagggcugguacuucgaccugugggggcgcggcacgcucaucguggucagcucc

SEQ ID NO: 10889 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgcccucuucaccgcccacauggacauccgggggcugacgcagggcgacaccgccaccuacuucugcgcgcgccagaaguucgcccgcggggaccagggcugguucuucgaccugugggggcggggcacccucaucgugguguccagc

SEQ ID NO: 10890 - RNA, 375 nt, Artificial Sequence
  derived and/or modified sequence opt1 from anti-HIV-1_HeavyChain
cgcgugcaccuggagcagagcggcuccggggucaagaagcccggcgccagcgugcggguguccugcuggaccagcgaggacaucuucgagcgcaccgagcucauccacuggguccggcaggccccggggcagggccuggaguggaucgggugggugaagacggugaccggcgcggucaacuucggcucccccaacuuccgccaccgggugagccugacccgcgaccgggaccucuucaccgcccacauggacauccgcgggcugacgcagggcgacaccgccaccuacuucugcgcccggcagaaguucgagcgcgggggccaggggugguacuucgaccuguggggccggggcacccucaucguggucuccagc

SEQ ID NO: 10891 - RNA, 375 nt, Artificial Sequence
  derived and/or modified sequence opt1 from anti-HIV-1_HeavyChain
caggcccaccuggagcagagcggcgccggggugaagaagcccggcgcguccguccgcgugagcugcuggaccuccgaggacaucuucgagcggaccgagcucauccacugggugcgccaggccccggggcagggccuggaguggaucgggugggucaagacggugaccggcgccgugaacuucggcagccccaacuuccggcagcgcgucucccugacccgggaccgcgaccucagcaccgcccacauggacauccgggggcugacgcaggacgacaccgccaccuacuucugcgcgcgccagaaguucgcccggggcgaccaggggugguucuucgaccuguggggccgcgggacccucaucgugguguccagc

SEQ ID NO: 10892 - RNA, 375 nt, Artificial Sequence
  derived and/or modified sequence opt1 from anti-HIV-1_HeavyChain
caggugcagcugguccagagcggcgccgaggugaagcgccccggggccuccgugaaggucagcugcuggaccuccgaggacaucuucgagcggaccgagcucauccacugggugcgccaggcgccgggccaggggcuggaguggaucggcugggugaagacggucagcggggccgugaacuucggcucccccaacuuccggcaccgcgugagccugacccgggaccgcgaccucuucaccgcccacauggacauccggggccugacccagggggacacggccaccuacuucugcgcccgccagaaguucgagcggggcgggcagggcugguacuucgaccugugggggcgcggcacccucaucgucguguccagc

SEQ ID NO: 10893 - RNA, 375 nt, Artificial Sequence
  derived and/or modified sequence opt1 from anti-HIV-1_HeavyChain
cgccacgaccuggagcagagcggcuccggggugaagaagcccggcgccagcguccggguguccugcuggaccagcgaggacaucuucgagcgcaccgagcucauccacugggugcggcaggccccggggcagggccuggaguggaucgggugggucaagaucguguccggcgcggugaacuucggcagccccaacuuccgccagcgggucucccugacgcgcgaccgggaccucuucaccgcccacauggacauccgcgggcugacccagggcgacaccgccacguacuucugcgcccggcagaaguucgagcgcgggggccagggguggaucuucgaccuguggggccggggcacccucaucgccgugagcucc

SEQ ID NO: 10894 - RNA, 375 nt, Artificial Sequence
  derived and/or modified sequence opt1 from anti-HIV-1_HeavyChain
cgccacaccugggagcaggucuggagcggcgugaagaagcccggggccuccgugcgggugagcugcuggaccuccgaggacaucuucgagaaguccgagcugauccacuggguccgccaggccccgggccaggggcucgaguggaucggcugggugaagacggugaccggggcggucaacuucggcagcagcgacuuccggcagcgcgugucccugacccgggaccgcgaccuguucaccgcccacauggacauccggggccucacgcagggggacaccgccaccuacuucugcgcccgccagaaguucuacgccggcgggcagggcugguacuucgaccugugggggcggggcacccugaucguggucagcucc

SEQ ID NO: 10895 - RNA, 375 nt, Artificial Sequence
  derived and/or modified sequence opt1 from anti-HIV-1_HeavyChain
cgccacaccuggaacaagagcggcuccggggugaagaagcccggcgccagcguccggguguccugcuggaccagcgaggacaucuucgagcgcacggagcugauccacugggugcggcaggccccggggcagggccucgaguggaucgggugggucaaggcgguguccggcgccgugaacuacggcagccuggacuuccgccaccgggucucccugacccgcgaccgggaccucagcaccgcccacauggacauccgcgggcugacccaggacgacacggccaccuacuucugcgcccggcagaaguucgcgcgcggcgaccaggggugguucuucgaccuguggggccgggggacccucaucgugguguccagc

SEQ ID NO: 10896 - RNA, 375 nt, Artificial Sequence
  derived and/or modified sequence opt1 from anti-HIV-1_HeavyChain
cgccacaccugggagcagagcggcuccggggugaagaagcccggcgccagcguccggguguccugcuggaccagcgaggacaucuucgagaaguccgagcugauccacugggugcgccaggccccggggcagggccucgaguggaucgggugggucaagacggugaccggcgcggugaacuucggcagcuccgacuuccggcagcgcgucagccugacccgggaccgcgaccuguucaccgcccacauggacauccgggggcucacgcagggcgacaccgccaccuacuucugcgcccgccagaaguucgagcgcgggggccagggguggaucuucgaccuguggggccggggcacccugaucgccguguccagc

SEQ ID NO: 10897 - RNA, 375 nt, Artificial Sequence
  derived and/or modified sequence opt1 from anti-HIV-1_HeavyChain
caggcccaccuggagcagagcggcuccggggugaagcgccccggcgccagcguccggguguccugcuggaccagcgaggacaucuucgagaccacggagcucauccacugggugcgccaggcgccggggcagggccuggaguggaucgggugggucaaggccguguccggcgccgugaacuacggcagccuggacuuccggcaccgcgucucccucacccgggaccgcgaccugagcaccgcccacauggacauccgggggcugacccaggacgacacggccaccuacuucugcgcgcgccagaaguucgcccggggcgaccaggggugguucuucgaccucuggggccgcgggacccugaucgugguguccagc

SEQ ID NO: 10898 - RNA, 375 nt, Artificial Sequence
  derived and/or modified sequence opt1 from anti-HIV-1_HeavyChain
cgccacgaccuggagcagagcggcuccggggugaagaagcccggcgccagcguccggguguccugcuggaccagcgaggacaucuucgagcgcaccgagcucauccacugggugcggcaggccccggggcagggccuggaguggaucgggugggucaagacggugaccggcgcggugaacuucggcucccccaacuuccgccaccgggucagccugacccgcgaccgggaccucuucaccgcccacauggacauccgcgggcugacgcagggcgacaccgccaccuacuucugcgcccggcagaaguucgagcgcgggggccaggggugguacuucgaccuguggggccggggcacccucaucgugguguccagc

SEQ ID NO: 10899 - RNA, 375 nt, Artificial Sequence
  derived and/or modified sequence opt1 from anti-HIV-1_HeavyChain
cgccacaccugggagcagagcggcuccggggugaagaagcugggcgccagcguccggguguccugcuggaccagcgaggacaucuucgagcgcacggagcucauccacugggugcggcaggcccccgggcagggccuggaguggaucgggugggucaaggcgguguccggcgccgugaacuacggcagccuggacuuccgccaccgggucucccucacccgcgaccgggaccugagcaccgcccacauggacauccgcgggcugacccaggacgacacggccaccuacuucugcgcccggcagaaguucgcgcgcggcgaccaggggugguucuucgaccucuggggccgggggacccugaucgugguguccagc

SEQ ID NO: 10900 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugccucgcgagcgaggacaucuucgagaaguccgagcugauccacugggugcggcaggccccggggcagggccuggaguggaucgggugggucaagaccgugaccggcgccgugaacuucggcagcuccgacuuccgccagcgggucagccucacgcgcgaccgggaccuguucaccgcccacauggacauccgcgggcugacccagggcgacaccgccacguacuucugcgcgcggcagaaguucuacgccgggggccaggggugguacuucgaccucuggggccgcggcacccugaucgugguguccagc

SEQ ID NO: 10901 - RNA, 375 nt, Artificial Sequence
  derived and/or modified sequence opt1 from anti-HIV-1_HeavyChain
caggcccaccuggagcagagcggcgccggggugaagaagcccggcgcguccguccgcgugagcugcuggaccuccgaggacaucuucgagaaguccgagcucauccacugggugcggcaggccccggggcagggccuggaguggaucgggugggucaagaccgugacgggcgccgugaacuucggcagcagcgacuuccgccagcgggucucccugacccgcgaccgggaccucuucaccgcccacauggacauccgcgggcugacccagggcgacacggccaccuacuucugcgcgcggcagaaguucuacgccgggggccaggggugguacuucgaccuguggggccgcggcacccucaucguggugagcucc

SEQ ID NO: 10902 - RNA, 375 nt, Artificial Sequence
  derived and/or modified sequence opt1 from anti-HIV-1_HeavyChain
cgccacaccugggagcagagcggcuccggggugaagaagcccggcgccagcguccggguguccugcuggaccagcgaggacaucuucgagaaguccgagcugauccacugggugcgccaggccccggggcagggccucgaguggaucgggugggucaagacggugaccggcgcggugaacuucggcagcuccgacuuccggcagcgcgucagccugacccgggaccgcgaccuguucaccgcccacauggacauccgggggcucacgcagggcgacaccgccaccuacuucugcgcccgccagaaguucuacgccgggggccaggggugguacuucgaccuguggggccggggcacccugaucgugguguccagc

SEQ ID NO: 10903 - RNA, 375 nt, Artificial Sequence
  derived and/or modified sequence opt1 from anti-HIV-1_HeavyChain
cgccacaccugggagcagagcggcuccggggugaagaagcccggcgccagcguccggguguccugcuggaccagcgaggacaucuucgagcgcacggagcugauccacugggugcggcaggccccggggcagggccucgaguggaucgggugggucaagaccgugaccggcgcggugaacuucggcucccccaacuuccgccaccgggucagccugacccgcgaccgggaccuguucacggcccacauggacauccgcgggcucacccacggcgacaccgccaccuacuucugcgcccggcagaaguucgagcgcgggggccaggggugguacuucgaccuguggggccggggcacgcugaucgugguguccagc

SEQ ID NO: 10904 - RNA, 375 nt, Artificial Sequence
  derived and/or modified sequence opt1 from anti-HIV-1_HeavyChain
cgccacaccugggagcagagcggcuccggggugaagaagcugggcgcgagcguccggguguccugcuggaccagcgaggacaucuucgagcgcacggagcucauccacugggugcggcaggcccccgggcagggccuggaguggaucgggugggucaaggcgguguccggcgccgugaacuacggcagccuggacuuccgccaccgggucucccucacccgcgaccgggaccuguucaccgcccacauggacauccgcgggcugacccagggcgacacggccaccuacuucugcgcccggcagaaguucuacgccgggggccaggggugguacuucgaccucuggggccgcggcacccugaucguggugagcucc

SEQ ID NO: 10905 - RNA, 375 nt, Artificial Sequence
  derived and/or modified sequence opt1 from anti-HIV-1_HeavyChain
caggcccaccuggagcagagcggcgccggggugaagaagcucggcgcguccguccgcgugagcugcuggaccuccgaggacaucuucgagcggaccgagcugauccacugggugcgccaggcccccgggcagggccuggaguggaucgggugggucaaggccgugagcggcgccgugaacuacggcucccucgacuuccggcaccgcgucagccugacgcgggaccgcgaccuguucaccgcccacauggacauccgggggcucacccaggacgacaccgcgacguacuucugcgcccgccagaaguucgcccggggcgaccaggggugguucuucgaccuguggggccgcgggacccugaucgugguguccagc

SEQ ID NO: 10906 - RNA, 375 nt, Artificial Sequence
  derived and/or modified sequence opt1 from anti-HIV-1_HeavyChain
caggcccaccuggagcagagcggcuccggggugaagaagcccggcgccagcgucgagguguccugcuggaccagcgaggacaucuucgagcgcaccgagcucauccacugggugcggcaggcgccggggcagggccuggaguggaucgggugggucaagacgguguccggcgccgugaacuucggcagccccaacuuccgccaccgggucucccugacccgcgaccgggaccucuucaccgcccacauggacauccgcgggcugacccagggcgacacggccaccuacuucugcgcccggcagaaguucgcgcgcggggaccagggcugguucuucgaccugugggggcggggcacccucaucguggugagcucc

SEQ ID NO: 10907 - RNA, 372 nt, Artificial Sequence
  derived and/or modified sequence opt1 from anti-HIV-1_HeavyChain
caggcccaccuggagcagagcggcgccggggugaagaagcucggcgcguccguccgcgugagcugcuggaccuccgaggacaucuucaagaccgagcugauccacugggugcggcaggcccccgggcagggccuggaguggaucgggugggucaaggccgugagcggcgccgugaacuacggcucccucgacuuccgccaccgggucagccugacgcgcgaccgggaccuguccaccgcccacauggacauccgcgggcucacccaggacgacaccgcgacguacuucugcgcccggcagaaguucgcccgcggcgaccaggggugguucuucgaccuguggggccgggggacccugaucguggugagcucc

SEQ ID NO: 10908 - RNA, 375 nt, Artificial Sequence
  derived and/or modified sequence opt1 from anti-HIV-1_HeavyChain
cgccacaccugggagcagagcggcuccggggugaagaagcccggcgccagcguccggguguccugcuggaccagcgaggacaucuucgagcgcacggagcugauccacugggugcggcaggccccggggcagggccucgaguggaucgggugggucaagaccgugaccggcgcggugaacuucggcucccccaacuuccgccaccgggucagccugacccgcgaccgggaccuguucacggcccacauggacauccgcgggcucacccagggcgacaccgccaccuacuucugcgcccggcagaaguucuacgccgggggccaggggugguacuucgaccuguggggccgcggcacgcugaucgugguguccagc

SEQ ID NO: 10909 - RNA, 375 nt, Artificial Sequence
  derived and/or modified sequence opt1 from anti-HIV-1_HeavyChain
cgccacaccugggagcggaucuggagcggcgugaagaagcccggggccuccguccgcgugagcugcuggaccuccgaggacaucuucgagcggacggagcugauccacugggugcgccaggccccgggccaggggcucgaguggaucggcugggucaagaucgugagcggggcggugaacuucggcucccccaacuuccggcagcgcgucagccugacccgggaccgcgaccuguucaccgcccacauggacauccggggccucacccagggggacacggccaccuacuucugcgcccgccagaaguucgagcggggcgggcagggcuggaucuucgaccugugggggcgcggcacccugaucgccguguccagc

SEQ ID NO: 10910 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccugagcaccgcccacauggacauccggcgccucacccaggacgacaccgccacguacuucugcgcgcggcagaaguucgcccgcggggaccagggcugguucuucgaccugugggggcggggcacccugaucgugguguccagc

SEQ ID NO: 10911 - RNA, 375 nt, Artificial Sequence
  derived and/or modified sequence opt1 from anti-HIV-1_HeavyChain
cgccacaccguggagcagagcggcuccggggucaagaagcccggcgccagcgugcggguguccugcuggaccagcgaggacaucuucgagcgcacggagcugauccacuggguccggcaggccccggggcagggccucgaguggaucgggugggugaagaccgugaccggcgcggucaacuucggcucccccaacuuccgccaccgggugagccugacccgcgaccgggaccuguucacggcccacauggacauccgcgggcucacccagggcgacaccgccaccuacuucugcgcccggcagaaguucgagcgcgggggccaggggugguacuucgaccuguggggccggggcacgcugaucguggucuccagc

SEQ ID NO: 10912 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccccgaccgcgaccucuucaccgcccacauggacauccgggggcugacccagggcgacacggccaccuacuucugcgcccgccagaaguucuacgccgggggccaggggugguacuucgaccuguggggccggggcacccucaucgugguguccagc

SEQ ID NO: 10913 - RNA, 375 nt, Artificial Sequence
  derived and/or modified sequence opt1 from anti-HIV-1_HeavyChain
cgccacaccguggagcagagcggcuccggggucaagaaggugggcgccagcgugcgggucuccugcuggaccagcgaggacaucuucgagcgcacggagcugauccacugggugcggcaggcccccgggcagggccucgaguggaucgggugggugaaggcggucuccggcgccgugaacuacggcagccuggacuuccgccaccgggugucccugacccgcgaccgggaccucuucaccgcccacauggacauccgcgggcugacccaggacgacacggccaucuacuucugcgcccggcagaaguucgcgcgcggcgaccaggggugguucuucgaccuguggggccgggggacccucaucgucgugagcucc

SEQ ID NO: 10914 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcugggcgagcgaggacaucuucgagcggaccgagcucauccacugggugcgccaggccccggggcagggccuggaguggaucgggugggucaagaccguguccggcgccgugaacuucggcagccccaacuuccggcaccgcgucucccugacgcgggaccgcgaccucuucaccgcccacauggacauccgggggcugacccagggcgacaccgccacguacuucugcgcgcgccagaaguucgagcgcgggggccaggggugguacuucgaccuguggggccggggcacccucaucguggugagcucc

SEQ ID NO: 10915 - RNA, 375 nt, Artificial Sequence
  derived and/or modified sequence opt1 from anti-HIV-1_HeavyChain
cgccacaccugggagcaggucuggagcggcgugaagaagcccggggccuccgugcgggugagcugcuggaccuccgaggacaucuucgagcgcacggagcugauccacuggguccggcaggccccgggccaggggcucgaguggaucggcugggugaagaccgugaccggggcggucaacuucggcagccccaacuuccgccaccgggugucccugacccgcgaccgggaccuguucacggcccacauggacauccgcggccucacccagggggacaccgccaccuacuucugcgcccggcagaaguucgagcgcggcgggcagggcugguacuucgaccugugggggcggggcacgcugaucguggucagcucc

SEQ ID NO: 10916 - RNA, 375 nt, Artificial Sequence
  derived and/or modified sequence opt1 from anti-HIV-1_HeavyChain
cgccacaccuggcggcagagcggcuccggggugaagaagcugggcgccagcguccgcguguccugcuggaccagcgaggacaucuucgagcggacggagcucauccacugggugcgccaggcccccgggcagggccuggaguggaucgggugggucaaggcgguguccggcguggucaacuacggcagccuggacuuccggcaccgcgugucccucacccgggaccgcgaccugagcaccgcccacauggacauccgggggcugacccaggacgacacggccaccuacuucugcgcccgccagaaguucgcccggggcgaccaggggugguucuucgaccucuggggccgcgggacccugaucguggucuccagc

SEQ ID NO: 10917 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcggggacaucuucgagcggaccgagcucauccacugggugcgccaggcgccgggccaggggcuggaguggaucggcugggucaagaucguguccggcgccgugaacuucgggagccccaacuuccggcagcgcgucucccugacgcgggaccgcgaccucuucaccgcccacauggacauccggggccugacccagggggacaccgccacguacuucugcgcccgccagaaguucgagcggggcgggcagggcuggaucuucgaccuguggggccgcgggacccucaucgcggugagcucc

SEQ ID NO: 10918 - RNA, 375 nt, Artificial Sequence
  derived and/or modified sequence opt1 from anti-HIV-1_HeavyChain
cgccacaccguggagcagagcggcuccggggucaagaagcccggcgccagcgugcggguguccugcuggaccagcgaggacaucuucgagaaguccgagcugauccacuggguccgccaggccccggggcagggccucgaguggaucgggugggugaagacggugaccggcgcggucaacuucggcagcuccgacuuccggcagcgcgugagccugacccgggaccgcgaccuguucaccgcccacauggacauccgggggcucacgcagggcgacaccgccaccuacuucugcgcccgccagaaguucuacgccgggggccaggggugguacuucgaccuguggggccggggcacccugaucguggucuccagc

SEQ ID NO: 10919 - RNA, 375 nt, Artificial Sequence
  derived and/or modified sequence opt1 from anti-HIV-1_HeavyChain
caggcccaccuggagcagagcggcuccggggugaagaagcgcugggccagcguccggguguccugcuggaccagcgaggacaucuucgagcgcaccgagcucauccacugggugcggcaggcgcccggccaggggcuggaguggaucggcugggucaaggccguguccggggccgugaacuacggcagccuggacuuccgccaccgggucucccucacgcgcgaccgggaccuguucaccgcccacauggacauccgcggccugacccaggacgacaccgccacguacuucugcgcgcggcagaaguucgcccgcggggaccagggcugguucuucgaccucugggggcggggcacccugaucguggugagcucc

SEQ ID NO: 10920 - RNA, 375 nt, Artificial Sequence
  derived and/or modified sequence opt1 from anti-HIV-1_HeavyChain
cgccacaccguggagcagagcggcuccggggucaagcggcccggcgccagcgugcgcguguccugcuggaccagcgaggacaucuucgagacgaccgagcugauccacuggguccggcaggccccggggcagggccucgaguggaucgggugggugaagaccgugaccggcgcggucaacuucggcuccagcgacuuccgccagcgggugucccugacgcgcgaccgggaccuguucaccgcccacauggacauccgcgggcucacccagggcgacaccgccacguacuucugcgcccggcagaaguucuacgccgggggccaggggugguacuucgaccuguggggccgcggcacccugaucguggucagcucc

SEQ ID NO: 10921 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgggcuguucaccgcccacauggacauccggggccucacccaggacgacaccgccacguacuucugcgcgcgccagaaguucgcccgcggggaccagggcugguucuucgaccugugggggcggggcacccugaucguggugagcucc

SEQ ID NO: 10922 - RNA, 375 nt, Artificial Sequence
  derived and/or modified sequence opt1 from anti-HIV-1_HeavyChain
caggugcaccuggagcagagcggcuccggggucaagaagcccggcgccagcgugcgcguguccugcuggaccagcgaggacaucuucgagaaguccgagcucauccacuggguccggcaggccccggggcagggccuggaguggaucgggugggugaagaccgugacgggcgcggccaacuucggcagcuccgacuuccgccagcgggucagccugacccccgaccgcgaccucuucaccgcccacauggacauccgggggcugacccagggcgacacggccaccuacuucugcgcccgccagaaguucuacaagggcgggcaggggugguacuucgaccuguggggccggggcacccucaucgugguguccagc

SEQ ID NO: 10923 - RNA, 375 nt, Artificial Sequence
  derived and/or modified sequence opt1 from anti-HIV-1_HeavyChain
caggcccaccuggagcagagcggcgccggggugaagaagcccggcgcguccguccgcgugagcugcuggaccuccgaggacaucuucgacaccacggagcucauccacugggugcggcaggccccggggcagggccuggaguggaucgggugggucaagaucgugagcggcgccgugaacuucggcucccccaacuuccgccagcgggucagccugacccgcgaccgggaccucuucaccgcccacauggacauccgcgggcugacccagggcgacacggccaccuacuucugcgcgcggcagaaguucgagcgcgggggccagggguggaucuucgaccuguggggccggggcacccucaucgccguguccagc

SEQ ID NO: 10924 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagccgggacaucuucgagcgcaccgagcugauccacugggugcggcaggcgcccgggcagggccuggaguggaucgggugggucaaggccguguccggcgccgugaacuacggcagccucgacuuccgccaccgggucucccugacgcgcgaccgggaccugagcaccgcccacauggacauccgcgggcucacccaggacgacaccgccacguacuucugcgcgcggcagaaguucgcccgcggcgaccaggggugguucuucgaccuguggggccgggggacccugaucgugguguccagc

SEQ ID NO: 10925 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugccuggcgagcgaggacaucuucgagcggaccgagcugauccacugggugcgccaggcccccgggcagggccucgaguggaucgggugggucaaggccguguccggcgccgugaacuacggcagccuggacuuccggcaccgcgucucccugacccgggaccgcgaccucagcacggcccacauggacauccgggggcugacccaggacgacaccgcgaccuacuucugcgcccgccagaaguucgcccggggcgaccaggggugguucuucgaccuguggggccgcgggacgcucaucgugguguccagc

SEQ ID NO: 10926 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggccgagcgaggacaucuucgagcggaccgagcucauccacugggugcgccaggcgcccgggcagggccuggaguggaucgggugggucaagaccgugacgggcaccgugaacuucggcucccugaacuuccggcagcgcgucagccucacccgggaccgcgaccuguucaccgcccacauggacauccgggggcugacgcagggcgacaccgccaccuacuucugcgcccgccagaaguucgagcgcgggggccaggggugguacuucgaccucuggggccggggcacccugaucgugguguccagc

SEQ ID NO: 10927 - RNA, 375 nt, Artificial Sequence
  derived and/or modified sequence opt1 from anti-HIV-1_HeavyChain
cgcgcccaccuggagcagagcggcuccgaguggaagaagcucggggccagcgugcgggucuccugcuggaccagcggcgacaucuucgagcgcaccgagcugauccacugggugcggcaggcgcccgggcagggccuggaguggaucgggugggugaaggccgucuccggcgccgugaacuacggcagccucgacuuccgccaccgggugucccugacgcgcgaccgggaccuguucaccgcccacauggacauccgcgggcucacccaggacgacaccgccacguacuucugcgcgcggcagaaguucgcccgcggcgaccaggggugguucuucgaccuguggggccgggggacccugaucgucgugagcucc

SEQ ID NO: 10928 - RNA, 375 nt, Artificial Sequence
  derived and/or modified sequence opt1 from anti-HIV-1_HeavyChain
cgccacaccguggagcagagcggcuccggggucaagaagcugggcgccagcgugaacguguccugcuggaccagcgaggacaucuucgagcggacggagcucauccacuggguccgccaggcccccgggcagggccuggaguggaucgggugggugaaggcgguguccggcgccgucaacuacggcagccuggacuuccggcaccgcgugucccucacccgggaccgcgaccuguucaccgcccacauggacauccgggggcugacccaggacgacacggccaccuacuucugcgcccgccagaaguucgcgcggggcgaccaggggugguucuucgaccucuggggccgcgggacccugaucguggucagcucc

SEQ ID NO: 10929 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagcccgugaccggcgccgugaacuucggcagcuccgacuuccgccagcgggucagccugacgcgcgaccgggaccucuucaccgcccacauggacauccgcgggcugacccagggcgacaccgccacguacuucugcgcccggcagaaguucuacgccgggggccaggggugguacuucgaccuguggggccgcggcacccucaucgugguguccagc

SEQ ID NO: 10930 - RNA, 375 nt, Artificial Sequence
  derived and/or modified sequence opt1 from anti-HIV-1_HeavyChain
cgccacaccuggaacaagagcggcuccggggugaagaagcccggcgccagcguccggguguccugcuggaccagcgaggacaucuucgagcgcacggagcugauccacugggugcggcaggccccggggcagggccucgaguggaucgggugggucaagaccgugaccggcgcggugaacuucggcucccccaacuuccgccaccgggucagccugacccgcgaccgggaccuguucacggcccacauggacauccgcgggcucacccagggcgacaccgccaccuacuucugcgcccggcagaaguucgagcgcgggggccaggggugguacuucgaccuguggggccggggcacgcugaucgugguguccagc

SEQ ID NO: 10931 - RNA, 375 nt, Artificial Sequence
  derived and/or modified sequence opt1 from anti-HIV-1_HeavyChain
caggcccacagcgagcaguccggcagcggggugaagaagcccggcgccuccguccgcgugagcugcuggaccuccgaggacaucuucgagcggaccgagcugauccacugggugcgccaggcgccggggcagggccucgaguggaucgggugggucaagaucgugagcggcgccgugaacuucggcucccccaacuuccggcagcgcgucagccugacgcgggaccgcgaccuguucaccgcccacauggacauccgggggcucacccagggcgacaccgccacguacuucugcgcccgccagaaguucgagcgcgggggccagggguggaucuucgaccuguggggccggggcacccugaucgcgguguccagc

SEQ ID NO: 10932 - RNA, 375 nt, Artificial Sequence
  derived and/or modified sequence opt1 from anti-HIV-1_HeavyChain
caggcccaccuggagcagagcggcgccggggugaagcgccccggcgcguccguccgggugagcugcuggaccuccgaggacaucuucgagaccacggagcucauccacugggugcgccaggccccggggcagggccuggaguggaucgggugggucaagaccgugaccggcgccgugaacuucggcagccccaacuuccggcaccgcgucucccugacccgggaccgcgaccucuucacggcccacauggacauccgggggcugacccagggcgacaccgccaccuacuucugcgcgcgccagaaguucgagcgcgggggccaggggugguacuucgaccuguggggccggggcacgcucaucguggugagcucc

SEQ ID NO: 10933 - RNA, 375 nt, Artificial Sequence
  derived and/or modified sequence opt1 from anti-HIV-1_HeavyChain
ggccacaccugggagcagagcggggccggcgugaagaagcugggggccuccguccgcgugagcugcuggaccuccgaggacaucuucgagcggacggagcucauccacugggugcgccaggcgcccggccaggggcuggaguggaucggcugggucaaggccgugagcggcgccgugaacuacgggucccuggacuuccggcaccgcgucagccucacccgggaccgcgaccuguucaccgcccacauggacauccggggccugacccaggacgacacggccaucuacuucugcgcgcgccagaaguucgcccgcggggaccagggcugguucuucgaccucugggggcggggcacccugaucgugguguccagc

SEQ ID NO: 10934 - RNA, 375 nt, Artificial Sequence
  derived and/or modified sequence opt1 from anti-HIV-1_HeavyChain
ggcacccccgggagcgaguccggcagcggggugaagaagcugggcgccuccguccgcgugagcugcuggaccuccgaggacaucuucgagcggacggagcucauccacugggugcgccaggccccggggcagggccuggaguggaucggcugggucaaggcggugagcggggccgugaacuacggcucccuggacuuccggcaccgcgucagccucacccgggaccgcgaccuguccaccgcccacauggacauccgggggcugacccaggacgacacggccaccuacuucugcgcccgccagaaguucgcgcggggcgaccaggggugguucuucgaccucuggggccgcggcacccugaucguggugagcucc

SEQ ID NO: 10935 - RNA, 375 nt, Artificial Sequence
  derived and/or modified sequence opt1 from anti-HIV-1_HeavyChain
ggcacccccgggagcgaguccggcagcggggugaagaugccgggcgccuccguccgcgugagcugcuggaccuccgaggacaucuucgagcggacggagcugauccacugggugcgccaggcccccgggcagggccucgaguggaucggcugggucaagaccgugagcggggcggugaacuucggcucccccaacuuccggcaccgcgucagccugacccgggaccgcgaccuguucaccgcccacauggacauccgggggcucacgcagggcgacaccgccaccuacuucugcgcccgccagaaguucgagcgcgggggccagggcugguacuucgaccugugggggcggggcacccugaucgugguguccagc

SEQ ID NO: 10936 - RNA, 375 nt, Artificial Sequence
  derived and/or modified sequence opt1 from anti-HIV-1_HeavyChain
cgccacaccugggagcagagcggcgccggggugaagaagcccggcgccuccguccgggugagcugcuggaccuccgaggacaucuucgagcgcacggagcugauccacugggugcggcaggcgccggggcagggccucgaguggaucgggugggucaagaccgugagcggcgccgugaacuucggcucccccaacuuccgccaccgggucagccugacccgcgaccgggaccuguucaccgcccacauggacauccgcgggcucacgcagggcgacaccgccaccuacuucugcgcccggcagaaguucgagcgcgggggccaggggugguacuucgaccuguggggccggggcacccugaucgugguguccagc

SEQ ID NO: 10937 - RNA, 375 nt, Artificial Sequence
  derived and/or modified sequence opt1 from anti-HIV-1_HeavyChain
ggcacccccgggaacaagagcggcuccggggugaagaagccgggcgccagcguccgcguguccugcuggaccagcgaggacaucuucgagaaguccgagcugauccacugggugcggcaggcccccgggcagggccucgaguggaucggcugggucaagacggugaccggggcggugaacuucggcagcuccgacuuccgccagcgggucagccugacccgcgaccgggaccuguucaccgcccacauggacauccgcgggcucacgcagggcgacaccgccaccuacuucugcgcccggcagaaguucuacgccgggggccagggcugguacuucgaccugugggggcgcggcacccugaucgugguguccagc

SEQ ID NO: 10938 - RNA, 375 nt, Artificial Sequence
  derived and/or modified sequence opt1 from anti-HIV-1_HeavyChain
caggcccaccuggagcagagcggcgccggggugaagaagcccggcgcguccguccgcgugagcugcugguccagcgaggacaucuucgagcggaccgagcucauccacugggugcgccaggccccggggcagggccuggaguggaucgggugggucaagaccgugacgggcgccgugaacuucggcucccccaacuuccggcaccgcgucagccugacccgggaccgcgaccucuucaccgcccacauggacauccgggggcugacccagggcgacacggccaccuacuucugcgcgcgccagaaguucgagcgcgggggccaggggugguacuucgaccuguggggccggggcacccucaucgugguguccagc

SEQ ID NO: 10939 - RNA, 375 nt, Artificial Sequence
  derived and/or modified sequence opt1 from anti-HIV-1_HeavyChain
ggcacccccgggaacaagagcggcuccggggugaagaagccgggcgccagcguccgcguguccugcuggaccagcgaggacaucuucgagcggacggagcugauccacugggugcgccaggcccccgggcagggccucgaguggaucggcugggucaagaccgugaccggggcggugaacuucggcucccccaacuuccggcaccgcgucagccugacccgggaccgcgaccuguucacggcccacauggacauccgggggcucacccagggcgacaccgccaccuacuucugcgcccgccagaaguucgagcgcgggggccagggcuggaucuucgaccugugggggcggggcacgcugaucgccguguccagc

SEQ ID NO: 10940 - RNA, 375 nt, Artificial Sequence
  derived and/or modified sequence opt1 from anti-HIV-1_HeavyChain
ggcacccccgggaacaagagcggcuccggggugaagaagccgggcgccagcguccgcguguccugcuggagcuccgaggacaucuucgagcggaccgagcugauccacugggugcgccaggcccccgggcagggccucgaguggaucggcugggucaagacggugaccggggcggugaacuucggcagccuggacuuccggcaccgcaucucccugacccgggaccgcgaccucuucaccgcccacauggacauccgggggcugacgcagggcgacaccgccaccuacuucugcgcccgccagaaguucgagcgcgggggccagggcuggaucuucgaccugugggggcggggcacccucaucgccgucagcucc

SEQ ID NO: 10941 - RNA, 375 nt, Artificial Sequence
  derived and/or modified sequence opt1 from anti-HIV-1_HeavyChain
caggcccaccuggagcagagcgccuccggcgugaagcgccccgggggcuggguccgggugagcugcuggaccuccgaggacaucuucgagcgcagcgagcucaucuacugggugcggcaggcgccggggcagggccuggaguggaucgggugggucaagaccgugacgggcgccgugaacuucggcucccccaacuuccgccaccgggucagccugacccgcgaccgggaccucuucaccgcccacauggacauccgcgggcugacccagggcgacacggccaccuacuucugcgcccggcagaaguucgagcgcgggggccaggggugguacuucgaccuguggggccggggcacccucaucgugguguccagc

SEQ ID NO: 10942 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacguccagcggcgccgugaacuucggcucccccaacuuccggacccgcgugagccugacccgggaccgcgaccucuucaccgcccacauggacauccgggggcugacgcagggcgacaccgccaccuacuucugcgcccgccagaaguucgagcgcgggggccaggggugguacuucgaccuguggggccggggcacccucaucgucguguccagc

SEQ ID NO: 10943 - RNA, 375 nt, Artificial Sequence
  derived and/or modified sequence opt1 from anti-HIV-1_HeavyChain
caggcccaccuggagcagagcggcgccggggugaagaagcccggcgcguccguccgcgugagcugcuggaccuccgaggacaucuucgagcggaccgagcucauccacugggugcgccaggccccggggcagggccuggaguggaucgggugggucaagacggugagcggcgccgugaacuucggcucccccaacuuccggcaccgcgucagccugacccgggaccgcgaccucuucaccgcccacauggacauccgggggcugacccagggcgacacggccaccuacuucugcgcgcgccagaaguucgagcgcgggggccaggggugguacuucgaccuguggggccggggcacccucaucgugguguccagc

SEQ ID NO: 10944 - RNA, 375 nt, Artificial Sequence
  derived and/or modified sequence opt1 from anti-HIV-1_HeavyChain
cgccacaccugggagcagagcggcuccggggugaagaagcccggcgccagcguccggguguccugcuggaccagcgaggacaucuucgagcgcacggagcugauccacugggugcggcaggccccggggcagggccucgaguggaucgggugggucaagaccgugaccggcgcggugaacuucggcucccccaacuuccgccaccgggucagccugacccgcgaccgggaccuguucacggcccacauggacauccgcgggcucacccagggcgacaccgccaccuacuucugcgcccggcagaaguucgagcgcgggggccaggggugguacuucgaccuguggggccggggcacgcugaucgugguguccagc

SEQ ID NO: 10945 - RNA, 375 nt, Artificial Sequence
  derived and/or modified sequence opt1 from anti-HIV-1_HeavyChain
ggcaccaccuggaacaagagcggguccggcgugaagaagcccggggccagcguccgcguguccugcuggacgagcgaggacaucuucgagcggaccgagcugauccacugggugcgccaggccccgggccaggggcucgaguggaucggcugggucaagaccgugaccggcgcggugaacuucgggucccccaacuuccggcaccgcgucagccugacgcgggaccgcgaccuguucaccgcccacauggacauccggggccucacccagggggacaccgccacguacuucugcgcccgccagaaguucgagcggggcgggcagggcugguacuucgaccuguggggccgcgggacccugaucgugguguccagc

SEQ ID NO: 10946 - RNA, 375 nt, Artificial Sequence
  derived and/or modified sequence opt1 from anti-HIV-1_HeavyChain
cgccacaccuggaacgagagcggcuccggggugaagaagcccggcgccagcguccggguguccugcuggaccagcgaggacaucuucgagaaguccgagcugauccacugggugcgccaggccccggggcagggccucgaguggaucgggugggucaagacggugaccggcgcggugaacuucggcagcuccgacuuccggcagcgcgucagccugacccgggaccgcgaccuguucaccgcccacauggacauccgggggcucacgcagggcgacaccgccaccuacuucugcgcccgccagaaguucuacgccgggggccaggggugguacuucgaccuguggggccggggcacccugaucgugguguccagc

SEQ ID NO: 10947 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgggaacaucuucgagcggaccgagcugauccacugggugcgccaggcgcccggccaggggcuggaguggaucggcugggucaaggccguguccggcgccgugaacuacgggagccucgacuuccggcaccgcgucucccugacgcgggaccgcgaccugagcaccgcccacauggacauccggggccucacccaggacgacaccgccacguacuucugcgcgcgccagaaguucgcccgcggggaccagggcugguucuucgaccugugggggcggggcacccugaucgugguguccagc

SEQ ID NO: 10948 - RNA, 378 nt, Artificial Sequence
  derived and/or modified sequence opt1 from anti-HIV-1_HeavyChain
cgcugcagcauggagcagcccggcugguccgagaagccgggggccagcgugacccuguccugcaagaccgccgacgaggacgucuucgacgcggccuacaugcacugggugcggcaggcccccggccagacguucgaguggcucggguggaugaagcccgugaccggcgccgucagcuacgcccgcaaguuccaggggcggguguccuucuacaugacccgcgagcugggcauggcguacauggaccugcggaaccuccgcuucgacgacaccgccguguacuucugcgcccggaagacggccggcgacgucagcggggacaaccgcggcuacuucuucgaccugugggggcggggcucccgcgugaucgugagcucc

SEQ ID NO: 10949 - RNA, 375 nt, Artificial Sequence
  derived and/or modified sequence opt1 from anti-HIV-1_HeavyChain
cgccacaccagcgagcaguccggcagcggggugaagaagcccggcgccuccguccgggugagcugcuggaccuccgaggacaucuucgagcgcagcgagcugauccacugggugcggcaggccccggggcagggccucgaguggaucgggugggucaagacggugaccggcgcggugaacuucggcucccccaacuuccgccaccgggucagccugacccgcgaccgggaccuguucaccgcccacauggacauccgcgggcucacgcagggcgacaccgccaccuacuucugcgcccggcagaaguacuacgccgggggccaggggugguacuucgaccuguggggccgcggcacccugaucgugguguccagc

SEQ ID NO: 10950 - RNA, 375 nt, Artificial Sequence
  derived and/or modified sequence opt1 from anti-HIV-1_HeavyChain
cgccacaccguggagcagagcggcgccggggucaagaagcccggcgccuccgugcgggugagcugcuggaccuccgaggacaucuucgagcgcacggagcugauccacuggguccggcaggcgccggggcagggccucgaguggaucgggugggugaagaccgugagcggcgccgucaacuucggcucccccaacuuccgccaccgggugagccugacccgcgaccgggaccuguucaccgcccacauggacauccgcgggcucacgcagggcgacaccgccaccuacuucugcgcccggcagaaguucgagcgcgggggccaggggugguacuucgaccuguggggccggggcacccugaucguggucuccagc

SEQ ID NO: 10951 - RNA, 375 nt, Artificial Sequence
  derived and/or modified sequence opt1 from anti-HIV-1_HeavyChain
ggcacccccuggaacgagagcggguccggcgugaagaagccgggggccagcguccgcguguccugcuggaccagcgaggacaucuucgagaaguccgagcugauccacugggugcggcaggcccccggccaggggcucgaguggaucggcugggucaagacggugaccggcgcggugaacuucgggagccccaacuuccgccaccgggucucccugacccgcgaccgggaccuguucaccgcccacauggacauccgcggccucacgcagggggacaccgccaccuacuucugcgcccggcagaaguucgagcgcggcgggcagggcugguacuucgaccuguggggccgggggacccugaucguggugagcucc

SEQ ID NO: 10952 - RNA, 375 nt, Artificial Sequence
  derived and/or modified sequence opt1 from anti-HIV-1_HeavyChain
cgccacgaccuggagcccagcggcuccggggugaagaagccgggcgccagcguccggguguccugcuggaccagcgaggacaucuucgagcgcaccgagcucauccacugggugcggcaggcccccgggcagggccuggaguggaucgggugggucaagacggugaccggcgcggugaacuucggcucccuggacuuccgccaccggaucagccucacccgcgaccgggaccuguucaccgcccacauggacauccgcgggcugacgcagggcgacaccgccaccuacuucugcgcccggcagaaguucgagucccgcuacaccgggggccaggggugguacuucgaccucuggggccggggcacgcacaucguc

SEQ ID NO: 10953 - RNA, 375 nt, Artificial Sequence
  derived and/or modified sequence opt1 from anti-HIV-1_HeavyChain
cgccacaccguggagcagagcggcuccggggucaagaagcugggcgccagcgugcggguguccugccucgccagcgaggacaucuucgagcgcaccgagcugauccacuggguccggcaggcgcccgggcagggccuggaguggaucgggugggugaaggccguguccggcgccgucaacuacggcagccucgacuuccgccaccgggugucccugacgcgcgaccgggaccugagcaccgcccacauggacauccgcgggcucacccaggacgacaccgccacguacuucugcgcgcggcagaaguucgcccgcggcgaccaggggugguucuucgaccuguggggccgggggacccugaucguggucuccagc

SEQ ID NO: 10954 - RNA, 375 nt, Artificial Sequence
  derived and/or modified sequence opt1 from anti-HIV-1_HeavyChain
caggcccaccuggagcagagcggcuccgagagcaagaagcccggggccuccgugcgcgucagcugcuggaccuccgaggacaucuucgagaaguccgagcucauccacugggugcggcaggcgccgggccaggggcuggaguggaucggcugggugaagaccgucacgggggccgugaacuucggcagcagcgacuuccgccagcgggugucccugacccgcgaccgggaccucuucaccgcccacauggacauccgcggccugacccagggggacacggccaccuacuucugcgcccggcagaaguucuacgcgggcgggcagggcugguacuucgaccugugggggcgcggcacccucaucgucgugagcucc

SEQ ID NO: 10955 - RNA, 375 nt, Artificial Sequence
  derived and/or modified sequence opt1 from anti-HIV-1_HeavyChain
ggcacccccgggagcgaguccgccagcggcgugcgccggccgggggccuccguccgcgugagcugcuggaccuccgaggacaucuucgagcggagcgagcugaucuacugggugcgccaggcgcccggccgggggcucgaguggaucggcuggaucaagcuggucuccggcgccgugaacuucgggagcguggacuuccgcgaccgggucucccugacgcgcgaccgggaccucuucaccgcccacauggacauccgcggccugacccagggggacaccgccacguacuucugcgcccggcagaaguucgagcgcggcgggcagggcugguacuucgaccuguggggccgggggacccucaucguggugagcucc

SEQ ID NO: 10956 - RNA, 375 nt, Artificial Sequence
  derived and/or modified sequence opt1 from anti-HIV-1_HeavyChain
caggugcaccuggagcagagcggcuccggggucaagaagcccggcgccagcgugcgcguguccugcuggaccagcgaggacaucuucgagaaguccgagcucauccaguggguccggcaggccccggggcagggccuggaguggaucgggugggugaagaccgugacgggcgcggucaacuucggcagcuccgacuuccgccagcgggugagccugacccgcgaccgggaccucuucaccgcccacauggacauccgcgggcugacccagggcgacacggccaccuacuucugcgcccggcagaaguucuacgccgggggccaggggugguacuucgaccuguggggccgcggcacccucaucguggucuccagc

SEQ ID NO: 10957 - RNA, 375 nt, Artificial Sequence
  derived and/or modified sequence opt1 from anti-HIV-1_HeavyChain
ggcacccccgggagcgaguccggcagcggggugaagaaggucggcgccuccgugcgcgugagcugcuggaccuccgaggacaucuucgagcggacggagcugauccacuggguccgccaggccccggggcagggccucgaguggaucggcugggugaaggcggugagcggggccgucaacuacggcucccuggacuuccggcaccgcgugagccugacccgggaccgcgaccucuucaccgcccggauggacauccgcgggcugacccaggacgacacggccaucuacuucugcgcccggcagaaguucgcgcgcggcgaccaggggugguucuucgaccuguggggccggggcacccucaucguggucuccagc

SEQ ID NO: 10958 - RNA, 375 nt, Artificial Sequence
  derived and/or modified sequence opt1 from anti-HIV-1_HeavyChain
ggcacccccgggagcgaguccggcagcggggugaagcgcccgggcgccuccguccgggugagcugcuggaccuccgaggacaucuucgagacgaccgagcugauccacugggugcgccaggcccccgggcagggccucgaguggaucggcugggucaagaccgugagcggggcggugaacuucggcucccugaacuuccggcaccgcgucagccugacccgggaccgcgaccucuccacggcccacauggacauccgggggcugacccaggacgacaccgccaccuacuucugcgcccgccagaaguucgcccggggcgaccaggggugguucuucgaccuguggggccgcggcacgcucaucguggugagcucc

SEQ ID NO: 10959 - RNA, 372 nt, Artificial Sequence
  derived and/or modified sequence opt1 from anti-HIV-1_HeavyChain
cgcgcccaccuggagcagagcggcgccggggugaagaagcccggcggguggguccggguguccugcuggaccagcgaggacaucuucaagaccgagcucauccacugggugcgccaggcgccgggccaggggcuggaguggaucggcugggucaagacggugaccggcgccgugaacuucgggucccccaacuuccggcaccgcgucagccugacccgggaccgcgaccucuucaccgcccacauggacauccggggccugacgcagggggacaccgccaccuacuucugcgcccgccagaaguucgagcggggcgggcagggcugguacuucgaccuguggggccgcgggacccucaucgugguguccagc

SEQ ID NO: 10960 - RNA, 378 nt, Artificial Sequence
  derived and/or modified sequence opt1 from anti-HIV-1_HeavyChain
caggugcagcugaugcagagcggcgccgaggucaagcgccccggggccuccgugaagaucagcugcaccgcguccggcuucacccucacggaccacuacaugcacugggugcggcaggccccggggcagaccuucgaguggcugggcuggaugaagcccgucaccggggccgugaacuacgcccgcaaguuccagggccgggugagcuucuaccgcacccgggagcugggcaucgccuacauggaccuccgcaaccugcgguucgacgacacggcggucuacuucugcgcccgcaagaccgccggggacguguccggcgacaagcggggguucuucuucgaccuguggggccgcgggagccgggugaucgucuccagc

SEQ ID NO: 10961 - RNA, 378 nt, Artificial Sequence
  derived and/or modified sequence opt1 from anti-HIV-1_HeavyChain
caggugcagcugguccagagcggcgccgaggugaagaagcccggggccuccgugaaggucagcugcaaggcguccggcuacaacuucaccggguacuaccuccacugggugcgccaggccccgggccagaccuucgaguggcugggguggaugaagcccgugacgggcgccgucagcuacgcccggaaguuccagggccgcguguccuucuacaugacccgggagcuggggauggccuacauggaccuccgcaaccugcgguucgacgacaccgcgguguacuucugcgcccgcaagaccgccggcgacgucagcggggacaaccggggcuacuucuucgaccugugggggcgcggcucccgggugaucgugagcucc

SEQ ID NO: 10962 - RNA, 375 nt, Artificial Sequence
  derived and/or modified sequence opt1 from anti-HIV-1_HeavyChain
ggcacccccgggagcaaguccggcagcggggugaagaagccgggcgccuccguccgcgugagcugcuggaccuccgaggacaucuucgagcggacggagcugauccacugggugcgccaggcccccgggcagggccucgaguggaucggcugggucaagaccgugaccggggcggugaacuucggcagccccaacuuccggcaccgcgucucccugacccgggaccgcgaccuguucacggcccacauggacauccgggggcucacccagggcgacaccgccaccuacuucugcgcccgccagaaguucgagcgcgggggccagggcugguacuucgaccugugggggcggggcacgcugaucguggugagcucc

SEQ ID NO: 10963 - RNA, 378 nt, Artificial Sequence
  derived and/or modified sequence opt1 from anti-HIV-1_HeavyChain
caggugcagcugguccagagcggcgccgagcucaagaagcccggggccuccgugaaggugagcugcgaggcguccggcuacagcuucaccgaccaccacauccacuggguccgccaggccccggggcagggccuggaguggcugggguggaugaaccccaacaacggcgacaccgccuacgcccagacguuccucggccgggugaccaugacccgcgacaccuccaucaacacggccuacauggagcugagccggcugaccuccgacgacaccgcgguguacuucugcgcccgcaagaccgccggggacgucagcggcgacaagcggggguucuucuucgaccucuggggccgcgggucccgggugaucgugagcucc

SEQ ID NO: 10964 - RNA, 378 nt, Artificial Sequence
  derived and/or modified sequence opt1 from anti-HIV-1_HeavyChain
cagguguacaugagcucccgcggcgggaugaagaagcccggcgccagcaugaccgucuccugcaagaccgccgacgaggacaucuucgacgcggccuacaugcacugggugcggcaggccccggggcagacguucgaguggcugggcuggaugaagcccgugaccggggccgucaacuacgcccgccaguuccagggccgggugagcuucuaccgcacccgggagcucggcaucgcguacauggaccugcgcgaccugaaguucgacgacaccgccguguacuucugcgcccggaagacgaagggggacgucuccggcgacgaccgcggguucuucuucgaccucuggggccgggggacccgcgugaucgugagcucc

SEQ ID NO: 10965 - RNA, 378 nt, Artificial Sequence
  derived and/or modified sequence opt1 from anti-HIV-1_HeavyChain
caggugcagcugguccagagcggcgccgaggugaagaagcccggggccuccgugaaggucagcugcaaggcguccggcuacaccuucaccgccuacuacaugcacuggcuccgccaggccccggggcagggccuggaguggaugggguggaucaacccccacagcggcggcacgaacuucgcccagaaguuccaggggcgggugaccaugacccgcgacaccuccaucacgaccgccuacauggagcugagccggcuccgcuccgacgacaccgcgaccuacuucugcgcccggcagaaguucgccagccgcuacuccggcgaccaggggagcuacuucgaccuguggggccgggggacgcugaucguggucuccagc

SEQ ID NO: 10966 - RNA, 375 nt, Artificial Sequence
  derived and/or modified sequence opt1 from anti-HIV-1_HeavyChain
cgcgcccaccuggagcagagcggcgccggggugaagaagcucggcgcguccguccgggugagcugcuggaccuccgaggacaucuucgagcgcaccgagcugauccacugggugcggcaggcccccgggcagggccuggaguggaucgggugggucaaggccgugagcggcgccgugaacuacggcucccucgacuuccgccaccgggucagccugacgcgcgaccgggaccuguucaccgcccacauggacauccgcgggcucacccaggacgacaccgcgacguacuucugcgcccggcagaaguucgcccgcggcgaccaggggugguucuucgaccuguggggccgggggacccugaucgugguguccagc

SEQ ID NO: 10967 - RNA, 378 nt, Artificial Sequence
  derived and/or modified sequence opt1 from anti-HIV-1_HeavyChain
caggugcgccugguccagagcggcgccgacgugaagcagcccggggccuccgugaaggucagcugcaaggcguccggcuacaccuucaccgacuacuacaugcacugggugcggcaggccccggggcagacguucgaguggcucggcuggaugaagcccgugaccggggccgucagcuacgcccgcaaguuccagggccggguguccuucuacaugacccgcgagcugggcauggccuacauggaccugcggaaccuccgcuucgacgacaccgcgguguacuucugcgcccggaagacggccggggacgucagcggcgacaaccgcggguacuucuucgaccuguggggccgggggucccgcgugaucgugagcucc

SEQ ID NO: 10968 - RNA, 378 nt, Artificial Sequence
  derived and/or modified sequence opt1 from anti-HIV-1_HeavyChain
caggcccaccugggcaacaagagcggguccggcgugaagaagcccggggccagcguccgcguguccugcuggaccagcgaggacaucuucgagaaguccgagcucauccacugggugcggcaggcgccgggccaggggcuggaguggaucggcugggucaagaccgugacgggcgccgugaacuucgggagcuccgacuuccgccagcgggucagccugacccgcgaccgggaccucuucaccgcccacauggacauccgcggccugacccagggggacacggccaccuacuucugcgcccggcagaaguucuacgcgggcgggcagggcugguacuucgaccuguggggccgcgggacccucaucgugguguccagc

SEQ ID NO: 10969 - RNA, 381 nt, Artificial Sequence
  derived and/or modified sequence opt1 from anti-HIV-1_HeavyChain
cagguguacauggagcagagcggcgggggcgucaagaagcccggggccuccgugacccugagcugcaagaccgccgacgaggacguguucgacgcggccuacaugcacuggguccgccaggccccgggccagacguucgaguggcucggguggaugaagcccgugaccggcgccgugaacuacgcccggaaguuccagggccgcgucuccuucuaccggacccgcgagcuggggaucgcguacauggaccugcggaaccuccgcuucgacgacaccgccguguacuucugcacgcggaagaccgccggcgacgugagcggggacaagcgcggcuucuucuucgaccugugggggcggggcucccgcgucaucgugagcucc

SEQ ID NO: 10970 - RNA, 381 nt, Artificial Sequence
  derived and/or modified sequence opt1 from anti-HIV-1_HeavyChain
cagguguacgucgagcagcccggcgggggcgugaagaagccgggggccagcgugacccuguccugcaagaccgccgacgaggacgucuucgacgcgacguacaugcacugggugcgccaggcccccggccagaccuucgaguggcucggguggaugaagcccgugaccggcgccgucaacuacgcccggaaguuccagggccgcgugagcuucuaccggacccgcgagcuggggaucgccuacauggaccugcggaaccuccgcuucgacgacacggcgguguacuucugcgcccggaagaccgccggcgacgucuccggggacaagcgcggcuucuucuucgaccugugggggcggggcagccgcgugaucguguccagc

SEQ ID NO: 10971 - RNA, 381 nt, Artificial Sequence
  derived and/or modified sequence opt1 from anti-HIV-1_HeavyChain
cagguguacauggagcaggccggcgucgagguggagaagcccggggccagcgugacccuguccugcaagaccgcggacgaggacgucuucgacgccgccuacaugcacugggugcgccaggccccgggccagacguucgaguggcucggguggaugaagcccgugaccggcgccgucagcuacgcgcggaaguuccaggggcgcguguccuucuacaugacccgggagcugggcauggccuacauggaccugcgcaaccuccgguucgacgacaccgccguguacuucugcgcccgcaagacggcgggcgacgucagcggggacaaccggggcuacuucuucgaccugugggggcgcggcucccgggugaucgugagcucc

SEQ ID NO: 10972 - RNA, 381 nt, Artificial Sequence
  derived and/or modified sequence opt1 from anti-HIV-1_HeavyChain
cagguguacauggagcaggccggcgccggggucaagaagcccggcgcgagcgugacccuguccugcaagaccgccgacgaggacguguucgacgccgccuacaugcacuggguccgccaggccccggggcagacguucgaguggcucggcuggaugaagcccgugaccggggcggugagcuacgcccggaaguuccagggccgcgucuccuucuacaugacccgggagcugggcauggccuacauggaccugcgcaaccuccgguucgacgacaccgccguguacuucugcgcgcgcaagacggccggggacgugagcggcgacaaccggggguacuucuucgaccuguggggccgcgggucccgggucaucgugagcucc

SEQ ID NO: 10973 - RNA, 381 nt, Artificial Sequence
  derived and/or modified sequence opt1 from anti-HIV-1_HeavyChain
caggugcacauggagcaggccggcgccggggucaagaagcccggcgcgagcgugacccuguccugcaagaccgccgacgaggacguguucgacgccgccuacaugcacuggguccgccaggccccggggcagacguucgaguggcucggcuggaugaagcccgugaccggggcggugaacuacgcccggaaguuccagggccgcgucagcuucuaccggacccgcgagcugggcaucgccuacauggaccugcggaaccuccgcuucgacgacaccgccguguacuucugcgcgcggaagacggccggggacguguccggcgacaagcgcggguucuucuucgaccuguggggccgggggagccgcgucaucguguccagc

SEQ ID NO: 10974 - RNA, 381 nt, Artificial Sequence
  derived and/or modified sequence opt1 from anti-HIV-1_HeavyChain
cagguguacauggagcaggccggcgccgaggucaagaagcccggggcgagcgugacccuguccugcgagaccgccgacgaggacguguucgacgccgccuacaugcacuggguccgccaggccccgggccagacguucgaguggcucggguggaugaagcccgugaccggcgcggugaacuacgcccggaaguuccaggggcgcgucagcuucuaccggacccgcgagcugggcaucgccuacauggaccugcggaaccuccgcuucgacgacaccgccguguacuucugcgcgcggaagacggccggcgacguguccggggacaagcgcggcuucuucuucgaccugugggggcggggcagccgcgucaucguguccagc

SEQ ID NO: 10975 - RNA, 381 nt, Artificial Sequence
  derived and/or modified sequence opt1 from anti-HIV-1_HeavyChain
cagguguacauggagcagcccggcgggggcgucaagaagccgggggccagcgugacccuguccugcaagaccgccgacgaggacguguucgacgcggccuacaugcacuggguccgccaggcccccggccagacguucgaguggcucggguggaugaagcccgugaccggcgccgugaacuacgcccggaaguuccagggccgcgucagcuucuaccggacccgcgagcuggggaucgcguacauggaccugcggaaccuccgcuucgacgacaccgccguguacuucugcgcccggaagacggccggcgacguguccggggacaagcgcggcuucuucuucgaccugugggggcggggcagccgcgucaucguguccagc

SEQ ID NO: 10976 - RNA, 372 nt, Artificial Sequence
  derived and/or modified sequence opt1 from anti-HIV-1_HeavyChain
gccacccccuggaacaagagcggcuccggggugaagaagccgggcgccagcguccgcguguccugcuggaccagcgaggacaucuucgagcggacggagcugucccucgugcgccaggcgcccgggcagggccuggaguggaucggguggaugaagaccgucaccggcgccgugaacuucggcagccccaacuuccggcacggggugucccugacccgcgaccgggaccucuucacggcccacauggacauccgcggccugacccagggggacaccgccaccuacuucugcgcccggcagaaguucgagcgcggcgggcagggcugguacuucgaccuguggggccgggggacgcucaucgucgugagcucc

SEQ ID NO: 10977 - RNA, 381 nt, Artificial Sequence
  derived and/or modified sequence opt1 from anti-HIV-1_HeavyChain
cagguguacauggagcaggccggcgccgggaugaagaagcccggcgcgagcaugaccgccuccugcaagaccgccgacgaggacaucuucgacgccgccuacaugcacuggguccgccaggcgccggggcagacguucgaguggcugggcuggaugaagcccgugaccggggccgugaacuacgcccggcaguuccagggccgcgucagcuucuaccggacccgcgagcucggcaucgccuacauggaccugcgggaccugaaguucgacgacaccgcgguguacuucugcgcccgcaagacgaagggggacguguccggcgacgaccggggguucuucuucgaccucuggggccgcgggacccgggucaucgugagcucc

SEQ ID NO: 10978 - RNA, 378 nt, Artificial Sequence
  derived and/or modified sequence opt1 from anti-HIV-1_HeavyChain
caggugcagcugguccagagcggcgccgaggugaagaagcccggggccuccgugaaggucagcugcaaggcguccggcuacaccuucaccggguacuacaugcacugggugcgccaggccccgggccagacguucgaguggcucggguggaugaagcccgugaccggcgccgucaacuacgcccggcaguuccagggccgcgugagcuucuaccggacccgcgagcuggggaucgccuacauggaccugcgggaccucaaguucgacgacaccgcgguguacuucugcgcccgcaagacgaaggccgacgucuccggcgacgaccggggguucuucuucgaccuguggggccgcgggacccgggugaucgugagcucc

SEQ ID NO: 10979 - RNA, 381 nt, Artificial Sequence
  derived and/or modified sequence opt1 from anti-HIV-1_HeavyChain
cgcguguacauggagcaggccggcgccggggucaagaagcccggcgcgagcgugacccuguccugcaagaccgccgacgaggacguguucgacgccgccuacaugcacuggguccggcaggccccggggcagacguucgaguggcucggcuggaugaagcccgugaccggggcggugagcuacgcccgcaaguuccagggccgggucuccuucaccaugacccgcgagcugggcauggccuacauggaccugcggaaccuccgcuucgacgacacggccguguacuucugcgcgcggaagaccgccggggacgugagcggcgacaaccgcggguacuucuucgaccuguggggccgggggucccgcgucaucgugagcucc

SEQ ID NO: 10980 - RNA, 381 nt, Artificial Sequence
  derived and/or modified sequence opt1 from anti-HIV-1_HeavyChain
cagguguacauggagcagagcggcgggggcgucaagaagcccgggccguccgugacccugagcugcaagaccgccgacgaggacguguucgacgccgcguacaugcacuggguccgccaggcccccggccagacguucgaguggcucggguggaugaagcccgugaccggcgccgugaacuacgcccggaaguuccagggccgcgucuccuucuaccggacccgcgagcuggggaucgccuacauggaccugcggaaccuccgcuucgacgacaccgcgguguacuucugcgcccggaagacggccggcgacgugagcggggacaagcgcggcuucuucuucgaccugugggggcggggcucccgcgucaucgugagcucc

SEQ ID NO: 10981 - RNA, 378 nt, Artificial Sequence
  derived and/or modified sequence opt1 from anti-HIV-1_HeavyChain
caggugcagcugguccagagcggcgccgaggugaagaagcccggggccuccgugaaggucagcugcaaggcguccggcuacaccuucaccggguacuacauccacuggaugcgccaggccccgggccaggggcucgaguggaugggcuggaucaaccccaacagcggcgccguguccuacgcccggaaguuccaggggcgcgugagcuuccugcacgaccagggcauccggauggccuacauggaccugcgcaaccuccgguucgacgacacggcggucuacuucugcgcccgcaagaccgccggggacguguccggcgacaaccggggguacuucuucgaccuguggggccgcggcagccgggugaucgucuccagc

SEQ ID NO: 10982 - RNA, 381 nt, Artificial Sequence
  derived and/or modified sequence opt1 from anti-HIV-1_HeavyChain
caggugcacauggagcaggccggcgucgagguggagaagcccggggccagcgugacccuguccugcaagaccgcggacgaggacgucuucgacgccgccuacaugcacugggugcgccaggccccgggccagacguucgaguggcucggguggaugaagcccgugaccggcgccgucaacuacgcgcggaaguuccaggggcgcgugagcuucuaccggacccgcgagcugggcaucgccuacauggaccugcggaaccuccgcuucgacgacaccgccguguacuucugcgcccggaagacggcgggcgacgucuccggggacaagcgcggcuucuucuucgaccugugggggcggggcagccgcgugaucguguccagc

SEQ ID NO: 10983 - RNA, 381 nt, Artificial Sequence
  derived and/or modified sequence opt1 from anti-HIV-1_HeavyChain
cagguguacauggagcaggccggcgccggggucaagaagcccggcgcgagcgccacccuguccugcaagaccgccgacgaggacguguucgacgccgccuacaugcacugggugcgccaggcgccggggcagacguucgaguggcucggcuggaugaagcccgucaccggggccgugagcuacgcccggaaguuccagggccgcguguccuucuacaugacccgggagcugggcauggccuacauggaccugcgcaaccuccgguucgacgacaccgcggucuacuucugcgcccgcaagacggccggggacgugagcggcgacaaccggggguacuucuucgaccuguggggccgcgggucccgggugaucgucagcucc

SEQ ID NO: 10984 - RNA, 375 nt, Artificial Sequence
  derived and/or modified sequence opt1 from anti-HIV-1_HeavyChain
ggccacgaccuggagcagagcggguccggcgugaagaagcccggggccagcguccgcguguccugcuggaccagcgaggacaucuucgagaaguccgagcucauccacugggugcggcaggccccgggccaggggcuggaguggaucggcugggucaaggcggugagcggcgccgugaacuacgggucccuggacuuccgccaccgggucagccucacccgcgaccgggaccuguucacggcccacauggacauccgcggccugacccaggacgacaccgccaucuacuucugcgcccggcagaaguucgcgcgcggggaccagggcugguucuucgaccucugggggcggggcacccugaucgugguguccagc

SEQ ID NO: 10985 - RNA, 378 nt, Artificial Sequence
  derived and/or modified sequence opt1 from anti-HIV-1_HeavyChain
caggcccaccgcggcaccaucugggggcuggaggugaagaagcccggcggguggguccgggugagcugcuggaccuccgaggacaucuucgagcgcacggagcucauccacugggugcggcaggccccgggccaggggcuggaguggaucggcugggucaagaccgugaccggcgcggugaacuucgggagccccaacuuccgccaccgggucucccugacccgcgaccgggaccucuucacggcccacauggacauccgcggccugacccagggggacaccgccaccuacuucugcgcccggcagaaguucgagcgcggcgggcagggcugguacuucgaccuguggggccgggggacgcucaucguggugagcucc

SEQ ID NO: 10986 - RNA, 381 nt, Artificial Sequence
  derived and/or modified sequence opt1 from anti-HIV-1_HeavyChain
caggugcacauggagcaggccggcgccggggucgagaagcccggcgcgagcgugacccuguccugcaagaccgccgacgaggacguguucgacgccgccuacaugcacuggguccgccaggccccggggcagacguucgaguggcucggcuggaugaagcccgugaccggggcggugagcuacgcccggaaguuccagggccgcgucuccuucuacaugacccgggagcugggcauggccuacauggaccugcgcaaccuccgguucgacgacaccgccguguacuucugcgcgcgcaagacggccggggacgugagcggcgacaaccggggguacuucuucgaccuguggggccgcgggucccgggucaucgugagcucc

SEQ ID NO: 10987 - RNA, 381 nt, Artificial Sequence
  derived and/or modified sequence opt1 from anti-HIV-1_HeavyChain
cagguguacauggagcagagcggcgggggcgucaagaagcccggggccuccgugacccugagcugcaagaccgccgacgaggacguguucgacgcggccuacaugcacuggguccgccaggccccgggccagacguucgaguggcucggguggaugaagcccgugaccggcgccguguccuacgcccggaaguuccagggccgcgucagcuucuacaugacccgggagcuggggauggcguacauggaccugcgcaaccuccgguucgacgacaccgccguguacuucugcgcccgcaagacggccggcgacguguccggggacaaccggggcuacuucuucgaccugugggggcgcggcagccgggucaucguguccagc

SEQ ID NO: 10988 - RNA, 381 nt, Artificial Sequence
  derived and/or modified sequence opt1 from anti-HIV-1_HeavyChain
cagguguacauggagcagagcggcgggggcgucaagaagcccggggccuccgugacccugagcugcaagaccgccgacgaggacguguucgacgcggccuacaugcacuggguccgccaggccccgggccagacguucgaguggcucggguggaugaagcccgugaccggcgccgugaacuacgcccggaaguuccagggccgcgucuccuucuaccggacccgcgagcuggggaucgcguacauggaccugcggaaccuccgcuucgacgacaccgccguguacuucugcgcccggaagacggccggcgacgugagcggggacaagcgcggcuucuucuucgaccugugggggcggggcucccgcgucaucgugagcucc

SEQ ID NO: 10989 - RNA, 381 nt, Artificial Sequence
  derived and/or modified sequence opt1 from anti-HIV-1_HeavyChain
gagguguacauggagcagagcggcgggggcgucaagaagcccggggccuccgugacccugagcugcaagaccgccuccgaggacguguucgacgcggccuacaugcacuggguccgccaggccccgggccagacguucgaguggcucggguggaugaagcccgugaccggcgccgugaacuacgcccggaaguuccagggccgcgucagcuucuaccggacccgcgagcuggggaucgcguacauggaccugcggaaccuccgcuucgacgacaccgccguguacuucugcgcccggaagacggccggcgacguguccggggacaagcgcggcuucuucuucgaccugugggggcggggcagccgcgucaucguguccagc

SEQ ID NO: 10990 - RNA, 381 nt, Artificial Sequence
  derived and/or modified sequence opt1 from anti-HIV-1_HeavyChain
caggugcagcugguccagagcggcgccgaggugaagaagcccggggccuccgugacccucagcugcaagaccgcggacgaggacgucuucgacgccgccuacaugcacugggugcgccaggccccgggccagacguucgaguggcugggguggaugaagcccgugaccggcgccgucuccuacgcgcggaaguuccaggggcgcgugagcuucuacaugacccgggagcugggcauggccuacauggaccuccgcaaccugcgguucgacgacaccgccguguacuucugcgcccgcaagacggcgggcgacgucuccggggacaaccggggcuacuucuucgaccugugggggcgcggcagccgggugaucguguccagc

SEQ ID NO: 10991 - RNA, 381 nt, Artificial Sequence
  derived and/or modified sequence opt1 from anti-HIV-1_HeavyChain
cagguguucauggagcagagcggcgggggcaugaagaagcccggggccuccaugaccgucagcugcaagaccgccgacgaggacguguucgacgcggccuacaugcacugggugcgccaggccccgggccagacguucgaguggcugggguggaugaagcccgucaccggcgccguguccuacgcccggaaguuccagggccgcgugagcuucuacaugacccgggagcucgggauggcguacauggaccugcgcaaccugcgguucgacgacaccgccgucuacuucugcgcccgcaagacggccggcgacguguccggggacaaccggggcuacuucuucgaccucugggggcgcggcagccgggugaucgucuccagc

SEQ ID NO: 10992 - RNA, 381 nt, Artificial Sequence
  derived and/or modified sequence opt1 from anti-HIV-1_HeavyChain
cagguguacauggagcaggccggcgggggcaugaagaagcccggggccagcaugaccgucuccugcaagaccgcggacgaggacaucuucgacgccgccuacaugcacugggugcgccaggccccgggccagacguucgaguggcugggguggaugaagcccgugaccggcgccgucaacuacgcgcggcgcuuccagggccgggugagcuucuaccgcacccgggagcucgggaucgccuacauggaccugcgcgaccugaaguucgacgacaccgccguguacuucugcgcccggaagacgaagggcgacgucuccggggacgaccgcggcuucuucuucgaccucugggggcggggcacccgcgugaucgugagcucc

SEQ ID NO: 10993 - RNA, 381 nt, Artificial Sequence
  derived and/or modified sequence opt1 from anti-HIV-1_HeavyChain
cagguguacauggagcaggccggcgccggggucaagaagcccggcgcgagcgugacccuguccugcaaggccgccgacgaggacguguucgacgccgccuacaugcacuggguccgccaggcgccggggcagaccuucgaguggcucggcuggaugaagcccgugacgggggccgugagcuacgcccggaaguuccagggccgcgucuccuucuacaugacccgggagcugggcauggccuacauggaccugcgcaaccuccgguucgacgacaccgcgguguacuucugcgcccgcaagaccgccggggacgugagcggcgacaaccggggguacuucuucgaccuguggggccgcgggucccgggucaucgugagcucc

SEQ ID NO: 10994 - RNA, 381 nt, Artificial Sequence
  derived and/or modified sequence opt1 from anti-HIV-1_HeavyChain
cagguguucauggagcaggccggcgccgggaugaagaagcccggcgcgagcaugaccgucuccugcaagaccgccgacgaggacaucuucgacgccgccuacaugcacugggugcgccaggccccggggcagacguucgaguggcugggcuggaugaagcccgugaccggggcggucaacuacgcccggcaguuccagggccgcgugagcuucuaccggacccgcgagcucggcaucgccuacauggaccugcgggaccugaaguucgacgacaccgccguguacuucugcgcgcgcaagacgaagggggacgucuccggcgacgaccggggguucuucuucgaccucuggggccgcgggacccgggugaucgugagcucc

SEQ ID NO: 10995 - RNA, 381 nt, Artificial Sequence
  derived and/or modified sequence opt1 from anti-HIV-1_HeavyChain
cagguguacauggagcagcccggcggggaggucaagaagccgggcgccagcgugacccuguccugcaagaccgccgacgaggacguguucgacgcggccuacaugcacuggguccgccaggcccccgggcagacguucgaguggcucggcuggaugaagcccgugaccggggccgugaacuacgcccggaaguuccagggccgcgucagcuucuacaugacccgggagcugggcauggcguacauggaccugcgcaaccuccgguucgacgacaccgccguguacuucugcgcccgcaagacggccggggacguguccggcgacaaccggggguacuucuucgaccuguggggccgcgggagccgggucaucguguccagc

SEQ ID NO: 10996 - RNA, 381 nt, Artificial Sequence
  derived and/or modified sequence opt1 from anti-HIV-1_HeavyChain
caggugcacauggagcaggccggcgccggggucaagaagcccggcgcgagcgugacccuguccugcaagaccgccgacgaggacguguucgacgccgccuacaugcacuggguccgccaggccccggggcagacguucgaguggcucggcuggaugaagcccgugaccggggcggugagcuacgcccggaaguuccagggccgcgucuccuucuacaugacccgggagcugggcauggccuacauggaccugcgcaaccuccgguucgacgacaccgccguguacuucugcgcgcgcaagacggccggggacgugagcggcgacaaccggggguacuucuucgaccuguggggccgcgggucccgggucaucgugagcucc

SEQ ID NO: 10997 - RNA, 381 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugaacuacgcgcggaaguuccagggccgcgucagcuucuaccggacccgcgagcuggggaucgccuacauggaccugcggaaccuccgcuucgacgacaccgccguguacuucugcgcccggaagacggcgggcgacguguccggggacaagcgcggcuucuucuucgaccugugggggcggggcccccgcgucaucgugagcucc

SEQ ID NO: 10998 - RNA, 381 nt, Artificial Sequence
  derived and/or modified sequence opt1 from anti-HIV-1_HeavyChain
caggugcagcugguccagagcggcgccgaggugaagaagcccggggccuccgugaaggucagcugcaaggcguccggccacaccuucaccaacuacgacaucaacugggugcgccaggccccggggcagggccucgaguggaucgggugggugaagaucgucagcggcacggugaacuucgccucccuggacuuccggaaccgcaucagccugucccgggaccgcgaccucagcaccgccuacauggacauccggggccugacccaggacgacaccgccacguacuucugcgcgcgccagaaguucgccucccgguacagcggggaccagggcuccuacuucgaccugugggggcgcggcacccucaucguggucagcucc

SEQ ID NO: 10999 - RNA, 381 nt, Artificial Sequence
  derived and/or modified sequence opt1 from anti-HIV-1_HeavyChain
cagguguacauggagcaggccggcgggggcaugaagaagcccggggccagcaugaccgucuccugcaagaccgcggacgaggacaucuucgacgccgccuacaugcacugggugcgccaggccccgggccagacguucgaguggcugggguggaugaagcccgugaccggcgccgucaacuacgcgcggcaguuccagggccgcgugagcuucuaccggacccgcgagcucgggaucgccuacaccgaccugcgggaccugaaguucgacgacacggccguguacuucugcgcccgcaagaccaagggcgacgucuccggggacgaccggggcuucuucuucgaccucugggggcgcggcacccgggugaucgugagcucc

SEQ ID NO: 11000 - RNA, 381 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugaacuacgcgcggcaguuccagggccgcgucagcuucuaccggacccgcgagcuggggaucgccuacauggaccugcgggaccucaaguucgacgacaccgccguguacuucugcgcccgcaagacgaagggcgacguguccggggacgaccggggcuucuucuucgaccugugggggcgcggcacccgggucaucgugagcucc

SEQ ID NO: 11001 - RNA, 381 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcccggguggaugaagcccgugaccggcgccgugaacuacgcgcggaaguuccagggccgcgucagcuucuaccggacccgcgagcucgggaucgccuacauggaccugcggaaccugcgcuucgacgacaccgccguguacuucugcgcccggaagacggcgggcgacguguccggggacaagcgcggcuucuucuucgaccucugggggcggggcagccgcgucaucguguccagc

SEQ ID NO: 11002 - RNA, 381 nt, Artificial Sequence
  derived and/or modified sequence opt1 from anti-HIV-1_HeavyChain
cagguguacauggagcaggccggcgggggcgucaagaagcccggggccagcgcgacccuguccugcaagaccgccgacgaggacguguucgacgccgccuacaugcacugggugcgccaggccccgggccagacguucgaguggcucggguggaugaagcccgucaccggcgcggugagcuacgcccggaaguuccagggccgcguguccuucuacaugacccgggagcuggggauggccuacauggaccugcgcaaccuccgguucgacgacaccgccgucuacuucugcgcgcgcaagacggccggcgacgugagcggggacaaccggggcuacuucuucgaccugugggggcgcggcucccgggugaucgucagcucc

SEQ ID NO: 11003 - RNA, 381 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcgcuggguccggcaggccccgggccagacguucgaguggcucggguggaugaagcccgugaccggcgccgugaacuacgcgcgcaaguuccagggccgggucagcuucuaccgcacccgggagcuggggaucgccuacauggaccugcgcaaccuccgguucgacgacaccgccguguacuucugcgcccgcaagacggcgggcgacguguccggggacaagcggggcuucuucuucgaccugugggggcgcggcagccgggucaucguguccagc

SEQ ID NO: 11004 - RNA, 381 nt, Artificial Sequence
  derived and/or modified sequence opt1 from anti-HIV-1_HeavyChain
caggugcagcugguccagagcggcgccgaggugaagaagcccggggccuccgugaaggucagcugccgcgcguccggcuacaccuucgggaaccacgccaucagcugggugcggcaggccccgggccaggggcucgaguggaugggcuggauccgccccaagaccggcgcccggaaccaggcccgccaguuccagccccggaucucccugacgcgcgaccgggcgcugagcaccgccuaccucgaccugaacucccugaccagcgccgacuccgggaccuacuucugcgcccgccagacguucaagcccgacuucuacuucgcggaccagggcuggagcuucaaccucugggggcggggcgcccacuucaucguguccagc

SEQ ID NO: 11005 - RNA, 381 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugagcuacgcgcggaaguuccagggccgcgucuccuucuacaugacccgggagcuggggauggccuacauggaccugcgcaaccuccgguucgacgacaccgccguguacuucugcgcccgcaagacggcgggcgacgugagcggggacaaccggggcuacuucuucgaccugugggggcccggcucccgcgucaucgugagcucc

SEQ ID NO: 11006 - RNA, 381 nt, Artificial Sequence
  derived and/or modified sequence opt1 from anti-HIV-1_HeavyChain
cagguguacauggagcaggccggcgccggggucaagaagcccggcgcgagcgugacccuguccugcaagaccgccgacgaggacguguucgacgccgccuacaugcacuggguccgccaggccccggggcagacguucgaguggcucggcuggaugaagcccgugaccggggcggugaacuacgcccggaaguuccagggccgcgucagcuucuaccggacccgcgagcugggcaucgccuacauggaccugcggaaccuccgcuucgacgacaccgccguguacuucugcgcgcggaagacggccggggacguguccggcgacaagcgcggguucuucuucgaccuguggggccgggggagccgcgucaucguguccagc

SEQ ID NO: 11007 - RNA, 381 nt, Artificial Sequence
  derived and/or modified sequence opt1 from anti-HIV-1_HeavyChain
caggugcacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugaacuacgcgcggaaguuccagggccgcgucagcuucuaccggacccgcgagcuggggaucgccuacauggaccugcggaaccuccgcuucgacgacaccgccguguacuucugcgcccggaagacggcgggcgacguguccggggacaagcgcggcuucuucuucgaccugugggggcggggcagccgcgucaucguguccagc

SEQ ID NO: 11008 - RNA, 381 nt, Artificial Sequence
  derived and/or modified sequence opt1 from anti-HIV-1_HeavyChain
cagguguacauggagcaggccggcgacgggaugaagaagcccggcgccagcaugaccgucuccugcaagaccgcggacgaggacaucuucgacgccgccuacaugcacugggugcgccaggccccggggcagacguucgaguggcugggcuggaugaagcccgugaccggggccgucaacuacgcgcggcaguuccagggccgcgugagcuucuaccggacccgcgagcucggcaucgccuacauggaccugcgggaccugaaguucgacgacaccgccguguacuucugcgcccgcaagacgaagggggacgucuccggcgacgaccggggguucuucuucgaccucuggggccgcgggacccgggugaucgugagcucc

SEQ ID NO: 11009 - RNA, 381 nt, Artificial Sequence
  derived and/or modified sequence opt1 from anti-HIV-1_HeavyChain
caggugcagcugguccagagcggcgccgaggugaagaagcccggggccuccgugacccucagcugcaagaccgcggacgaggacgucuucgacgccgccuacaugcacugggugcgccaggcccagggccagacguucgaguggcugggguggaugaagccggugaccggcgccgucaacuacgcgcggaaguuccaggggcgcguguccuucuaccggacccgcgagcugggcaucgccuacauggaccuccggaaccugcgcuucgacgacaccgccguguacuucugcgcccggaagacggcgggcgacgucagcggggacaagcgcggcuucuucuucgaccugugggggcggggcucccgcgugaucgugagcucc

SEQ ID NO: 11010 - RNA, 381 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugaacuacgcgcggaaguuccagggccgcgucagcuucuaccggacccgcgagcuggggaucgccuacauggaccugcggaaccuccgcuucgacgacaccgccguguacuucugcgcccggaagacggcgggcgacguguccggggacaagcgcggcuucuucuucgaccugugggggcggggcagccaggucaucguguccagc

SEQ ID NO: 11011 - RNA, 381 nt, Artificial Sequence
  derived and/or modified sequence opt1 from anti-HIV-1_HeavyChain
caggugcagcugguccagagcggcgccgaggugcgcaagcccggggccuccgugaaggucagcugcaaggcguccggcuacaccuucaccaacuacuacaugcacugggugcggcaggccccggggcagggccucgaguggaucgggugggugaagaucgucagcggcacggugaacuucgccucccuggacuuccgcaaccggaucagccugucccgcgaccgggaccucagcaccgccuacauggacauccgcggccugacccaggacgacaccgccacguacuucugcgcgcggcagaaguucgccucccgcuacagcggggaccagggcuccuacuucgaccugugggggcggggcacccucaucguggucagcucc

SEQ ID NO: 11012 - RNA, 381 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcaccgugaacuacgcccggaaguuccagggccgcgucuccuucuaccggacccgcgagcuggggaucgccuacauggaccuccggaaccugcgcuucgacgacacggccguguacuucugcgcccggaagaccgcgggcgacgugagcggggacaagcgcggcuucuucuucgaccugugggggcggggcucccgcgucaucgugagcucc

SEQ ID NO: 11013 - RNA, 381 nt, Artificial Sequence
  derived and/or modified sequence opt1 from anti-HIV-1_HeavyChain
cugauccaccucgcccagagcggcgccgaggugaagaagcccggggcguccgucacccugagcugcaagaccgccgacgaggacguguucgacgccgccuacaugcacugggugcgccaggccccgggccagacguucgaguggcugggguggaugaagcccgucaccggcgcgguguccuacgcccggaaguuccaggggcgcgugagcuucuacaugacccgggagcucggcauggccuacauggaccugcgcaaccugcgguucgacgacaccgccgucuacuucugcgcgcgcaagacggccggcgacguguccggggacaaccggggcuacuucuucgaccucugggggcgcggcagccgggugaucgucuccagc

SEQ ID NO: 11014 - RNA, 381 nt, Artificial Sequence
  derived and/or modified sequence opt1 from anti-HIV-1_HeavyChain
caggugcagcugguccagagcggcgccgaggugaagaagcccggggccuccaugaccgugagcugcaagaccgcggacgaggacaucuucgacgccgccuacaugcacuggguccgccaggccccgggccagacguucgaguggcucggguggaugaagcccgugaccggcgccgugaacuacgcgcggcaguuccaggggcgcgucuccuucuaccggacccgcgagcugggcaucgccuacauggaccugcgggaccucaaguucgacgacaccgccguguacuucugcgcccgcaagacgaagggcgacgugagcggggacgaccggggcuucuucuucgaccugugggggcgcggcacccgggucaucguguccagc

SEQ ID NO: 11015 - RNA, 381 nt, Artificial Sequence
  derived and/or modified sequence opt1 from anti-HIV-1_HeavyChain
cagguguacauggagcagggccgcgggggcgucaagaagcccggggccagcgugacccuguccugcaagaccgccgacgaggacguguucgacgcggccuacaugcacuggguccggcaggccccgggccagacguucgaguggcucggguggaugaagcccgugaccggcgccgugaacuacgcccgcaaguuccagggccgggucagcuucuaccgcacccgggagcuggggaucgcguacauggaccugcgcaaccuccgguucgacgacaccgccguguacuucugcgcccgcaagacggccggcgacguguccggggacaagcggggcuucuucuucgaccugugggggcgcggcagccgggucaucguguccagc

SEQ ID NO: 11016 - RNA, 381 nt, Artificial Sequence
  derived and/or modified sequence opt1 from anti-HIV-1_HeavyChain
cagguguacauggagcaggccggcgggggcaugaagaagcccggggccagcaugaccgucuccugcaagaccgcggacgaggacguguucgacgccgccuacaugcacugggugcgccaggccccgggccagacguucgaguggcugggguggaugaagcccgucaccggcgccgugaacuacgcgcggcaguuccagggccgcgugagcuucuaccggacccgcgagcucgggaucgccuacauggaccugcgggaccugaaguccgacgacaccgccgucuacuucugcgcccgcaagacggcgggcgacgugagcggggacaagcggggcuucuucuucgaccucugggggcgcggcucccgggugaucgucagcucc

SEQ ID NO: 11017 - RNA, 381 nt, Artificial Sequence
  derived and/or modified sequence opt1 from anti-HIV-1_HeavyChain
caggugcagcugguccagagcggcgccgaggugaagaagcccggguccagcaucaagguguccugcaaggccagcggcgacaccaucucccgcuacgcgaucaacuggguccggcaggccccggggcagggccucgaguggaucgggugggugaagaccgugacgggcgccgucaacuucggcagccuggacuuccgccaccggaucucccugacccgcgaccgggaccucuucaccgcccacauggggauccgcggccugacccagggggacacggccaccuacuucugcgcgcggcagaaguucgagagccgcuacaccggcgggcagggcugguacuucgaccuguggggccgggggacccacaucgugguguccagc

SEQ ID NO: 11018 - RNA, 381 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacaucuucgacgccgccuacaugcacugggugcgccaggccccgggccagacguucgaguggcucggguggaugaagcccgucaccggcgccgugaacuacgcgcggaaguuccagggccgcgugagcuucuaccggacccgcgagcuggggaucgccuacauggaccugcggaaccuccgcuucgacgacaccgccgucuacuucugcgcccggaagacggcgggcgacguguccggggacaagcgcggcuucuucuucgaccugugggggcggggcagccgcgugaucgucuccagc

SEQ ID NO: 11019 - RNA, 381 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugaacuacgcgcggaacuuccagggccgcgucagcuucuaccggacccgcgagcuggggaucgccuacauggaccugcggaaccuccgcuucgacgacaccgccguguacuucugcgcccggcagaaguucgagucccgcuacagcggcgaccagggguccuacuucgaccuguggggccgggggacgcugaucaucgugagcucc

SEQ ID NO: 11020 - RNA, 381 nt, Artificial Sequence
  derived and/or modified sequence opt1 from anti-HIV-1_HeavyChain
cagguguacauggagcaggccggcgggggcgucaagcgccccggggccagcgugacccuguccugcaagaccgcggacgaggacguguucgacgccgccuacaugcacuggguccggcaggccccgggccagacguucgaguggcucggguggaugaagcccgugaccggcgccgugaacuacgcgcgcaaguuccagggccgggucagcuucuaccgcacccgggagcuggggaucgccuacauggaccugcgcaaccuccgguucgacgacaccgccguguacuucugcgcccgcaagacggcgggcgacguguccggggacaagcggggcuucuucuucgaccugugggggcgcggcagccgggucaucguguccagc

SEQ ID NO: 11021 - RNA, 381 nt, Artificial Sequence
  derived and/or modified sequence opt1 from anti-HIV-1_HeavyChain
caggugcagcugguccagagcggcgacgaggugaagaagcccggggccuccgugacccucagcugcaagaccgccgacgaggacgucuucgacgcggccuacaugcacugggugcgccaggccccgggccagacguucgaguggcugggguggaugaagcccgugaccggcgccgucaacuacgcccggaaguuccaggggcgcguguccuucuaccggacccgcgagcugggcaucgcguacauggaccuccggaaccugcgcuucgacgacaccgccguguacuucugcgcccggaagacggccggcgacgucagcggggacaagcgcggcuucuucuucgaccugugggggcggggcucccgcgugaucgugagcucc

SEQ ID NO: 11022 - RNA, 381 nt, Artificial Sequence
  derived and/or modified sequence opt1 from anti-HIV-1_HeavyChain
caggugcagcugguccagagcggcgccggggugaagaagcccggcuccagcgugaaggucuccugcaaggccagcgggggcaccuucuccagcuacgcgaucaacuggcuccgccaggugccggggcagcggcccgaguggaugggcuggauccgccccaagaccggcgcccggaaccaggcccgccaguuccagccccggaucucccugacgcgcgaccgggcccugagcaccgccuaccucgaccugaacucccugaccagcgcggacuccgggaccuacuucugcgcccgccagacguucaagccggacuucuacuucgccgaccagggcuggagcuucaaccucugggggcggggcgcccacuucaucguguccagc

SEQ ID NO: 11023 - RNA, 381 nt, Artificial Sequence
  derived and/or modified sequence opt1 from anti-HIV-1_HeavyChain
cagguguacauggagcgcgccggcgggggcgucaagaagcccggggccagcgugacccuguccugcgagaccgcggacgaggacguguucgacgccgccuacaugcacuggguccggcaggccccgggccagacguucgaguggcucggguggaugaagcccgugaccggcgccgugaacuacgcgcgcaaguuccagggccgggucagcuucuaccgcacccgggagcuggggaucgccuacauggaccugcgcaaccuccgguucgacgacaccgccguguacuucugcgcccgcaagacggcgggcgacguguccggggacaagcggggcuucuucuucgaccugugggggcgcggcagccgggucaucguguccagc

SEQ ID NO: 11024 - RNA, 381 nt, Artificial Sequence
  derived and/or modified sequence opt1 from anti-HIV-1_HeavyChain
cagguguacauggagcaggccggcgccgggaugaagaagcccggcgcgagcaugaccgucuccugcaagaccgccgacgaggacaucuucgacgccgccuacaugcacugggugcgccaggccccggggcagacguucgaguggcugggcuggaugaagcccgugaccggggcggucaacuacgcccggcaguuccagggccgcgugagcuuccuccaggaccagggcauccggaucgccuacauggaccugcgcgaccugaaguucgacgacaccgccguguacuucugcgcgcggaagaccaagggggacgucuccggcgacgaccgcggguucuucuucgaccucuggggccgggggacgcgcgugaucgugagcucc

SEQ ID NO: 11025 - RNA, 381 nt, Artificial Sequence
  derived and/or modified sequence opt1 from anti-HIV-1_HeavyChain
cagguguacaugggcgccgggcgcggcggggucaagaagcccggcgccagcgugacccuguccugcaagaccgcggacgaggacguguucgacgccgccuacaugcacuggguccggcaggccccggggcagacguucgaguggcucggcuggaugaagcccgugaccggcgccgugaacuacgcgcgcaaguuccaggggcgggucagcuucuaccgcacccgggagcugggcaucgccuacauggaccugcgcaaccuccgguucgacgacaccgccguguacuucugcgcccgcaagacggcgggggacguguccggcgacaagcggggguucuucuucgaccuguggggccgcggcagccgggucaucguguccagc

SEQ ID NO: 11026 - RNA, 381 nt, Artificial Sequence
  derived and/or modified sequence opt1 from anti-HIV-1_HeavyChain
cagguguacauggagcaggccggcgccggggucaagaagcccggcgcgagcgugacccuguccugcaagaccgccgacgaggacguguucgacgccgccuacaugcacuggguccgccaggccccggggcagcccuucgaguggcucggcuggaugaagcccgugacgggggcggugagcuacgcccggaaguuccagggccgcgucuccuucuacaugacccgggagcugggcauggccuacauggaccugcgcaaccuccgguucgacgacaccgccguguacuucugcgcgcgcaagaccgccggggacgugagcggcgacaaccggggguacuucuucgaccuguggggccgcgggucccgggucaucgugagcucc

SEQ ID NO: 11027 - RNA, 381 nt, Artificial Sequence
  derived and/or modified sequence opt1 from anti-HIV-1_HeavyChain
caggugcagcugguccagagcggcgccgaggugaagaagcccggggccuccgugaagaucagcugcaaggcguccggcuacaccuucauccgccacgggauccacuggcuccggcaggucccgggccagcgccccgaguggaugggguggauccggcccaagaccggcgcccgcaaccaggcccggcaguuccagccccgcaucagccuggcccgggaccgcgcccuguccacggcguaccucgaccugaacagccugaccuccgccgacagcggcaccuacuucugcgcccggcagaccuucaagccggacuucuacuucgccgaccaggggugguccuucaaccucuggggccgcggggcgcacuucaucgugagcucc

SEQ ID NO: 11028 - RNA, 381 nt, Artificial Sequence
  derived and/or modified sequence opt1 from anti-HIV-1_HeavyChain
caggugcugcucguccagagcggcgccgaggugaagaagcccggguccagcgugaaggucuccugcaaggccagcggcgacucccugaccaaguacgcguucagcugggugcggcaggccccggggcagggccccgaguggaugggguggauccggcccaagaccggcgcccgcaaccgggcccgccaguuccagccccggaucucccugacgcgcgaccgggcccucagcaccgcguaccuggaccugaacucccucaccagcgccgacuccggcaccuacuucugcgcccgccagacguucaagccggacuucuacuucgccgaccagggguggagcuucaaccuguggggccgcggggcgcacuucaucguguccagc

SEQ ID NO: 11029 - RNA, 381 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggcccggggccagacguucgaguggcucggguggaugaagccggugaccggcgccgugaacuacgcgcgcaaguuccagggccgggucagcuucuaccgcacccgggagcuggggaucgccuacauggaccugcgcaaccuccgguucgacgacaccgccguguacuucugcgcccgcaagacggcgggcgacguguccggggacaagcggggcuucuucuucgaccugugggggcgcggcagccgggucaucguguccagc

SEQ ID NO: 11030 - RNA, 381 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugaacuacgcgcggaaguuccagggccgcgucagcuucuaccggacccgcgagcuggggaucgccuacauggaccugcggaaccuccgcuucgacgacaccgccguguacuucugcgcccggaagacggcgggcgacguguccggggacaaccgcggcuacuucuucgaccugugggggcggggcagccgcgucaucguguccagc

SEQ ID NO: 11031 - RNA, 381 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugaacuacgcgcggaaguuccagggccgcgucagcuucuaccggacccgcgagcuggggaucgccuacauggaccugcggaaccuccgcuucgacgacaccgccguguacuucugcgcccggaagacggcgggcgacguguccggggacaagcgcggcuucuucuucgaccugugggggcccggcagccgggucaucguguccagc

SEQ ID NO: 11032 - RNA, 381 nt, Artificial Sequence
  derived and/or modified sequence opt1 from anti-HIV-1_HeavyChain
cagguguacauggagcaggccggcgggggcaugaagaagcccggggccagcaugaccgucuccugcaagaccgcggacgaggacaucuucgacgccgccuacaugcgcugggugcggcaggccccgggccagacguucgaguggcugggguggaugaagcccgugaccggcgccgucaacuacgcgcgccaguuccagggccgggugagcuucuaccgcacccgggagcucgggaucgccuacauggaccugcgcgaccugaaguucgacgacaccgccguguacuucugcgcccggaagacgaagggcgacgucuccggggacgaccgcggcuucuucuucgaccucugggggcggggcacccgcgugaucgugagcucc

SEQ ID NO: 11033 - RNA, 381 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugagcuacgcgcggaaguuccagggccgcgucuccuucuacaugacccgggagcuggggauggccuaccuggaccuccgcaaccugcgguucgacgacaccgccguguacuucugcgcccgcaagacggcgggcgacgugagcggggacaaccggggcuacuucuucgaccugugggggcgcggcucccgggucaucgugagcucc

SEQ ID NO: 11034 - RNA, 381 nt, Artificial Sequence
  derived and/or modified sequence opt1 from anti-HIV-1_HeavyChain
caggugcagcugguccagagcggcgccgaggugaagaagcccggggccuccgugaaggucagcugcaaggcguccggcuacaccuucaccggguacuacaugcacugggugcgccaggccccgggccaggggcucgaguggaucggcugggugaagacggucaccggcgccgugaacuucgggagccuggacuuccggcaccgcaucucccugacccgggaccgcgaccucuucaccgcccacauggacauccggggccugacgcagggggacaccgccaccuacuucugcgcgcgccagaaguucgagagccgguacaccggcgggcagggcugguacuucgaccuguggggccgcgggacgcacaucguggucuccagc

SEQ ID NO: 11035 - RNA, 381 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaucaagcccgugaccggcgccgugaacuacgcgcggaaguuccagggccgcgucagcuucuaccggacccgcgagcuggggaucgccuacauggaccugcggaaccuccgcuucgacgacaccgccguguacuucugcgcccggaagacggcgggcgacguguccggggacaagcgcggcuucuucuucgaccugugggggcggggcagccgcgucaucguguccagc

SEQ ID NO: 11036 - RNA, 381 nt, Artificial Sequence
  derived and/or modified sequence opt1 from anti-HIV-1_HeavyChain
cagguguacauggagcaggccggcgggggcaugaagaagcccggggccagcgucaccguguccugcaagaccgcggacgaggacaucuucgacgccgccuacaugcacugggugcgccaggccccgggccagacguucgaguggcugggguggaugaagcccgucaccggcgccgugaacuacgcgcggcaguuccagggccgcgugagcuucuaccggacccgcgagcucgggaucgccuacauggaccugcgggaccugaaguucgacgacaccgccgucuacuucugcgcccgcaagacgaagggcgacguguccggggacgaccggggcuucuucuucgaccucugggggcgcggcacccgggugaucgucagcucc

SEQ ID NO: 11037 - RNA, 381 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucagcaaggcggagcucauccacugggugcggcaggccccggggcagggccuggaguggaucgggugggucaagaccgugaccggcgccgugaacuucggcucccuggacuuccgccaccggaucagccucacgcgcgaccgggaccuguucaccgcccacauggacauccgcgggcugacccagggcgacaccgccacguacuucugcgcgcggcagaaguucgagucccgcuacaccgggggccaggggugguacuucgaccucuggggccggggcacccacaucgucgugagcucc

SEQ ID NO: 11038 - RNA, 381 nt, Artificial Sequence
  derived and/or modified sequence opt1 from anti-HIV-1_HeavyChain
cagguguacauggaggccggccgcgggggcgucaagaagcccggggccagcgcgacccuguccugcaagaccgccgacgaggacguguucgacgccgccuacaugcacugggugcggcaggccccgggccagacguucgaguggcucggguggaugaagcccgucaccggcgcggugagcuacgcccgcaaguuccagggccggguguccuucuacaugacccgcgagcuggggauggccuacauggaccugcggaaccuccgcuucgacgacaccgccgucuacuucugcgcgcggaagacggccggcgacgugagcggggacaaccgcggcuacuucuucgaccugugggggcggggcucccgcgugaucgucagcucc

SEQ ID NO: 11039 - RNA, 381 nt, Artificial Sequence
  derived and/or modified sequence opt1 from anti-HIV-1_HeavyChain
cgcugcaucuggcggcaggccggcgggggcgugaagaagcccggggccagcgucacccuguccugcaagaccgcggacgaggacguguucgacgccgccuacaugcacugggugcgccaggccccgggccagacguucgaguggcucggguggaugaagcccgucaccggcgccgugagcuacgcgcggaaguuccagggccgcguguccuucuacaugacccgggagcuggggauggccuacauggaccugcgcaaccuccgguucgacgacaccgccgucuacuucugcgcccgcaagacggcgggcgacgugagcggggacaaccggggcuacuucuucgaccugugggggcgcggcucccgggugaucgucagcucc

SEQ ID NO: 11040 - RNA, 381 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaucaagcccgugaccggcgccgugagcuacgcgcggaaguuccagggccgcgucuccuucuacaugacccgggagcuggggauggccuacauggaccugcgcaaccuccgguucgacgacaccgccguguacuucugcgcccgcaagacggcgggcgacgugagcggggacaaccggggcuacuucuucgaccugugggggcgcggcucccgggucaucgugagcucc

SEQ ID NO: 11041 - RNA, 384 nt, Artificial Sequence
  derived and/or modified sequence opt1 from anti-HIV-1_HeavyChain
cagagccaccuggagcaguccggcagcgccaugaagaagcccggggccuccgucaagagcuccugcuggaccagcgaggacaucuucgacaccacggagcucaucuacugggugcgccaggcgccgggccaggggcuggaguggaucggcugggugaagaucguguccgggaccgucaacuucgccagccuggacuuccggaaccgcaucucccucagccgggaccgcgaccuguccaccgccuacauggacauccggggccugacccaggacgacacggccaccuacuucugcgcccgccagaaguucgcgagccgguacuccggcgaccaggggagcuacuucgaccucuggggccgcgggacccugaucgugguguccagc

SEQ ID NO: 11042 - RNA, 381 nt, Artificial Sequence
  derived and/or modified sequence opt1 from anti-HIV-1_HeavyChain
cgcugccuguggcggcaggccggcgggggcaugaagaagcccggggccagcaugaccguguccugcaagaccgcggacgaggacgucuucgacgccgccuacaugcacugggugcgccaggccccgggccagacguucgaguggcucggguggaugaagcccgugaccggcgccgucaacuacgcgcggaaguuccagggccgcgugagcuucuaccggacccgcgagcuggggaucgccuacauggaccugcggaaccuccgcuucgacgacaccgccguguacuucugcgcccggaagacggcgggcgacgucuccggggacaagcgcggcuucuucuucgaccugugggggcggggcagccgcgugaucguguccagc

SEQ ID NO: 11043 - RNA, 381 nt, Artificial Sequence
  derived and/or modified sequence opt1 from anti-HIV-1_HeavyChain
cgcugcaucugggagcgggccggcgggggcaugaagaagcccggggccagcaugaccguguccugcaagaccgcggacgaggacaucuucgacgccgccuacaugcacuggguccgccaggccccgggccagacguucgaguggcugggguggaugaagcccgugaccggcgccgugaacuacgcgcggcaguuccagggccgcgucagcuucuaccggacccgcgagcucgggaucgccuacauggaccugcgggaccugaaguucgacgacaccgccguguacuucugcgcccgcaagacgaagggcgacguguccggggacgaccggggcuucuucuucgaccucugggggcgcggcacccgggucaucgugagcucc

SEQ ID NO: 11044 - RNA, 381 nt, Artificial Sequence
  derived and/or modified sequence opt1 from anti-HIV-1_HeavyChain
caggugcagcuggagcaggccggcgggggcgucaagaagcccggggccagcgugacccucuccugcaagaccgcggacgaggacguguucgacgccgccuacaugcacuggguccgccaggccccgggccagacguucgaguggcugggguggaugaagcccgugaccggcgccgugaacuacgcgcggaaguuccagggccgcgucagcuucuaccggacccgcgagcuggggaucgccuacauggaccuccggaaccugcgcuucgacgacaccgccguguacuucugcgcccggaagacggcgggcgacguguccggggacaagcgcggcuucuucuucgaccugugggggcggggcagccgcgucaucguguccagc

SEQ ID NO: 11045 - RNA, 381 nt, Artificial Sequence
  derived and/or modified sequence opt1 from anti-HIV-1_HeavyChain
cagguguacauggagcaggccggcgggggcaugaagaagcccggggccagcaugaccgucuccugcaagaccgcggacgaggacguguucgacgccgccuacaugcacugggugcgccaggccccgggccagacguucgaguggcugggguggaugaagcccgucaccggcgccgugaacuacgcgcggaaguuccagggccgcgugagcuucuaccggacccgcgagcucgggaucgccuacauggaccugcggaaccugcgcuucgacgacaccgccgucuacuucugcgcccggaagacggcgggcgacguguccggggacaagcgcggcuucuucuucgaccucugggggcggggcagccgcgugaucgucuccagc

SEQ ID NO: 11046 - RNA, 381 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcgcuggguccggcaggccccgggccagacguucgaguggcucggguggaugaagcccgugaccggcgccgugagcuacgcgcgcaaguuccagggccgggucuccuucuacaugacccgcgagcuggggauggccuacauggaccugcggaaccuccgcuucgacgacaccgccguguacuucugcgcccggaagacggcgggcgacgugagcggggacaaccgcggcuacuucuucgaccugugggggcggggcucccgcgucaucgugagcucc

SEQ ID NO: 11047 - RNA, 381 nt, Artificial Sequence
  derived and/or modified sequence opt1 from anti-HIV-1_HeavyChain
cagguguacauggagcagcccggcgggggcgucaagaagccgggggccagcgugacccuguccugcaagaccgccgacgaggacguguucgacgcggccuacaugcacuggguccgccaggcccccggccagacguucgaguggcucggguggaugaagcccgugaccggcgccgugagcuacgcccggaaguuccagggccgcgucuccuucuacaugacccgggagcuggggauggcguacauggaccugcgcaaccuccgguucgacgacaccgccguguacuucugcgcccgcaagacggccggcgacgugagcggggacaaccggggcuacuucuucgaccugugggggcgcggcucccgggucaucgugagcucc

SEQ ID NO: 11048 - RNA, 381 nt, Artificial Sequence
  derived and/or modified sequence opt1 from anti-HIV-1_HeavyChain
cagguguacauggagcaggccggcggggaggucaagaagcccggcgccagcgugacccuguccugcaagaccgcggacgaggacguguucgacgccgccuacaugcacuggguccgccaggccccggggcagacguucgaguggcucggcuggaugaagcccgugaccggggccgugagcuacgcgcggaaguuccagggccgcgucuccuucuacaugacccgggagcugggcauggccuacauggaccugcgcaaccuccgguucgacgacaccgccguguacuucugcgcccgcaagacggcgggggacgugagcggcgacaaccggggguacuucuucgaccuguggggccgcgggucccgggucaucgugagcucc

SEQ ID NO: 11049 - RNA, 381 nt, Artificial Sequence
  derived and/or modified sequence opt1 from anti-HIV-1_HeavyChain
caggugcagcugguccagagcggcgccgaggugaagaagcccggggccuccgugcgcgucagcugccaggcguccggcuacaucuucaccggguacuucgugaacuggcuccggcagcugccgggccagcgccccgaguggaugggguggauccggcccaagagcggcgcccgcaaccaggcccggcaguuccagccccgcaucucccugacccgggaccgcgcccucagcacggccuaccuggacuccaacagccugaccuccgcggacagcggcaccuacuucugcgcccggcagaccuucaagccggacuucuacuucgccgaccaggggugguccuucaaccucuggggccgcggggcccacuucaucgugagcucc

SEQ ID NO: 11050 - RNA, 381 nt, Artificial Sequence
  derived and/or modified sequence opt1 from anti-HIV-1_HeavyChain
ggcugcaucuggacccaggccgggggcggggugaagaagcccggcgccagcgucacccuguccugcaagacggcggacgaggacguguucgacgccgccuacaugcacugggugcgccaggccccggggcagaccuucgaguggcucggcuggaugaagcccgucaccggcgccgugagcuacgcgcggaaguuccaggggcgcguguccuucuacaugacccgggagcugggcauggccuacauggaccugcgcaaccuccgguucgacgacacggccgucuacuucugcgcccgcaagaccgcgggggacgugagcggcgacaaccggggguacuucuucgaccuguggggccgcggcucccgggugaucgucagcucc

SEQ ID NO: 11051 - RNA, 381 nt, Artificial Sequence
  derived and/or modified sequence opt1 from anti-HIV-1_HeavyChain
cgcugcaucuggcggcaggccggcgggggcaugaagaagcccggggccagcaugaccguguccugcaagaccgcggacgaggacaucuucgacgccgccuacaugcacuggguccgccaggccccgggccagacguucgaguggcugggguggaugaagcccgugaccggcgccgugaacuacgcgcggcaguuccagggccgcgucagcuucuaccggacccgcgagcucgggaucgccuacauggaccugcgggaccugaaguucgacgacaccgccguguacuucugcgcccgcaagacgaagggcgacguguccggggacgaccggggcuucuucuucgaccucugggggcgcggcacccgggucaucgugagcucc

SEQ ID NO: 11052 - RNA, 381 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgagugggugggguggaugaagcccgugaccggcgccgucagcuacgcgcggaaguuccagggccgcguguccuucuacaugacccgggagcucgggauggccuacauggaccugcgcaaccugcgguucgacgacaccgccguguacuucugcgcccgcaagacggcgggcgacgucagcggggacaaccggggcuacuucuucgaccucugggggcgcggcucccgggugaucgugagcucc

SEQ ID NO: 11053 - RNA, 381 nt, Artificial Sequence
  derived and/or modified sequence opt1 from anti-HIV-1_HeavyChain
cagguguacauggagcaggccggcgggggcgucaaggagcccggggccagcgugacccuguccugcaagaccgcggacgaggacguguucgacgccgccuacaugcacuggguccgccaggccccgggccagacguucgaguggcucggguggaugaagcccgugaccggcgccgugaacuacgcgcggaaguuccagggccgcgucagcuucuaccggacccgcgagcuggggaucgccuacauggaccugcggaaccuccgcuucgacgacaccgccguguacuucugcgcccggaagacggcgggcgacguguccggggacaagcgcggcuucuucuucgaccugugggggcggggcagccgcgucaucguguccagc

SEQ ID NO: 11054 - RNA, 381 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucaagaccgagcucauccacugggugcggcaggcgccggggcagggccuggaguggaucgggugggucaagaccgugacgggcgccgugaacuucggcagccuggacuuccgccaccggaucucccucacccgcgaccgggaccuguucaccgcccacauggacauccgcgggcugacccagggcgacacggccaccuacuucugcgcccggcagaaguucgagagccgcuacaccgggggccaggggugguacuucgaccucuggggccggggcacccacaucgucguguccagc

SEQ ID NO: 11055 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucggguggaugaagaccgucacgggcgccgugaacuucggcagccuggacuuccggcaccgcaucucccucacccgggaccgcgaccuguucaccgcccacauggacauccgggggcuggcccagggcgacaccgccacguacuucugcgcgcgccagaaguucgagagccgguacaccgggggccaggggugguacuucgaccucuggggccgcggcacccacaucguggucuccagc

SEQ ID NO: 11056 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccuggacuuccggcaccgcaucagccucacccgggaccgcgaccuguucaccgcccacauggacauccgggggcugacgcagggcgacaccgccaccuacuucugcgcccgccagaaguucgagucccgguacaccgggggccaggggugguacuucgaccucuggggccgcggcacgcacaucgucgugagcucc

SEQ ID NO: 11057 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgccuacauggacauccgcggccugacccaggacgacacggccaccuacuucugcgcccggcagaaguucgcgucccgcuacagcggcgaccagggguccuacuucgaccucuggggccgggggacccugaucguggucagcucc

SEQ ID NO: 11058 - RNA, 384 nt, Artificial Sequence
  derived and/or modified sequence opt1 from anti-HIV-1_HeavyChain
agccacaccuggaacaaccgcggcuccgccaugaagaagcccggggccagcgugcgggucuccugcuggaccagcgaggacaucuucgacacgaccgagcugaucuacugggugcgccaggcgccgggccaggggcucgaguggaucggcugggugaagaucgucuccgggaccgugaacuucgccagccuggacuuccggaaccgcaucucccugagccgggaccgcgaccucuccaccgccuacauggacauccggggccugacgcaggacgacaccgccaccuacuucugcgcccgccagaaguucgcgagccgguacuccggcgaccaggggagcuacuucgaccuguggggccgcgggacccucaucguggucuccagc

SEQ ID NO: 11059 - RNA, 381 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuuccacaacgagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcacggccuacauggacauccgcggccugacccaggacgacaccgccaccuacuucugcgcccggcagaaguucgcgucccgcuacagcggcgaccagggguccuacuucgaccucuggggccgggggacgcugaucguggucagcucc

SEQ ID NO: 11060 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucggguggaugaagacggucaccggcgccgugaacuucggcucccuggacuuccggcaccgcaucagccucacccgggaccgcgaccuguucaccgcccacauggacauccgggggcugacgcagggcgacaccgccaccuacuucugcgcccgccagaaguucgagucccgguacaccgggggccaggggugguacuucgaccucuggggccgcggcacgcacaucguggucagcucc

SEQ ID NO: 11061 - RNA, 381 nt, Artificial Sequence
  derived and/or modified sequence opt1 from anti-HIV-1_HeavyChain
cagguguucauggagcaggccggcggggaggucaagaagcccggcgccagcaugaccguguccugcaagaccgcggacgaggacguguucgacgccgccuacaugcacuggguccgccaggccccggggcagacguucgaguggcugggcuggaugaagcccgugaccggggccgugaacuacgcgcggcaguuccagggccgcgucagcuucuaccggacccgcgagcucggcaucgccuacauggaccugcgggaccugaaguucgacgacaccgccguguacuucugcgcccgcaagacgaagggggacguguccggcgacgaccggggguucuucuucgaccucuggggccgcgggacccgggucaucgugagcucc

SEQ ID NO: 11062 - RNA, 381 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgaggacgagcugauccacugggugcggcaggcgcccgggcagggccuggaguggaucgggugggucaagaucguguccggcaccgugaacuucgccagccucgacuuccgcaaccggaucucccugagccgcgaccgggaccuguccacggccuacauggacauccgcggccucacccaggacgacaccgccaccuacuucugcgcccggcagaaguucgcgagccgcuacuccggggaccagggcagcuacuucgaccugugggggcggggcacgcugaucgucguguccagc

SEQ ID NO: 11063 - RNA, 381 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacauccucaaggcggagcugaucuacugggugcggcaggccccgggccgcgggcuggaguggaucggcugggugaagaccgucagcgggacggugaacuucggcuccagcgacuuccggaaccgcaucucccucacccgggaccgcgaccugagcaccgcccacauggacauccggggccugacccaggacgacacggccaccuacuucugcgcccgccagaaguucgagucccucuacagcgacgaccagggguccuacuucgaccuguggggccgggggacccugaucaucgugagcucc

SEQ ID NO: 11064 - RNA, 381 nt, Artificial Sequence
  derived and/or modified sequence opt1 from anti-HIV-1_HeavyChain
caggugcagcugguccagagcggcgccgaggugaagaagcccggggccuccgugaaggucagcugcaaggcguccggcuacagcuucaccgacuacuacauccacuggcuccgccaggugcaggggcagcggccggaguggaugggcuggauccgcccccggaccggggcccgcaaccaggcccggcaguuccagccccgcaucucccugacgcgggaccgcgcccugagcaccgccuaccucgaccugaacucccugaccagcgcggacuccggcaccuacuucugcgcccggcagacguucaagcccgacuucuacuucgccgaccagggcuggagcuucaaccucugggggcgcggcgcccacuucaucguguccagc

SEQ ID NO: 11065 - RNA, 381 nt, Artificial Sequence
  derived and/or modified sequence opt1 from anti-HIV-1_HeavyChain
cagguguucauggagcaggccggcggggaggucaagaagcccggcgccagcaugaccguguccugcaagaccgcggacgaggacguguucgacgccgccuacaugcacuggguccgccaggccccggggcagacguucgaguggcugggcuggaugaagcccgugaccggggccgugaacuacgcgcggaaguuccagggccgcgucagcuucuaccggacccgcgagcucggcaucgccuacauggaccugcgggaccugaaguucgacgacaccgccguguacuucugcgcccgcaagacgaagggggacguguccggcgacgaccggggguucuucuucgaccucuggggccgcgggacccgggucaucgugagcucc

SEQ ID NO: 11066 - RNA, 384 nt, Artificial Sequence
  derived and/or modified sequence opt1 from anti-HIV-1_HeavyChain
caggcccaccuggagcagagcggcgccggggugaagaagcccggcgcguccguccgcgugagcugcuggaccuccgaggacaucuucgagcggaccgagcucauccacugggugcgccaggccccggggcagggccuggaguggaucgggugggucaagacggugaccggcgccgugaacuucggcagccuggacuuccggcaccgcaucucccucacccgggaccgcgaccuguucaccgcccacauggacauccgggggcugacgcagggcgacaccgccaccuacuucugcgcgcgccagaaguucgagagccgguacaccgggggccaggggugguacuucgaccucuggggccgcggcacgcacaucgucguguccagc

SEQ ID NO: 11067 - RNA, 384 nt, Artificial Sequence
  derived and/or modified sequence opt1 from anti-HIV-1_HeavyChain
caggcccaccuggagcagagcggcgccggggugaagaagcccggcgcguccguccgcgugagcugcugguccagcgaggacaucuucgagcggaccgagcucauccacugggugcgccaggccccggggcagggccuggaguggaucgggugggucaagaccgugacgggcgccgugaacuucggcucccuggacuuccggcaccgcaucagccucacccgggaccgcgaccuguucaccgcccacauggacauccgggggcugacccagggcgacacggccaccuacuucugcgcgcgccagaaguucgagucccgguacaccgggggccaggggugguacuucgaccucuggggccgcggcacccacaucgucgugagcucc

SEQ ID NO: 11068 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcugggcguccgaggacaucuucgacaccaccgagcucaucuacugggugcggcaggccccgggccaggggcuggaguggaucggcugggugaagaucgucagcgggacggugaacuucgccucccuggacuuccgcaaccggaucagccucucccgcgaccgggaccugagcaccgccuacauggacauccgcggccugacccaggacgacaccgccacguacuucugcgcgcggcagaaguucgccucccgcuacagcggcgaccagggguccuacuucgaccucuggggccgggggacccugaucguggucagcucc

SEQ ID NO: 11069 - RNA, 381 nt, Artificial Sequence
  derived and/or modified sequence opt1 from anti-HIV-1_HeavyChain
cgcugccggcuggugcagagcggcgccgaggucaagaagcccggggccuccgugcgcgugagcugccaggcguccggcuacaccuucagcgccuacggggucaacugggugcggcaggccccgggccaggagcucgaguggaucgggugggugaagaccgucacgggcgccgugaacuucggcucccccaacuuccgccaccggaucagccugacccgcgaccgggaccuguucaccgcccacauggacauccgcgggcucacccagggcgacacggcgaccuacuucugcgcccggcagaaguucgagucccgcuacaccgggggccaggggugguacuucgaccuguggggccggggcacccacaucguggucagcucc

SEQ ID NO: 11070 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugugccaggcgccggggcagggccuggaguggaucgggugggucaagaccgugacgggcgccgugaacuucggcagccuggacuuccgccaccggaucucccucacccgcgaccgggaccuguucaccgcccacauggacauccgcgggcugacccagggcgacacggccaccuacuucugcgcccggcagaaguucgagagccgcuacaccgggggccaggggugguacuucgaccucuggggccggggcacccacaucgucguguccagc

SEQ ID NO: 11071 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaucgugaccggcgccgugaacuucggcagccuggacuuccggcaccgcaucucccucacgcgggaccgcgaccuguucaccgcccacauggacauccgggggcugacccagggcgacaccgccacguacuucugcgcccgccagaaguucgagagccgguacaccgggggccaggggugguacuucgaccucuggggccgcggcacccacaucgucguguccagc

SEQ ID NO: 11072 - RNA, 384 nt, Artificial Sequence
  derived and/or modified sequence opt1 from anti-HIV-1_HeavyChain
caggugcagcugguccagagcggccucgaggugaagaagcccggggccuccgugcgcgucagcugcuggaccuccgaggacaucuucgacaccacggagcugaucuacugggugcggcaggccccgggccaggggcuggaguggaucggcugggugaagaucgucagcgggaccgugaacuucgcgucccucgacuuccgcaaccggaucagccugucccgcgaccgggaccugagcaccgcccacauggacauccgcggccucacccaggacgacacggccaccuacuucugcgcccggcagaaguucgccucccgcuacagcggcgaccagggguccuacuucgaccuguggggccgggggacccugaucaucgugagcucc

SEQ ID NO: 11073 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugcggcaggacgacaccgccacguacuucugcgcccgccagaaguucgagucccgguacagcggcgaccagggguccuacuucgaccucuggggccgcgggacccugaucaucgugagcucc

SEQ ID NO: 11074 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucgcgucccgcuacagcggggaccagggcuccuacuucgaccugugggggcggggcacccucaucguggugagcucc

SEQ ID NO: 11075 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacgcagggcgacaccgccaccuacuucugcgcccgccagaaguucgagucccgguacaccgggggccaggggugguacuucgaccuguggggccgcggcacgcacaucguggugagcucc

SEQ ID NO: 11076 - RNA, 384 nt, Artificial Sequence
  derived and/or modified sequence opt1 from anti-HIV-1_HeavyChain
cgccacaccugggagcagagcggcuccggggugaagaagcccggcgccagcguccggguguccugcuggaccagcgaggacaucuucgagaaguccgagcugauccacugggugcgccaggccccggggcagggccucgaguggaucgggugggucaagacggugaccggcgcggugaacuucggcagcuccgacuuccggcagcgcgucagccugacccgggaccgcgaccuguccaccgccuacauggacauccgggggcucacgcaggacgacaccgccaccuacuucugcgcccgccagaaguucgccagccgguacuccggcgaccaggggagcuacuucgaccuguggggccgcgggacccugaucgugguguccagc

SEQ ID NO: 11077 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgccuacauggacauccgcggccugacccaggacgacacggccaccuacuucugcgcccggcagaaguucgagucccgcuacaccggcgggcagggcugguacuucgaccucugggggcggggcacccacaucguggucagcucc

SEQ ID NO: 11078 - RNA, 384 nt, Artificial Sequence
  derived and/or modified sequence opt1 from anti-HIV-1_HeavyChain
caggugcagcugguccagagcggcgccgaggugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugacccaggacgacacggccaccuacuucugcgcccggcagaaguucgagucccgcuacaccggcgggcagggcugguacuucgaccucugggggcggggcacccacaucguggucagcucc

SEQ ID NO: 11079 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgccuacauggacauccgcggccugacccagggcgacacggccaccuacuucugcgcccggcagaaguucgagucccgcuacaccgggggccaggggugguacuucgaccucuggggccgggggacccacaucguggucagcucc

SEQ ID NO: 11080 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccccgacuuccggcaccgcaucucccugagccgggaccgcgaccucuccaccgcccacauggacauccgggggcugacccaggacgacaccgccacguacuucugcgcccgccagaaguucgcgagccgguacuccggcgaccaggggagcuacuucgaccuguggggccgcgggacccucaucaucgucuccagc

SEQ ID NO: 11081 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcggggccuggaguggaucgggugggucaagacgguguccggcaccgugaacuucggcagcuccgacuuccgcaaccgggucagccugacccgcgaccgggaccucuccaccgcccacauggacauccgcgggcugacgcaggacgacaccgccaccuacuucugcgcccggcagaaguucgagagccuguacuccgacgaccagggcagcuacuucgaccucugggggcgcggcacccugaucaucguguccagc

SEQ ID NO: 11082 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggaaccgcaucagccugacccgggaccgcgaccucuccaccgcccacauggacauccgggggcugacgcaggacgacaccgccaccuacuucugcgcccgccagaaguucgagagccuguacuccgacgaccagggcagcuacuucgaccucugggggcggggcacccugaucaucgucuccagc

SEQ ID NO: 11083 - RNA, 384 nt, Artificial Sequence
  derived and/or modified sequence opt1 from anti-HIV-1_HeavyChain
cagagccaccuggagcaguccggcagcgccaugaagcgccccggggccuccgugcgggucagcugcuggaccuccgaggacaucuucgacaccacggagcucaucuacugggugcgccaggcgccgggccaggggcuggaguggaucggcugggugaagaucgucagcgggaccgugaacuucgccucccuggacuuccggaaccgcaucagccucucccgggaccgcgaccugagcaccgccuacauggacauccggggccugacccaggacgacacggccaccuacuucugcgcccgccagaaguucgcgucccgguacagcggcgaccagggguccuacuucgaccucuggggccgcgggacccugaucguggucagcucc

SEQ ID NO: 11084 - RNA, 384 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggaaccgcaucucccugagccgggaccgcgaccuguccacggccuacauggacauccgggggcucacccaggacgacaccgccaccuacuucugcgcgcgccagaaguucgccagccgguacuccggcgaccaggggagcuacuucgaccuguggggccgcgggacgcugaucgucguguccagc

SEQ ID NO: 11085 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccuggacuuccggcaccgcaucagccucacccgggaccgcgacuucuucaccgcccacauggacauccgggggcugacgcagggcgacaccgccaccuacuucugcgcccgccagaaguucgagucccgguacaccgggggccaggggugguacuucgaccuguggggccgcggcacgcacaucgucgugagcucc

SEQ ID NO: 11086 - RNA, 381 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuuccggaccgagcucauccacugggugcgccaggcgccggggcagggccuggaguggaucgggugggucaagaccgugacgggcgccgugaacuucggcagccuggacuuccggcaccgcaucucccucacccgggaccgcgaccuguucaccgcccacauggacauccgggggcugacccagggcgacacggccaccuacuucugcgcccgccagaaguucgagagccgguacaccgggggccaggggugguacuucgaccucuggggccgcggcacccacaucgucguguccagc

SEQ ID NO: 11087 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacgcagggcgacaccgccaccuacuucugcgcccgccagaaguucgagucccuguacagcgacgaccagggguccuacuucgaccucuggggccgggggacccugaucaucgugagcucc

SEQ ID NO: 11088 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugacccaggacgacacggccaccuacuucugcgcccggcagaaguucgcgucccgcuacagcggcgaccagggguccuacuucgaccucuggggccgggggacccugaucaucgugagcucc

SEQ ID NO: 11089 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccuccagcgacuuccgcaaccggaucucccugagccgcgaccgggaccucuccaccgcccacauggacauccgcggccugacccaggacgacacggccaccuacuucugcgcccggcagaaguucgcgagccgcuacuccggcgaccaggggagcuacuucgaccuguggggccgggggacccucaucguggucuccagc

SEQ ID NO: 11090 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucaucuacugggugcgccaggcgccggggcggggccuggaguggaucgggugggucaagacgguguccggcaccgugaacuucggcagcuccgacuuccgcaaccggaucagccugacccgcgaccgggaccucuccaccgcccacauggacauccgcgggcugacgcaggacgacaccgccaccuacuucugcgcccggcagaaguucgagagccuguacuccgacgaccagggcagcuacuucgaccucugggggcgcggcacccugaucaucgucuccagc

SEQ ID NO: 11091 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucauccacugggugcggcaggcgccgggccaggggcuggaguggaucggcugggugaagaccgucaccggggccgugaacuucggcagccuggacuuccgccaccggaucucccucacccgcgaccgggaccuguucacggcccacauggacauccgcggccugacccagggggacaccgccaccuacuucugcgcccggcagaaguucgagagccgcuacacgggcgggcagggcugguacuucgaccucugggggcggggcacccacaucguggucuccagc

SEQ ID NO: 11092 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucggcaccacggagcucaucuacugggugcggcaggcgccggggcagggccuggaguggaucgggugggugaagaucgucagcggcaccgugaacuucgccucccuggacuuccgcaaccggaucagccucucccgcgaccgggaccugagcaccgccuacauggacauccgcggccugacccaggacgacacggccaccuacuucugcgcccggcagaaguucgcgucccgcuacagcggggaccagggcuccuacuucgaccucugggggcggggcacccugaucguggucagcucc

SEQ ID NO: 11093 - RNA, 384 nt, Artificial Sequence
  derived and/or modified sequence opt1 from anti-HIV-1_HeavyChain
caggugcagcugguccagagcggcuccgccaugaagaagcccggggccagcgugcgcguguccugcuggaccagcgaggacaucuucgacaccacggagcucaucuacuggguccggcaggcgccgggccaggggcuggaguggaucggcugggugaagaucguguccgggaccgucaacuucgccagccuggacuuccgcaaccggaucucccucagccgcgaccgggaccuguccaccgccuacauggacauccgcggccugacccaggacgacacggccaccuacuucugcgcccggcagaaguucgcgagccgcuacuccggcgaccaggggagcuacuucgaccucuggggccgggggacccugaucgugguguccagc

SEQ ID NO: 11094 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggggaucuucgagcggaccgagcucauccacugggugcgccaggcgccgggccaggggcuggaguggaucggcugggucaagacggugaccggcgccgugaacuucgggucccuggacuuccggcaccgcaucagccucacccgggaccgcgaccuguucaccgcccacauggacauccggggccugacgcagggggacaccgccaccuacuucugcgcccgccagaaguucgagucccgguacaccggcgggcagggcugguacuucgaccucuggggccgcgggacgcacaucgucgugagcucc

SEQ ID NO: 11095 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggcgcgccaggccccggggcagggccuggaguggaucgggugggugaagacggucaccggcgccgugaacuucggcucccccaacuuccggcaccgcgccagccugacccgggaccgcgaccucuucaccgcccacauggacauccgggggcugacggagggcgacaccgcgaccuacuucugcgcccgccagaaguucgccucccgguacagcggggaccagggcuccuacuucgaccugugggggcgcggcacccucaucaucgugagcucc

SEQ ID NO: 11096 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccgcggagcucaucuacugggugcggcaggccccgggccaggggcuggaguggaucggcugggugaagaucgucagcgggacggugaacuucgccucccuggacuuccgcaaccggaucagccucucccgcgaccgggaccugagcaccgcccacauggacauccgcggccugcggcaggacgacaccgccaccuacuucugcgcgcgccagaaguucgagucccgguacagcggcgaccagggguccuacuucgaccucuggggccgcgggacgcugaucaucgugagcucc

SEQ ID NO: 11097 - RNA, 384 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgagugggucaaggccguguccggggccgugaacuacggcagccucgacuuccggcaccgcgucucccugacgcgggaccgcgaccuguucaccgcccacauggacauccggggccucacccaggacgacaccgccacguacuucugcgcgcgccagaaguucgagagccgguacaccgggggccaggggugguacuucgaccuguggggccgcgggacccacaucgugguguccagc

SEQ ID NO: 11098 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgccuacauggacauccgcggccugacccaggacgacacggccaccuacuucugcgcccggcagaaguucgcgucccgcuacagcggcgaccagggguccuacuucgaccucuggggccgggggacccuggacugcgugagcucc

SEQ ID NO: 11099 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcggggccgugaacuucgccucccuggacuuccgcaaccggaucagccucucccgcgaccgggaccugagcaccgcccacauggacauccgcggccugacccaggacgacaccgccacguacuucugcgcgcggcagaaguucgccucccgcuacagcggcgaccagggguccuacuucgaccucuggggccgggggacccugaucaucgugagcucc

SEQ ID NO: 11100 - RNA, 384 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccugagcaccgcccacauggacauccgggggcucacccagggcgacaccgccacguacuucugcgcgcgccagaaguucgagucccgguacaccgggggccaggggugguacuucgaccuguggggccgcggcacccacaucguggugagcucc

SEQ ID NO: 11101 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuccaccgcccacauggacauccgcgggcugacccaggacgacacggccaccuacuucugcgcccggcagaaguucgagagccuguacuccgacgaccagggcagcuacuucgaccucugggggcgcggcacccugaucaucguguccagc

SEQ ID NO: 11102 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcaccgugaacuucggcucccugaacuuccggcaccgcaucagccucacccgggaccgcgaccuguucacggcccacauggacauccgggggcugacccagggcgacaccgccaccuacuucugcgcccgccagaaguucgagucccgguacaccgggggccaggggugguacuucgaccucuggggccgcggcacgcacaucgucgugagcucc

SEQ ID NO: 11103 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucaucuacugggugcgccaggcgccgggccgggggcuggaguggaucggcugggugaagaucgucagcgggacggugaacuucgccucccuggacuuccgcaaccggaucagccucucccgcgaccgggaccugagcaccgcccacauggacauccgcggccugacccaggacgacaccgccacguacuucugcgcccggcagaaguucgcgucccgcuacagcggcgaccagggguccuacuucgaccucuggggccgggggacccugaucaucgugagcucc

SEQ ID NO: 11104 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgccuacauggacauccgcggccugacccaggacgacacggccaccuacuucugcgcccggcagaaguucgcgucccgcuacagcggcgaccagggguccuacuucgaccucuggggccgggggacccugaucaucgugagcucc

SEQ ID NO: 11105 - RNA, 384 nt, Artificial Sequence
  derived and/or modified sequence opt1 from anti-HIV-1_HeavyChain
caggcccgccuggagcagagcggcuccggggugaagaagcucggcgccagcguccggguguccugcuggaccagcgaggacaucuucgagcgcaccgagcugauccacugggugcggcaggcgcccgggcagggccuggaguggaucgggugggucaaggccguguccggcgccgugaacuacggcagccucgacuuccgcaaccggaucucccugagccgcgaccgggaccuguccacggccuacauggacauccgcgggcucacccaggacgacaccgccaccuacuucugcgcgcggcagaaguucgccagccgcuacuccggcgaccaggggagcuacuucgaccuguggggccgggggacgcugaucgucguguccagc

SEQ ID NO: 11106 - RNA, 384 nt, Artificial Sequence
  derived and/or modified sequence opt1 from anti-HIV-1_HeavyChain
caggcccaccuggagcagagcggcuccgccaugaagaagcccggggcgagcgugcgcgucuccugcuggaccagcgaggacaucuucgacaccacggagcucaucuacugggugcggcaggccccgggccaggggcuggaguggaucggcugggugaagaucgucuccgggaccgugaacuucgccagccuggacuuccgcaaccggaucucccucagccgcgaccgggaccuguccaccgcccacauggacauccgcggccugacccaggacgacacggccaccuacuucugcgcgcggcagaaguucgccagccgcuacuccggcgaccaggggagcuacuucgaccucuggggccgggggacccugaucaucguguccagc

SEQ ID NO: 11107 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccuggacuuccggcaccgcaucucccucacccgggaccgcgaccugagcaccgccuacauggacauccgggggcugacccaggacgacacggccaccuacuucugcgcccgccagaaguucgcgucccgguacagcggcgaccagggguccuacuucgaccucuggggccgcgggacccugaucgucgugagcucc

SEQ ID NO: 11108 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgccaacuucggcagccuggacuuccggcaccgcaucucccucacccgggaccgcgaccuguucaccgcccacauggacauccgggggcugacccagggcgacacggccaccuacuucugcgcgcgccagaaguucgagagccgguacaccgggggccaggggugguacuucgaccucuggggccgcggcacccacaucguggucuccagc

SEQ ID NO: 11109 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcgguccgagcucauccacugggugcgccaggcgccggggcagggccuggaguggaucgggugggucaagaccgugacgggcgccgugaacuucggcagccuggacuuccggcaccgcaucucccucacccgggaccgcgaccuguucaccgcccacauggacauccgggggcugacccagggcgacacggccaccuacuucugcgcccgccagaaguucgagagccgguacaccgggggccaggggugguacuucgaccucuggggccgcggcacccacaucgucguguccagc

SEQ ID NO: 11110 - RNA, 381 nt, Artificial Sequence
  derived and/or modified sequence opt1 from anti-HIV-1_HeavyChain
cgcugcaucuggcggcaggccggcgggggcgugaagaagcccggggccagcgucacccuguccugcaagaccgcggacgaggacguguucgacgccgccuacaugcacugggugcgccaggccccgggccagacguucgaguggcucggguggaugaagcccgucaccggcgccgugagcuacgcgcggaaguuccagggccgcguguccuucuacaugacccgggggauccgcauggccuacauggaccugcggaaccugcgcuucgacgacaccgccgucuacuucugcgcccggaagacggcgggcgacgugagcggggacaaccgcggcuacuucuucgaccucugggggcggggcucccgcgugaucgucagcucc

SEQ ID NO: 11111 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucaucuacugggugcgccaggcgccgggccgggggcuggaguggaucggcugggugaagaucgucagcgggacggugaacuucgccucccuggacuuccgcaaccggaucagccucucccgcgaccgggaccugagcaccgccuacauggacauccgcggccugacccaggacgacaccgccacguacuucugcgcccggcagaaguucgcgucccgcuacagcggcgaccagggguccuacuucgaccucuggggccgggggacccugaucguggucagcucc

SEQ ID NO: 11112 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucauccacugggugcgccaggcgccgggccaggggcuggaguggaucggcugggugaagacggucaccggggccgugaacuucggcagccuggacuuccggcaccgcaucucccucacccgggaccgcgaccuguucaccgcccacauggacauccggggccugacgcagggggacaccgccaccuacuucugcgcccgccagaaguucgagagccgguacaccggcgggcagggcugguacuucgaccucugggggcgcggcacgcacaucguggucuccagc

SEQ ID NO: 11113 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcgccgcccacauggacauccgcggccugacccaggacgacaccgccacguacuucugcgcgcggcagaaguucgccucccgcuacagcggcgaccagggguccuacuucgaccucuggggccgggggacccugaucaucgugagcucc

SEQ ID NO: 11114 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagaucguguccggcgccgugaacuucggcagccccaacuuccggcagcgcgucucccugacgcgggaccgcgaccucuucaccgcccacauggacauccgggggcugacccagggcgacaccgccacguacuucugcgcccgccagaaguucgcgagccgguacuccggggaccagggcagcuacuucgaccugugggggcgcggcacccucaucgugguguccagc

SEQ ID NO: 11115 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccuggacuuccggcaccgcaucucccucacccgggaccgcgaccuguucaccgcccacauggacauccgggggcugacccagggcgacacggccaccuacuucugcacccgccagaaguucgagagccgguacaccgggggccaggggugguacuucgaccucuggggccgcggcacgcacaucgucguguccagc

SEQ ID NO: 11116 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccccgaguggaucgggugggucaagaccgugacgggcgccgugaacuucggcagccuggacuuccggcaccgcaucucccugacccgggaccgcgaccucuucaccgcccacauggacauccgggggcugacccagggcgacacggccaccuacuucugcgcccgccagaaguucgagagccgguacaccgggggccaggggugguacuucgaccuguggggccgcggcacccacaucgucguguccagc

SEQ ID NO: 11117 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcccccuggacuuccggcaccgcaucagccucacccgggaccgcgaccuguucaccgcccacauggacauccgggggcugacccagggcgacacggccaccuacuucugcgcccgccagaaguucgagucccgguacaccgggggccaggggugguacuucgaccucuggggccgcggcacccacaucgucgugagcucc

SEQ ID NO: 11118 - RNA, 384 nt, Artificial Sequence
  derived and/or modified sequence opt1 from anti-HIV-1_HeavyChain
cagagccaccuggagcaguccggccccgccaugaagaagccgggggccagcgugcgcgucuccugcuggaccagcgaggacaucuucgagcggaccgagcucaucuacugggugcgccaggcgcccggccgggggcuggaguggaucggcugggugaagacggucuccgggaccgugaacuucggcagcuccgacuuccgcaaccggaucagccugacccgcgaccgggaccucuccaccgcccacauggacauccgcggccugacgcaggacgacaccgccaccuacuucugcgcccggcagaaguucgagagccuguacuccgacgaccaggggagcuacuucgaccucuggggccgcgggacccugaucaucguguccagc

SEQ ID NO: 11119 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccggggccugagcaccgcccacauggacauccgcggccugacccaggacgacacggccaccuacuucugcgcccggcagaaguucgcgucccgcuacagcggggaccagggcuccuacuucgaccucugggggcggggcacccugaucaucgugagcucc

SEQ ID NO: 11120 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccccaacuuccggcaccgcgucucccugacccgggaccgcgaccucuucaccgcccacauggacauccgggggcugacccagggcgacacggccaccuacuucugcgcccgccagaaguucgcgagccgguacuccggggaccagggcagcuacuucgaccugugggggcgcggcacccucaucaucguguccagc

SEQ ID NO: 11121 - RNA, 384 nt, Artificial Sequence
  derived and/or modified sequence opt1 from anti-HIV-1_HeavyChain
cagagccaccuggagcacuccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgccuacauggacauccgcggccugacccaggacgacacggccaccuacuucugcgcccggcagaaguucgcgucccgcuacagcggcgaccagggguccuacuucgaccucuggggccgggggacccugaucguggucagcucc

SEQ ID NO: 11122 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagaucguguccggcgccgugaacuucggcagccccaacuuccggcagcgcgucucccugacgcgggaccgcgaccucuucaccgcccacauggacauccgggggcugacccagggcgacaccgccacguacuucugcgcccgccagaaguucgagagccuguacuccgacgaccaggggagcuacuucgaccucuggggccgggggacccugaucaucguguccagc

SEQ ID NO: 11123 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccccaacuuccggcaccgcaucucccugacccgggaccgcgaccucuucaccgcccacauggacauccgggggcugacccagggcgacacggccaccuacuucugcgcccgccagaaguucgagagccgguacaccgggggccaggggugguacuucgaccuguggggccgcggcacccacaucgucguguccagc

SEQ ID NO: 11124 - RNA, 384 nt, Artificial Sequence
  derived and/or modified sequence opt1 from anti-HIV-1_HeavyChain
caggcccaccuggagcagagcgccuccggcgugcgccggcccggggcgagcguccgcguguccugcuggaccagcgaggacaucuucgagcgguccgagcucaucuacugggugcgccaggccccgggccgggggcuggaguggaucggcuggaucaagcuggucagcggggccgugaacuucggcuccguggacuuccgcaaccggaucagccucucccgcgaccgggaccugagcaccgcccacauggacauccgcggccugcggcaggacgacacggccaccuacuucugcgcgcgccagaaguucgagucccgguacagcggggaccagggcuccuacuucgaccucugggggcgcggcacccugaucaucgucagcucc

SEQ ID NO: 11125 - RNA, 384 nt, Artificial Sequence
  derived and/or modified sequence opt1 from anti-HIV-1_HeavyChain
caggcccaccuggagcagagcgccuccggcgugaagcgccccggggcgagcguccggguguccugcuggaccagcgaggacaucuucgagcgcaccgagcucaucuacugggugcggcaggccccgggccaggggcuggaguggaucggcugggucaagacgguguccggggccgugaacuucggcagccaggacuuccgcgaccgguucucccugacccgcgaccgggaccucagcaccgcccacauggacauccgcggccugacccaggacgacacggccaccuacuucugcgcgcggcagaaguucgccucccgcuacagcggggaccagggcuccuacuucgaccugugggggcggggcacccucaucaucgucagcucc

SEQ ID NO: 11126 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagccuggacuuccgccaccggaucucccucacccgcgaccgggaccuguucaccgcccacauggacauccgcgggcugacccagggcgacacggccaccuacuucugcgcccggcagaaguucgagagccgcuacaccgggggccaggggugguacuucgaccucuggggccggggcacccacaucgucguguccagc

SEQ ID NO: 11127 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccccaacuuccggcaccgcgucucccugacccgggaccgcgaccucuucaccgcccacauggacauccgggggcugacccaggacgacacggccaccuacuucugcgcccgccagaaguucgagagccuguacuccgacgaccagggcagcuacuucgaccucugggggcggggcacccugaucaucguguccagc

SEQ ID NO: 11128 - RNA, 384 nt, Artificial Sequence
  derived and/or modified sequence opt1 from anti-HIV-1_HeavyChain
cagagccaccugaagcaguccggcagcgccaugaagaagcccggggccuccgugcgcgucagcugcuggaccuccgaggacaucuucgagcggaccgagcucaucuacugggugcgccaggcgccgggccgggggcuggaguggaucggcugggugaagacggucagcgggaccgugaacuucggcuccagcgacuuccgcaaccggaucucccugacccgcgaccgggaccucagcaccgcccacauggacauccgcggccugacgcaggacgacaccgccaccuacuucugcgcccggcagaaguucgagucccuguacagcgacgaccagggguccuacuucgaccucuggggccgcgggacccugaucaucgugagcucc

SEQ ID NO: 11129 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccuggacuuccggcaccgcaucucccucacccgggaccgcgaccugagcaccgcccacauggacauccgggggcugacccaggacgacacggccaccuacuucugcgcccgccagaaguucgcgucccgguacagcggcgaccagggguccuacuucgaccucuggggccgcgggacccugaucaucgucagcucc

SEQ ID NO: 11130 - RNA, 384 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccuguucaccgcccacauggacauccgggggcucacccaggacgacaccgccacguacuucugcgcgcgccagaaguucgagagccgguacaccggcgggcagggcugguacuucgaccugugggggcgcggcacccacaucgugguguccagc

SEQ ID NO: 11131 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacgcaggacgacaccgccaccuacuucugcgcccgccagaaguucgagucccuguacagcgacgaccagggcuccuacuucgaccucugggggcggggcacccugaucaucgugagcucc

SEQ ID NO: 11132 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacauccucgagcggaccgagcugaucuacugggugcgccaggcgccgggccgggggcuggaguggaucggcugggugaagacggucagcgggaccgugaacuucggcuccagcgacuuccgcaaccggaucucccucacccgcgaccgggaccugagcaccgcccacauggacauccgcggccugacgcaggacgacaccgccaccuacuucugcgcccggcagaaguucgagucccucuacagcgacgaccagggguccuacuucgaccuguggggccgcgggacccugaucaucgugagcucc

SEQ ID NO: 11133 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcagcgcgucagccugacccgggaccgcgaccucuucaccgcccacauggacauccgggggcugacgcagggcgacaccgccaccuacuucugcgcccgccagaaguucgcgucccgguacagcggggaccagggcuccuacuucgaccugugggggcgcggcacccucaucguggugagcucc

SEQ ID NO: 11134 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcaucagccugacccgggaccgcgaccucuucaccgcccacauggacauccgggggcugacgcagggcgacaccgccaccuacuucugcgcccgccagaaguucgagucccgguacaccgggggccaggggugguacuucgaccuguggggccgcggcacgcacaucgucgugagcucc

SEQ ID NO: 11135 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgacgacaucuucgagcggaccgagcucauccacugggugcgccaggcgccggggcagggccuggaguggaucgggugggucaagacggugaccggcgccgugaacuucggcucccccaacuuccggcagcgcgucagccugacccgggaccgcgaccucuucaccgcccacauggacauccgggggcugacgcagggcgacaccgccaccuacuucugcgcccgccagaaguucgagucccgguacaccgggggccaggggugguacuucgaccuguggggccgcggcacgcacaucguggugagcucc

SEQ ID NO: 11136 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugacccaggacgacacggccaccuacuucugcgcccggcagaaguucgcgucccgcuacagcggcgaccagggguccuacuucgaccucuggggccgggggacccugaucguggucagcucc

SEQ ID NO: 11137 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggaaccgcaucagccugucccgggaccgcgaccucagcaccgcccacauggacauccgggggcugacccaggacgacacggccaccuacuucugcgcccgccagaaguucgcgucccgguacagcggcgaccagggguccuacuucgaccuguggggccgcgggacccucaucaucgucagcucc

SEQ ID NO: 11138 - RNA, 384 nt, Artificial Sequence
  derived and/or modified sequence opt1 from anti-HIV-1_HeavyChain
caggcccaccuggagcagagcgccuccggcgugaagcgccccggggcgagcguccggguguccugcuggaccagcgaggacaucuucgagcgcaccgagcucaucuacugggugcggcaggccccgggccaggggcuggaguggaucggcugggucaagacggugaccggggccgugaacuucggcucccuggacuuccgccaccggaucagccucacccgcgaccgggaccuguucaccgcccacauggacauccgcggccugacgcagggggacaccgccaccuacuucugcgcgcggcagaaguucgagucccgcuacaccggcgggcagggcugguacuucgaccucugggggcggggcacgcacaucgucgugagcucc

SEQ ID NO: 11139 - RNA, 384 nt, Artificial Sequence
  derived and/or modified sequence opt1 from anti-HIV-1_HeavyChain
caggcccaccuggagcagagcgccuccggcgugcgccggcccggggcgagcguccgcguguccugcuggaccagcgaggacaucuucgagcgguccgagcucaucuacugggugcgccaggccccgggccgggggcuggaguggaucggcuggaucaagcuggucagcggggccgugaacuucggcuccguggacuuccgcgaccgggucagccucacccgcgaccgggaccuguucacggcccacauggacauccgcggccugacccaggacgacaccgccaccuacuucugcgcgcggcagaaguucgccucccgcuacagcggggaccagggcuccuacuucgaccucugggggcggggcacgcugaucaucgugagcucc

SEQ ID NO: 11140 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcaccgugaacuucgccagccuggacuuccggaaccgcaucucccucagccgggaccgcgaccuguccaccgccuacauggacauccggggccugacccaggacgacacggccaccuacuucugcgcccgccagaaguucgcgagccgguacuccggggaccagggcagcuacuucgaccucugggggcgcggcacccugaucgucguguccagc

SEQ ID NO: 11141 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccccaacuuccggcaccgcaucucccugagccgggaccgcgaccucuccaccgccuacauggacauccgggggcugacccaggacgacaccgccacguacuucugcgcccgccagaaguucgcgagccgguacuccggcgaccaggggagcuacuucgaccuguggggccgcgggacccucaucgucguguccagc

SEQ ID NO: 11142 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccuggacuuccggcaccgcaucucccccacccgggaccgcgaccucuucaccgcccacauggacauccgggggcugacccagggcgacacggccaccuacuucugcgcccgccagaaguucgagagccgguacaccgggggccaggggugguacuucgaccuguggggccgcggcacccucaucgucguguccagc

SEQ ID NO: 11143 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugcccaccgccuacauggacauccgcggccugacccaggacgacacggccaccuacuucugcgcccggcagaaguucgcgagccgcuacuccggcgaccaggggagcuacuucgaccucuggggccgggggacccugaucguggucuccagc

SEQ ID NO: 11144 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgccagcgggaccgucaacuucgccucccuggacuuccgcaaccggaucagccucucccgcgaccgggaccugagcaccgcccacauggacauccgcggccugacccaggacgacacggccaccuacuucugcgcgcggcagaaguucgccucccgcuacagcggcgaccagggguccuacuucgaccucuggggccgggggacccugaucguggugagcucc

SEQ ID NO: 11145 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaccgucaccggggccgugaacuucggcagccuggacuuccgccaccggaucucccucacccgcgaccgggaccuguucacggcccacauggacauccgcggccugacccagggggacaccgccaccuacuucugcgcccggcagaaguucgagagccgcuacacgggcgggcagggcugguacuucgaccucugggggcggggcacccacaucguggucuccagc

SEQ ID NO: 11146 - RNA, 384 nt, Artificial Sequence
  derived and/or modified sequence opt1 from anti-HIV-1_HeavyChain
caggugcagcugguccagagcggcgccgaggugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugcggcaggacgacaccgccacguacuucugcgcccgccagaaguucgagucccgguacagcggcgaccagggguccuacuucgaccucuggggccgcgggacccugaucaucgugagcucc

SEQ ID NO: 11147 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgccaccggaucagccucacccgcgaccgggaccuguucaccgcccacauggacauccgcggccugacgcagggcgacaccgccaccuacuucugcgcccggcagaaguucgagucccgcuacaccgggggccaggggugguacuucgaccucuggggccgggggacgcacaucguggucagcucc

SEQ ID NO: 11148 - RNA, 384 nt, Artificial Sequence
  derived and/or modified sequence opt1 from anti-HIV-1_HeavyChain
caggcccaccuggagcagagcgccuccggcgugaagcgccccggggcgagcguccggguguccugcuggaccagcgaggacaucuucgagcgcuccgagcucaucuacugggugcggcaggccccgggccaggggcuggaguggaucggcugggucaagaccgugacgggggccgugaacuucggcagccuggacuuccgccaccggaucucccucacccgcgaccgggaccuguucaccgcccacauggacauccgcggccugacccagggggacacggccaccuacuucugcgcgcggcagaaguucgagagccgcuacaccggcgggcagggcugguacuucgaccucugggggcggggcacccacaucgucguguccagc

SEQ ID NO: 11149 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucgagucccuguacagcgacgaccagggguccuacuucgaccucuggggccgcgggacccugaucaucgugagcucc

SEQ ID NO: 11150 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucaucuacugggugcgccaggcgccgggccgggggcuggaguggaucggcugggugaagacggucagcgggaccgugaacuucggcuccagcgacuuccgcaaccggaucucccugacccgcgaccgggaccucagcaccgcccacauggacauccgcggccugacgcaggacgacaccgccaccuacuucugcgcccggcagaaguucgagucccuguacagcgacgaccagggguccuacuucgaccucuggggccgcgggacccugaucguggucagcucc

SEQ ID NO: 11151 - RNA, 384 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccuguucaccgcccacauggacauccgggggcucacccagggcgacaccgccacguacuucugcgcgcgccagaaguucgagagccgguacaccgggggccaggggugguacuucgaccuguggggccgcggcacccacaucgugguguccagc

SEQ ID NO: 11152 - RNA, 381 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacauccuccggaaguccgagcugauccacugggugcgccaggcgccggggcagggccuggaguggaucgggugggucaagaccgugacgggcgccgugaacuucggccaccagaucagcgaccgggucucccucacccgcgaccgggaccugagcaccgcccacauggacauccgcgggcugacccaggacgacacggccaccuacuucugcgcccggcagaaguucgagucccucuacagcgacgaccagggcuccuacuucgaccugugggggcgcggcacccugaucaucgugagcucc

SEQ ID NO: 11153 - RNA, 384 nt, Artificial Sequence
  derived and/or modified sequence opt1 from anti-HIV-1_HeavyChain
cccgcccaccuggagcagagcggcuccggggugaagaagccgggcgccagcguccgcguguccugcugggcgagcgaggacaucuucgagcggaccgagcucauccacugggugcgccaggcccccgggcagggccuggaguggaucgggugggucaagaccgugacgggcgccgugaacuucggcucccuggacuuccggcaccgcaucagccucacccgggaccgcgaccuguucaccgcccacauggacauccgggggcugacccagggcgacacggccaccuacuucugcgcgcgccagaaguucgagucccgguacaccgggggccaggggugguacuucgaccucuggggccgcggcacccacaucgucgugagcucc

SEQ ID NO: 11154 - RNA, 384 nt, Artificial Sequence
  derived and/or modified sequence opt1 from anti-HIV-1_HeavyChain
caggcccaccuggagcagagcgccuccggcgugaagcgccccggggcgagcguccggguguccugcuggaccagcgaggacaucuucgagcgcuccgagcucaucuacugggugcggcaggccccgggccaggggcuggaguggaucggcugggucaagaccgugagcggggccgugaacuucggcuccacggacuuccgcgagcggaucagccugucccgcgaccgggaccucagcaccgccuacauggacauccgcggccugacccaggacgacgccgcgaccuacuucugcgcccggcagaaguucgccucccgcuacagcggggaccagggcuccuacuucgaccugugggggcggggcacgcucaucgucgugagcucc

SEQ ID NO: 11155 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccuggaccuccggcaccgcaucucccugacccgggaccgcgaccuguucaccgcccacauggacauccgggggcucacccagggcgacacggccaccuacuucugcgcccgccagaaguucgagagccgguacaccgggggccaggggugguacuucgaccuguggggccgcggcacccacaucgucguguccagc

SEQ ID NO: 11156 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccuggacuuccggcaccgcaucagccucacccgggaccgcgaccuguucaccgcccacauggacauccgggggcugacgcagggcgacaccgccaccuacuucugcgcccgccagaaguucgagucccgguacaccgggggccaggggugguacuucgaccucuggggccgcggcacgcugaucgucgugagcucc

SEQ ID NO: 11157 - RNA, 384 nt, Artificial Sequence
  derived and/or modified sequence opt1 from anti-HIV-1_HeavyChain
agccacgaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgccuacauggacauccgcggccugacccaggacgacacggccaccuacuucugcgcccggcagaaguucgcgucccgcuacagcggcgaccagggguccuacuucgaccucuggggccgggggacccugaucguggucagcucc

SEQ ID NO: 11158 - RNA, 384 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccgugacgggcgccgugaacuucggcucccucgacuuccggcaccgcaucagccugacccgggaccgcgaccuguucaccgcccacauggacauccgggggcucacccagggcgacacggccaccuacuucugcgcgcgccagaaguucgagucccgguacaccgggggccaggggugguacuucgaccuguggggccgcggcacccacaucgucgugagcucc

SEQ ID NO: 11159 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacgcagggcgacaccgccaccuacuucugcgcccgccagaaguucgcgucccgguacagcggggaccagggcuccuacuucgaccugugggggcgcggcacccucaucguggugagcucc

SEQ ID NO: 11160 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccuccagcgacuuccgcaaccggaucucccugagccgcgaccgggaccucuccaccgcccacaugggcauccgcggccugcggcaggacgacaccgccacguacuucugcgcccgccagaaguucgagagccgguacuccggggaccagggcagcuacuucgaccugugggggcgcggcacccucaucaucguguccagc

SEQ ID NO: 11161 - RNA, 384 nt, Artificial Sequence
  derived and/or modified sequence opt1 from anti-HIV-1_HeavyChain
gaggugcagcugguccagagcggcgccgacgugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgccuacauggacauccgcggccugacccaggacgacacggccaccuacuucugcgcccggcagaaguucgcgucccgcuacagcggcgaccagggguccuacuucgaccucuggggccgggggacccugaucguggucagcucc

SEQ ID NO: 11162 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcaccaggcgccggggcagggccuggaguggaucgggugggucaagaccgugacgggcgccgugaacuucggcagccuggacuuccgccaccggaucucccucacccgcgaccgggaccuguucaccgcccacauggacauccgcgggcugacccagggcgacacggccaccuacuucugcgcccggcagaaguucgagagccgcuacaccgggggccaggggugguacuucgaccucuggggccggggcacccacaucgucguguccagc

SEQ ID NO: 11163 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggcccugagcaccgcccacauggacauccgcggccugacccaggacgacacggccaccuacuucugcgcgcggcagaaguucgccucccgcuacagcggcgaccagggguccuacuucgaccucuggggccgggggacccugaucaucgugagcucc

SEQ ID NO: 11164 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucgccagccuggacuuccggaaccgcaucucccucagccgggaccgcgaccuguccaccgccuacauggacauccggggccugacccaggacgacaccgccacguacuucugcgcgcgccagaaguucgccagccgguacuccggggaccagggcagcuacuucgaccucugggggcgcggcacccugaucgucguguccagc

SEQ ID NO: 11165 - RNA, 384 nt, Artificial Sequence
  derived and/or modified sequence opt1 from anti-HIV-1_HeavyChain
caggcccaccuggagcagagcgccuccggcgugcgccggcccggggcgagcguccgcguguccugcuggaccagcgaggacaucuucgagcgguccgagcucaucuacugggugcgccaggccccgggccgggggcuggaguggaucggcuggaucaagcuggucagcggggccgugaacuucgccucccucgacuuccgcaaccggaucagccugucccgcgaccgggaccugagcaccgccuacauggacauccgcggccucacgcaggacgacaccgcgaccuacuucugcgcccggcagaaguucgccucccgcuacagcggcgaccagggguccuacuucgaccuguggggccgggggacccugaucguggucagcucc

SEQ ID NO: 11166 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccuggacuuccggcaccgcaucucccucacccgggaccgcgaccuguucaccgcccacauggacauccgggggcugacccaggacgacacggccaccuacuucugcgcccgccagaaguucgcgagccgguacuccggcgaccaggggagcuacuucgaccucuggggccgcgggacccugaucaucgucuccagc

SEQ ID NO: 11167 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcugggcuggaucgggugggugaagaucgucagcggcaccgugaacuucgccucccuggacuuccgcagccggaucucccucagccgcgaccgggaccuguccaccgccuacauggacauccgcggccugacccaggacgacacggccaccuacuucugcgcccggcagaaguucgcgagccgcuacuccggggaccagggcagcuacuucgaccucugggggcggggcacccugaucguggucuccagc

SEQ ID NO: 11168 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggccaagacggucaccggcgccgugaacuucggcucccuggacuuccggcaccgcaucagccucacccgggaccgcgaccuguucaccgcccacauggacauccgggggcugacgcagggcgacaccgccaccuacuucugcgcgcgccagaaguucgagucccgguacaccgggggccaggggugguacuucgaccucuggggccgcggcacgcacaucguggucagcucc

SEQ ID NO: 11169 - RNA, 384 nt, Artificial Sequence
  derived and/or modified sequence opt1 from anti-HIV-1_HeavyChain
caggcccaccuggagcagagcggcuccgccaugaagaagcccggggcgagcgugcgcgucuccugcuggaccagcgaggacaucuucgagcggaccgagcucaucuacugggugcgccaggccccgggccgggggcuggaguggaucggcugggugaagacggucuccgggaccgugaacuucggcagcuccgacuuccgcaaccggaucagccugacccgcgaccgggaccucuccaccgcccacauggacauccgcggccugacgcaggacgacaccgccaccuacuucugcgcccggcagaaguucgagagccuguacuccgacgaccaggggagcuacuucgaccucuggggccgcgggacccugaucaucguguccagc

SEQ ID NO: 11170 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucggcucccuggacuuccgccaccggaucagccucacccgcgaccgggaccuguucaccgcccacauggacauccgcggccugacgcagggggacaccgccaccuacuucugcgcccggcagaaguucgagucccgcuacaccggcgggcagggcugguacuucgaccucugggggcggggcacgcacaucguggucagcucc

SEQ ID NO: 11171 - RNA, 384 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgacaccacggagcugaucuacugggugcggcaggcgcccgggcagggccuggaguggaucgggugggucaagaucguguccggcaccgugaacuucgccagccucgacuuccgcaaccggaucucccugagccgcgaccgggaccuguccaccgccuacauggacauccgcggccucacccaggacgacacggccaccuacuucugcgcccggcagaaguucgcgagccgcuacuccggggaccagggcagcuacuucgaccugugggggcggggcacccugaucgucguguccagc

SEQ ID NO: 11172 - RNA, 384 nt, Artificial Sequence
  derived and/or modified sequence opt1 from anti-HIV-1_HeavyChain
agccacaaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgccuacauggacauccgcggccugacccaggacgacacggccaccuacuucugcgcccggcagaaguucgcgucccgcuacagcggcgaccagggguccuacuucgaccucuggggccgggggacccugaucguggucagcucc

SEQ ID NO: 11173 - RNA, 384 nt, Artificial Sequence
  derived and/or modified sequence opt1 from anti-HIV-1_HeavyChain
agccacaccuggaacaaccgcggcuccgccaugaagaagcccggggccagcgugcgggucuccugcuggaccagcgaggacaucuucgagcgcacggagcugaucuacugggugcggcaggcgccgggccgcgggcucgaguggaucggcugggugaagaccgucuccgggaccgugaacuucggcagcuccgacuuccggaaccgcaucagccugucccgggaccgcgaccugagcaccgcccacauggacauccggggccucacgcaggacgacaccgccaccuacuucugcgcccgccagaaguucgccucccgguacagcggggaccagggcuccuacuucgaccugugggggcgcggcacccugaucaucgugagcucc

SEQ ID NO: 11174 - RNA, 384 nt, Artificial Sequence
  derived and/or modified sequence opt1 from anti-HIV-1_HeavyChain
agccacaccuggaacgaguccggcagcgccaugaagaagcccggggccuccgugcgcgucagcugcuggaccuccgaggacaucuucgagcggacggagcugaucuacugggugcgccaggcgccgggccgggggcucgaguggaucggcugggugaagaucgucagcgggaccgugaacuucgccucccuggacuuccgcaaccggaucagccugucccgcgaccgggaccucagcaccgccuacauggacauccgcggccugacccaggacgacacggccaccuacuucugcgcccggcagaaguucgcgucccgcuacagcggcgaccagggguccuacuucgaccuguggggccgggggacccucaucguggucagcucc

SEQ ID NO: 11175 - RNA, 384 nt, Artificial Sequence
  derived and/or modified sequence opt1 from anti-HIV-1_HeavyChain
cgccacaccugggagcagagcggcuccggggugaagaagcccggcgccagcguccggguguccugcuggaccagcgaggacaucuucgagcgcacggagcugauccacugggugcggcaggccccggggcagggccucgaguggaucgggugggucaagaccgugaccggcgcggugaacuacggcucccugaacuuccgcagccggaucucccugacccgcgaccgggaccucuucacggcccacauggacauccgcgggcugacccagggcgacaccgccaccuacuucugcgcccggcagaaguucgagagccgcuacaccgggggccaggggugguacuucgaccuguggggccggggcacgcacaucgucguguccagc

SEQ ID NO: 11176 - RNA, 384 nt, Artificial Sequence
  derived and/or modified sequence opt1 from anti-HIV-1_HeavyChain
caggcccaccuggagcagagcggcuccggggugaagaagcccggcgccagcgucaagguguccugcuggaccagcgaggacaucuucgagcgcaccgagcucauccacugggugcggcaggcgccggggcagggccuggaguggaucgggugggucaagacggugaccggcgccgugaacuucggcucccuggacuuccgccaccggaucagccucacccgcgaccgggaccuguucaccgcccacauggacauccgcgggcugacgcagggcgacaccgccaccuacuucugcgcccggcagaaguucgagucccgcuacaccgggggccaggggugguacuucgaccucuggggccggggcacgcacaucgucgugagcucc

SEQ ID NO: 11177 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagggguccgagcucauccacugggugcggcaggcgccgggccaggggcuggaguggaucggcugggucaagaccgugacgggcgccgugaacuucgggagcgccuacuuccgccaccgggucucccugacccgcgaccgggaccucagcaccgccuacauggacauccgcggccugacccaggacgacacggccaccuacuucugcgcgcggcagaaguucgccucccgcuacagcggggaccagggcuccuacuucgaccugugggggcggggcacccucaucguggugagcucc

SEQ ID NO: 11178 - RNA, 384 nt, Artificial Sequence
  derived and/or modified sequence opt1 from anti-HIV-1_HeavyChain
ggccacgaccuggagcagagcggguccggcgugaagaagcccggggccagcguccgcguguccugcuggaccagcgaggacaucuucgagggcuccgagcucauccacugggugcggcaggccccggggcagggccuggaguggaucggcugggucaagaccgugacgggggcggugaacuucggcagcgccuacuuccgccaccggaucucccugagccgcgaccgggaccucuccaccgccuacauggacauccgcgggcugacccaggacgacaccgccacguacuucugcgcccggcagaaguucgcgagccgcuacuccggcgaccaggggagcuacuucgaccuguggggccggggcacccucaucgucguguccagc

SEQ ID NO: 11179 - RNA, 384 nt, Artificial Sequence
  derived and/or modified sequence opt1 from anti-HIV-1_HeavyChain
agccacaccuggaacaaccgcggcuccgccaugaagaagcccggggccagcgugcgggucuccugcuggaccagcgaggacaucuucgacacgaccgagcugaucuacugggugcgccaggcgccgggccaggggcucgaguggaucggcugggugaagaccgucuccgggaccgugaacuucggcagcuccgacuuccggaaccgcaucagccugacgcgggaccgcgaccuguccaccgcccacauggacauccggggccucacccaggacgacaccgccacguacuucugcgcccgccagaaguucgagagccuguacuccgacgaccaggggagcuacuucgaccuguggggccgggggacccucaucaucguguccagc

SEQ ID NO: 11180 - RNA, 384 nt, Artificial Sequence
  derived and/or modified sequence opt1 from anti-HIV-1_HeavyChain
cgccacaccugggagcagagcggcuccggggugaagaagcccggcgccagcguccggguguccugcuggaccagcgaggacaucuucgagcgcacggagcugauccacugggugcggcaggccccggggcagggccucgaguggaucgggugggucaagaccguguccggcgcggugaacuucggcagccccaacuuccgccaccgggucucccugacccgcgaccgggaccuguucaccgcccacauggacauccgcgggcucacgcagggcgacaccgccaccuacuucugcgcccggcagaaguucgagagccgcuacaccgggggccaggggugguacuucgaccuguggggccggggcacgcacaucgugguguccagc

SEQ ID NO: 11181 - RNA, 384 nt, Artificial Sequence
  derived and/or modified sequence opt1 from anti-HIV-1_HeavyChain
agccacaccuggaacaaccgcggcuccgccaugaagaagcccggggccagcgugcgggucuccugcuggaccagcgaggacaucuucgagcgcacggagcugaucuacugggugcggcaggcgccgggccgcgggcucgaguggaucggcugggugaagaccgucuccgggaccgugaacuucggcagcuccgacuuccggaaccgcaucagccugacccgggaccgcgaccuguccacggcccacauggacauccggggccucacccaggacgacaccgccaccuacuucugcgcccgccagaaguucgagagccuguacuccgacgaccaggggagcuacuucgaccuguggggccgggggacgcucaucaucguguccagc

SEQ ID NO: 11182 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugccucgcguccgaggacaucuucgacaccaccgagcugaucuacugggugcggcaggccccgggccaggggcuggaguggaucggcugggugaagaucgucagcgggacggugaacuucgccucccucgacuuccgcaaccggaucagccugucccgcgaccgggaccugagcaccgccuacauggacauccgcggccucacccaggacgacaccgccacguacuucugcgcgcggcagaaguucgccucccgcuacagcggcgaccagggguccuacuucgaccuguggggccgggggacccugaucguggucagcucc

SEQ ID NO: 11183 - RNA, 384 nt, Artificial Sequence
  derived and/or modified sequence opt1 from anti-HIV-1_HeavyChain
cagagccaccuggagcaguccggcgccgccaugaagaagcccggggcgagcgugcgcgucuccugcuggaccagcgaggacaucuucgacaccacggagcucaucuacugggugcggcaggccccgggccaggggcuggaguggaucggcugggugaagaucgucuccgggaccgugaacuucgccagccuggacuuccgcaaccggaucucccucagccgcgaccgggaccuguccaccgcccacauggacauccgcggccugcggcaggacgacaccgccacguacuucugcgcgcgccagaaguucgagagccgguacuccggcgaccaggggagcuacuucgaccucuggggccgcgggacccugaucaucguguccagc

SEQ ID NO: 11184 - RNA, 384 nt, Artificial Sequence
  derived and/or modified sequence opt1 from anti-HIV-1_HeavyChain
cgccacaccugggagcagagcggcuccggggugaagaagcccggcgccagcguccggguguccugcuggaccagcgaggacaucuucgagaaguccgagcugauccacugggugcgccaggccccggggcagggccucgaguggaucgggugggucaagacggugaccggcgcggugaacuucggcagcuccgacuuccggcagcgcgucagccugacccgggaccgcgaccuguucaccgcccacauggacauccgggggcucacgcagggcgacaccgccaccuacuucugcgcccgccagaaguucgagucccgguacaccgggggccaggggugguacuucgaccuguggggccgcggcacgcacaucguggugagcucc

SEQ ID NO: 11185 - RNA, 384 nt, Artificial Sequence
  derived and/or modified sequence opt1 from anti-HIV-1_HeavyChain
agccacaccuggaacgaguccggcagcgccaugaagaagcccggggccuccgugcgcgucagcugcuggaccuccgaggacaucuucgacacgaccgagcugaucuacugggugcggcaggcgccgggccaggggcucgaguggaucggcugggugaagaucgucagcgggaccgugaacuucgccucccuggacuuccgcaaccggaucagccugucccgcgaccgggaccucagcaccgccuacauggacauccgcggccugacgcaggacgacaccgccaccuacuucugcgcccggcagaaguucgcgucccgcuacagcggcgaccagggguccuacuucgaccuguggggccgggggacccucaucguggucagcucc

SEQ ID NO: 11186 - RNA, 384 nt, Artificial Sequence
  derived and/or modified sequence opt1 from anti-HIV-1_HeavyChain
cgccacaccuggaacgagagcggcuccggggugaagaagcccggcgccagcguccggguguccugcuggagcuccgaggacaucuucgagcgcaccgagcugauccacugggugcggcaggccccggggcgcggccucgaguggaucgggugggucaagacggugagcggcaccgugaacuucggcuccagcgacuuccggaaccgcaucucccugacccgggaccgcgaccugagcaccgcgcacauggacauccgggggcucacgcaggacgacaccgccaccuacuucugcgcccgccagaaguucgagucccuguacagcgacgaccagggcuccuacuucgaccugugggggcggggcacccucaucaucgucagcucc

SEQ ID NO: 11187 - RNA, 384 nt, Artificial Sequence
  derived and/or modified sequence opt1 from anti-HIV-1_HeavyChain
cagagccaccuggagcaguccggcagcgagaugaagaagcccggggccuccgugcgcgucagcugcuggaccuccgaggacaucuucgacaccacggagcucaucuacugggugcggcaggccccgggccaggggcuggaguggaucggcugggugaagaucgucagcgggaccgugaacuucgcgucccuggacuuccgcaaccggaucagccucucccgcgaccgggaccugagcaccgccuacauggacauccgcggccugacccaggacgacacggccaccuacuucugcgcccggcagaaguucgccucccgcuacagcggcgaccagggguccuacuucgaccucuggggccgggggacccugaucguggucagcucc

SEQ ID NO: 11188 - RNA, 384 nt, Artificial Sequence
  derived and/or modified sequence opt1 from anti-HIV-1_HeavyChain
cgccacaccugggagcagagcggcuccggggugaagaagcccggcgccagcguccggguguccugcuggaccagcgaggacaucuucgagcgcacggagcugauccacugggugcggcaggccccggggcagggccucgaguggaucgggugggucaagaccgugaccggcaccgugaacuucggcucccugaacuuccgccagcgggucagccugacgcgcgaccgggaccucuucaccgcgcacauggacauccgcgggcugacccagggcgacaccgccacguacuucugcgcccggcagaaguucgagucccuguacagcgacgaccagggguccuacuucgaccucuggggccgcgggacccugaucaucgugagcucc

SEQ ID NO: 11189 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcgguccgagcucauccacugggugcgccaggcgccggggcagggccuggaguggaucgggugggucaagaccgugacgggcgccgugaacuucggcagccagaucuuccggcaccgcaucucccugacccgggaccgcgaccucuucaccgcccacauggacauccgggggcugacccagggcgacacggccaccuacuucugcgcccgccagaaguucgagagccgguacaccgggggccaggggugguacuucgaccuguggggccgcggcacccacaucgucguguccagc

SEQ ID NO: 11190 - RNA, 384 nt, Artificial Sequence
  derived and/or modified sequence opt1 from anti-HIV-1_HeavyChain
agccacaccuggaacaaguccggcagcgccaugaagaagcccggggccuccgugcgcgucagcugcuggaccuccgaggacaucuucgagcggacggagcugaucuacugggugcgccaggcgccgggccgggggcucgaguggaucggcugggugaagaccgucagcgggaccgugaacuucggcuccagcgacuuccgcaaccggaucucccugacccgcgaccgggaccugagcacggcccacauggacauccgcggccucacccaggacgacaccgccaccuacuucugcgcccggcagaaguucgagucccuguacagcgacgaccagggguccuacuucgaccuguggggccgcgggacgcucaucaucgugagcucc

SEQ ID NO: 11191 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccagaucuuccggcaccgcaucucccugacccgggaccgcgaccucuucaccgcccacauggacauccgggggcugacccagggcgacacggccaccuacuucugcgcccgccagaaguucgagagccgguacaccgggggccaggggugguacuucgaccuguggggccgcggccccacccucuucgucuccagc

SEQ ID NO: 11192 - RNA, 384 nt, Artificial Sequence
  derived and/or modified sequence opt1 from anti-HIV-1_HeavyChain
caggcccaccuggagcagagcgccuccggcgugcgccggcccggggcgagcguccgcguguccugcuggaccagcgaggacaucuucgagcgguccgagcucaucuacugggugcgccaggccccgggccgggggcuggaguggaucggcuggaucaagaccugcagcggggccgucaacuucggcuccguggacuuccgcgaccgggugagccugacgcgcgaccgggaccucuucaccgcccacauggacauccgcggccugacccagggggacaccgccacguacuucugcgcgcggcagaaguucgagucccgcuacaccggcgggcagggcugguacuucgaccugugggggcggggcacccacaucgucgugagcucc

SEQ ID NO: 11193 - RNA, 384 nt, Artificial Sequence
  derived and/or modified sequence opt1 from anti-HIV-1_HeavyChain
agccacaccguggagcaguccggcagcgccaugaagaagcccggggccuccguccgcgugagcugcuggaccuccgaggacaucuucgacacgaccgagcugaucuacugggugcggcaggcgccgggccaggggcucgaguggaucggcugggucaagaucgugagcgggaccgugaacuucgccucccuggacuuccgcaaccggaucagccugucccgcgaccgggaccucagcaccgccuacauggacauccgcggccugacgcaggacgacaccgccaccuacuucugcgcccggcagaaguucgcgucccgcuacagcggcgaccagggguccuacuucgaccuguggggccgggggacccucaucgucgugagcucc

SEQ ID NO: 11194 - RNA, 384 nt, Artificial Sequence
  derived and/or modified sequence opt1 from anti-HIV-1_HeavyChain
cgccacaccuggaacaagagcggcuccggggugaagaagcccggcgccagcguccggguguccugcuggagcuccgaggacaucuucgagcgcaccgagcugauccacugggugcggcaggccccggggcagggccucgaguggaucgggugggucaagacggugaccggcgcggugaacuucggcagccuggacuuccgccaccggaucucccugacccgcgaccgggaccucuucaccgcccacauggacauccgcgggcugacgcagggcgacaccgccaccuacuucugcgcccggcagaaguucgagagccgcuacaccgggggccaggggugguacuucgaccuguggggccggggcacgcacaucgucguguccagc

SEQ ID NO: 11195 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagcggcuggaguggaucggcugggucaagacggugaccggggccgugaacuucggcucccccaacuuccgccaccgggucagccugacccgcgaccgggaccucuccaccgccuacauggacauccgcggccugacgcaggacgacaccgccaccuacuucugcgcccggcagaaguucgcgagccgcuacuccggggaccagggcagcuacuucgaccugugggggcggggcacccucaucgugguguccagc

SEQ ID NO: 11196 - RNA, 384 nt, Artificial Sequence
  derived and/or modified sequence opt1 from anti-HIV-1_HeavyChain
agccacgaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugcggcaggacgacaccgccacguacuucugcgcccgccagaaguucgagucccgguacagcggcgaccagggguccuacuucgaccucuggggccgcgggacccugaucaucgugagcucc

SEQ ID NO: 11197 - RNA, 384 nt, Artificial Sequence
  derived and/or modified sequence opt1 from anti-HIV-1_HeavyChain
cgccacaccuggaacgagagcggcuccggggugaagaagcccggcgccagcguccggguguccugcuggagcuccgaggacaucuucgagcgcaccgagcugauccacugggugcggcaggccccggggcagggccucgaguggaucgggugggucaagacggugaccggcgcggugaacuucggcagccuggacuuccgccaccggaucucccugacccgcgaccgggaccucuucaccgcccacauggacauccgcgggcugacgcagggcgacaccaccaccuacuucugcgcccggcagaaguucgagagccgcuacaccgggggccaggggugguacuucgaccuguggggccggggcacgcacaucgucguguccagc

SEQ ID NO: 11198 - RNA, 384 nt, Artificial Sequence
  derived and/or modified sequence opt1 from anti-HIV-1_HeavyChain
cgccacaccugggagcaggucuggagcggcgugaagaagcccggggccuccgugcgggugagcugcugguccagcgaggacaucuucgagcgcaccgagcugauccacuggguccggcaggccccgggccaggggcucgaguggaucggcugggugaagacggugaccggggcggucaacuucggcucccuggacuuccgccaccggaucagccugacccgcgaccgggaccucuucaccgcccacauggacauccgcggccugacgcagggggacaccgccaccuacuucugcgcccggcagaaguucgagucccgcuacaccggcgggcagggcugguacuucgaccugugggggcggggcacgcacaucguggugagcucc

SEQ ID NO: 11199 - RNA, 384 nt, Artificial Sequence
  derived and/or modified sequence opt1 from anti-HIV-1_HeavyChain
cagagccaccuggagcaguccggcagcgccaugaagaagcccggggccuccgugaccgucagcugcuggaccuccgaggacaucuucgacacgaccgagcucaucuacugggugcgccaggcgccgggccaggggcuggaguggaucggcugggugaagaucgucagcgggaccgugaacuucgccucccuggacuuccggaaccgcaucagccucucccgggaccgcgaccugagcaccgccuacauggacauccggggccugacgcaggacgacaccgccaccuacuucugcgcccgccagaaguucgcgucccgguacagcggcgaccagggguccuacuucgaccucuggggccgcgggacccugaucguggucagcucc

SEQ ID NO: 11200 - RNA, 384 nt, Artificial Sequence
  derived and/or modified sequence opt1 from anti-HIV-1_HeavyChain
cgccacgaccuggagcagagcggcuccggggugaagaagcccggcgccagcguccggguguccugcuggagcuccgaggacaucuucgagcgcaccgagcucauccacugggugcggcaggccccggggcagggccuggaguggaucgggugggucaagaccgugacgggcgcggugaacuucggcagccuggacuuccgccaccggaucucccucacccgcgaccgggaccuguucaccgcccacauggacauccgcgggcugacccagggcgacacggccaccuacuucugcgcccggcagaaguucgagagccgcuacaccgggggccaggggugguacuucgaccucuggggccggggcacccacaucgucguguccagc

SEQ ID NO: 11201 - RNA, 384 nt, Artificial Sequence
  derived and/or modified sequence opt1 from anti-HIV-1_HeavyChain
gugaccaccuggaacaagagcggcuccgccaugaagaagcccggggccagcguccgcguguccugcuggacgagcgaggacaucuucgacaccaccgagcugaucuacugggugcggcaggcgccgggccgcgggcucgaguggaucggcugggucaagaccguguccgggacggugaacuucggcagcuccgacuuccggaaccgcaucagccugacccgggaccgcgaccuguccaccgcccacauggacauccggggccucacccaggacgacacggccaccuacuucugcgcccgccagaaguucgagagccuguacuccgacgaccaggggagcuacuucgaccuguggggccgggggacccucaucaucgucuccagc

SEQ ID NO: 11202 - RNA, 384 nt, Artificial Sequence
  derived and/or modified sequence opt1 from anti-HIV-1_HeavyChain
cgccacaccuggaacaacaccggcagcggggugaagaagcccggcgccuccguccgggugagcugccuggccuccgaggacaucuucgagcgcacggagcucauccacugggugcggcaggcgccggggcagggccuggaguggaucgggugggucaagaccgugaccggcgccgugaacuucggcagccuggacuuccgccaccggaucucccucacccgcgaccgggaccuguucacggcccacauggacauccgcgggcugacccagggcgacaccgccaccuacuucugcgcccggcagaaguucgagagccgcuacaccgggggccaggggugguacuucgaccucuggggccggggcacgcacaucgucguguccagc

SEQ ID NO: 11203 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugccucgcguccgaggacaucuucgagcggaccgagcugaucuacugggugcgccaggccccgggccgggggcccgaguggaucggcugggugaagaccgucagcgggacggugaacuucggcuccagcgacuuccgcaaccggaucucccugacccgcgaccgggaccucagcaccgcccacauggacauccgcggccugacccaggacgacacggccaccuacuucugcgcccggcagaaguucgagucccuguacagcgacgaccagggguccuacuucgaccucuggggccgcgggacccugaucaucgugagcucc

SEQ ID NO: 11204 - RNA, 384 nt, Artificial Sequence
  derived and/or modified sequence opt1 from anti-HIV-1_HeavyChain
cgccacaccuggaacaacaccggcagcggggugaagaagcccggcgccuccguccgggugagcugcuggacguccgacgacaucuucgagcgcaccgagcugauccacugggugcggcaggccccggggcagggccucgaguggaucgggugggucaagaccgugagcggcaccgugaacuucgcgucccuggacuuccgcaaccggaucagccugucccgcgaccgggaccucagcacggccuacauggacauccgcggccugacccaggacgacaccgccaccuacuucugcgcccggcagaaguucgccucccgcuacagcggggaccagggcuccuacuucgaccugugggggcggggcacgcucaucgucgugagcucc

SEQ ID NO: 11205 - RNA, 384 nt, Artificial Sequence
  derived and/or modified sequence opt1 from anti-HIV-1_HeavyChain
ggcacccccgggaacaagagcggcuccggggugaagaagccgggcgccagcguccgcguguccugcuggagcuccgaggacaucuucgagcggaccgagcugauccacugggugcgccaggcccccgggcagggccucgaguggaucggcugggucaagacggugaccggggcggugaacuucggcagccuggacuuccggcaccgcaucucccugacccgggaccgcgaccucuucaccgcccacauggacauccgggggcugacgcagggcgacaccgccaccuacuucugcgcccgccagaaguucgagagccgguacaccgggggccagggcugguacuucgaccugugggggcgcggcacgcacaucgucguguccagc

SEQ ID NO: 11206 - RNA, 384 nt, Artificial Sequence
  derived and/or modified sequence opt1 from anti-HIV-1_HeavyChain
ggcacccccgggagcgaguccggcagcggggugaagcgcccgggcgccuccguccgggugagcugcuggaccuccgaggacaucuucgagacgaccgagcugauccacugggugcgccaggcccccgggcagggccucgaguggaucggcugggucaagaccgugagcggggcggugaacuucggcucccugaacuuccggcaccgcgucagccugacccgggaccgcgaccucuucacggcccacauggacauccgggggcugacccagggcgacaccgccaccuacuucugcgcccgccagaaguucgagucccgguacaccgggggccagggcugguacuucgaccugugggggcgcggcacgcacaucguggugagcucc

SEQ ID NO: 11207 - RNA, 384 nt, Artificial Sequence
  derived and/or modified sequence opt1 from anti-HIV-1_HeavyChain
gugacccccggcaccaaccuggggcuccgcaugaagaagccgggcgccagcguccggguguccugcuggacgagcgaggacaucuucgacaccaccgagcugaucuacugggugcgccaggcccccgggcagggccuggaguggaucgggugggucaagaucguguccggcaccgugaacuucgcgagccucgacuuccggaaccgcaucucccugagccgggaccgcgaccuguccacggccuacauggacauccggggccucacccaggacgacaccgccaccuacuucugcgcccgccagaaguucgccagccgguacuccggggaccagggcagcuacuucgaccugugggggcgcggcacgcugaucgucguguccagc

SEQ ID NO: 11208 - RNA, 384 nt, Artificial Sequence
  derived and/or modified sequence opt1 from anti-HIV-1_HeavyChain
cgccacgaccuggagcagagcggcgccggggugaagaagcccggcgccuccguccgggugagcugcugguccagcgaggacaucuucgagcgcaccgagcucauccacugggugcggcaggcgccggggcagggccuggaguggaucgggugggucaagaccgugacgggcgccgugaacuucggcucccuggacuuccgccaccggaucagccucacccgcgaccgggaccuguucaccgcccacauggacauccgcgggcugacccagggcgacacggccaccuacuucugcgcccggcagaaguucgagucccgcuacaccgggggccaggggugguacuucgaccucuggggccggggcacccacaucgucgugagcucc

SEQ ID NO: 11209 - RNA, 384 nt, Artificial Sequence
  derived and/or modified sequence opt1 from anti-HIV-1_HeavyChain
caggugcaccuggagcagagcggcuccggggucaagaagcccggcgccagcgugcgcguguccugcuggaccagcgaggacaucuucgagaaguccgagcucauccacuggguccggcaggccccggggcagggccuggaguggaucgggugggugaagaccgugacgggcgcggucaacuucggcagcuccgacuuccgccagcgggugagccugacccccgaccgcgaccucuucaccgcccacauggacauccgggggcugacccagggcgacacggccaccuacuucugcgcccgccagaaguucgagucccgguacaccgggggccaggggugguacuucgaccuguggggccgcggcacccacaucguggucagcucc

SEQ ID NO: 11210 - RNA, 384 nt, Artificial Sequence
  derived and/or modified sequence opt1 from anti-HIV-1_HeavyChain
ggcaccaccugggagcagagcggguccggcgugaagaagcccggggccagcguccgcguguccugcuggacgagcgaggacaucuucgagaaguccgagcugauccacugggugcggcaggccccgggccaggggcucgaguggaucggcugggucaagaccgugaccggcgcggugaacuucgggagccuggacuuccgccaccggaucucccugacccgcgaccgggaccucuucacggcccacauggacauccgcggccugacccagggggacaccgccaccuacuucugcgcccggcagaaguucgagagccgcuacacgggcgggcagggcugguacuucgaccuguggggccgggggacccacaucgucguguccagc

SEQ ID NO: 11211 - RNA, 384 nt, Artificial Sequence
  derived and/or modified sequence opt1 from anti-HIV-1_HeavyChain
agccacgaccuggagcaguccggcagcgaguggaagaagcccggggccuccgugcgcgucagcugcuggaccuccgaggacaucuucgacaccacggagcucauccacugggugcggcaggccccgggccaggggcuggaguggaucggcugggugaagaccgucaccggggcggugaacuucggcagccuggacuuccgccaccggaucucccucacccgcgaccgggaccuguucacggcccacauggacauccgcggccugacccagggggacaccgccaccuacuucugcgcccggcagaaguucgagagccgcuacacgggcgggcagggcugguacuucgaccucugggggcggggcacccacaucguggucuccagc

SEQ ID NO: 11212 - RNA, 384 nt, Artificial Sequence
  derived and/or modified sequence opt1 from anti-HIV-1_HeavyChain
cagagccgccccggcaacaaguccgggagcgccaugaagaagccgggcgccuccgugcgggucagcugcuggaccuccgaggacaucuucgagcgcaccgagcugcucugggugcggcaggcgcccgggcgcggccuggaguggaucgggugggugaagacggucagcggcaccgugaacuucggcuccagcgacuuccggaaccgcaucucccugacccgggaccgcgaccucagcaccgcccacauggacauccgggggcugacgcaggacgacaccgccaccuacuucugcgcccgccagaaguucgagucccuguacagcgacgaccagggcuccuacuucgaccucugggggcggggcacccugaucaucgugagcucc

SEQ ID NO: 11213 - RNA, 384 nt, Artificial Sequence
  derived and/or modified sequence opt1 from anti-HIV-1_HeavyChain
ggcaccaccuggagcaaguccgggagcggcgugaagaagcccggggccuccguccgcgugagcugcuggacguccgaggacaucuucgagcggaccgagcugaucuacugggugcgccaggccccgggccaggggcucgaguggaucggcugggucaagaucgugagcggcaccgugaacuucgcgucccuggacuuccggaaccgcaucagccugucccgggaccgcgaccucagcaccgcccacauggacauccgggggcugacgcaggacgacaccgccaccuacuucugcgcccgccagaaguucgccucccgguacagcggcgaccagggguccuacuucgaccuguggggccgcgggacccucaucaucgucagcucc

SEQ ID NO: 11214 - RNA, 387 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacauccuccggaagaagcgcguggacuccgucgggugcgacaccgcgccgggccaggggcuggaguggaucggcugggugaagacggugaccggcgccgucaacuucgggagcuccgacuuccggcagcgcgugagccugacccgggaccgcgaccucuucaccgcccacauggacauccggggccugacgcaggacgacaccgccaccuacuucugcgcccgccagaaguucgcgucccgguacagcggggaccagggcuccuacuucgaccugugggggcgcggcacccucaucguggucagcucc

SEQ ID NO: 11215 - RNA, 387 nt, Artificial Sequence
  derived and/or modified sequence opt1 from anti-HIV-1_HeavyChain
aaggcccaccugggcaacaagagcggguccggcgugaagaagcccggggccagcguccgcguguccugcuggagcuccgaggacaucuucgagcggaccgagcucauccacugggugcgccaggcgccgggccaggggcuggaguggaucggcugggucaagaccgugacgggcgccgugaacuucgggagccuggacuuccggcaccgcaucucccucacccgggaccgcgaccuguucaccgcccacauggacauccggggccugacccagggggacacggccaccuacuucugcgcccgccagaaguucgagagccgguacaccggcgggcagggcugguacuucgaccucuggggccgcgggacccacaucgucguguccagc

SEQ ID NO: 11216 - RNA, 384 nt, Artificial Sequence
  derived and/or modified sequence opt1 from anti-HIV-1_HeavyChain
accaccgugggcacgauccuggggcgcgccaugaagaagcccggcgccagcguccggguguccugcuggaccagcgaggacaucuucgacaccaccgagcucaucuacugggugcgccaggcgccggggcagggccuggaguggaucgggugggucaagaucguguccggcacggugaacuucgccagccuggacuuccggaaccgcaucucccucagccgggaccgcgaccuguccaccgccuacauggacauccggggccugacccaggacgacaccgccacguacuucugcgcccgccagaaguucgcgagccgguacuccggggaccagggcagcuacuucgaccucugggggcgcggcacccugaucgucguguccagc

SEQ ID NO: 11217 - RNA, 384 nt, Artificial Sequence
  derived and/or modified sequence opt1 from anti-HIV-1_HeavyChain
cagagccaccuggagcaguccggcagcgccaugaagaagcccggggccuccgugaaggucagcugcuggaccuccgaggacaucuucgacaccacggagcucaucuacugggugcgccaggcgccgggccaggggcuggaguggaucggcugggugaagaucgucagcgggaccgugaacuucgccucccuggacuuccggaaccgcaucagccucucccgggaccgcgaccugagcaccgccuacauggacauccggggccugacccaggacgacacggccaccuacuucugcgcccgccagaaguucgcgucccgguacagcggcgaccagggguccuacuucgaccucuggggccgcgggacccugaucguggucagcucc

SEQ ID NO: 11218 - RNA, 387 nt, Artificial Sequence
  derived and/or modified sequence opt1 from anti-HIV-1_HeavyChain
cagagccaccuggagcaggucugggugugccaguccaagaagcccggcgccagcgugcgcguguccugcuggaccagcgaggacaucuucgacaccacggagcucaucuacuggguccggcaggccccggggcagggccuggaguggaucgggugggugaagaucguguccggcaccgucaacuucgcgagccuggacuuccgcaaccggaucucccucagccgcgaccgggaccuguccaccgcccacauggacauccgcgggcugacccaggacgacacggccaccuacuucugcgcccggcagaaguucgccagccgcuacuccggcgaccagggcagcuacuucgaccucugggggcggggcacccugaucaucguguccagc

SEQ ID NO: 11219 - RNA, 384 nt, Artificial Sequence
  derived and/or modified sequence opt1 from anti-HIV-1_HeavyChain
cgccacaccguggagcagagcggcuccggggucaagaagcccggcgccagcgugcggguguccugcuggagcuccgaggacaucuucgagcgcaccgagcugauccacuggguccggcaggccccggggcagggccucgaguggauggggugggugaagacggugaccggcgcggucaacuucggcagccuggacuuccgccaccggaucucccugacccgcgaccgggaccucuucaccgcccacauggacauccgcgggcugacgcagggcgacaccgccaccuacuucugcgcccggcagaaguucgagagccgcuacaccgggggccaggggugguacuucgaccuguggggccggggcacgcacaucgugguguccagc

SEQ ID NO: 11220 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuccgcgcgggaggacaucuucgacaccaccgagcucaucuacugggugcgccaggccccgggccaggggcuggaguggaucggcugggugaagaucgucugcgggacggugaacuucgccagccuggacuuccggaaccgcaucucccucagccgggaccgcgaccuguccaccgcccacauggacauccggggccugacccaggacgacaccgccacguacuucugcgcgcgccagaaguucgccagccgguacuccggcgaccaggggagcuacuucgaccucuggggccgcgggacccugaucaucguguccagc

SEQ ID NO: 11221 - RNA, 387 nt, Artificial Sequence
  derived and/or modified sequence opt1 from anti-HIV-1_HeavyChain
gaggugcagcgcggcgggcgggucgugggccgcgacgugaagaagcccggggccagcguccggguguccugcuggaccagcgaggacaucuuccacaccgagcugaucuacugggugcgccaggccccgggccaggggcucgaguggaucggcugggucaagaucguguccggcacggugaacuucgcgagccuggacuuccggaaccgcaucucccugagccgggaccgcgaccucuccaccgccuacauggacauccgggggcugacccaggacgacaccgccacguacuucugcgcccgccagaaguucgccagccgguacuccggcgaccaggggagcuacuucgaccuguggggccgcgggacccucaucgucguguccagc

SEQ ID NO: 11222 - RNA, 384 nt, Artificial Sequence
  derived and/or modified sequence opt1 from anti-HIV-1_HeavyChain
ggcaccaccuggaacgagagcggguccggcgugaagaagcccggggccagcguccgcgugccgugcugguccagcgaggacaucuucgagcggacggagcugauccaccgcgugcggcaggcccccggccaggggcucgaguggaucggcugggucaagaccgugaccggcgcggugaacuucgggucccccaacuuccgccaccggaucagccugacccgcgaccgggaccuguucacggcccacauggacauccgcggccucacccagggggacaccgccaccuacuucugcgcccggcagaaguucgagucccgcuacacgggcgggcagggcugguacuucgaccuguggggccgggggacccacaucgucgugagcucc

SEQ ID NO: 11223 - RNA, 384 nt, Artificial Sequence
  derived and/or modified sequence opt1 from anti-HIV-1_HeavyChain
cgcagcaacugggugcaguccggcgccgacgucaagaagcccggggccagcgugaaguccagcugcuggaccuccgaggacaucuucgacaccacggagcugaucuacugggugcggcaggcgccgggccaggggcucgaguggaucggcugggucaagaucgugagcgggaccgugaacuucgccucccuggacuuccgcaaccggaucagccugucccgcgaccgggaccucagcaccgccuacauggacauccgcggccugacccaggacgacacggccaccuacuucugcgcccggcagaaguucgcgucccgcuacagcggcgaccagggguccuacuucgaccuguggggccgggggacccucaucgucgugagcucc

SEQ ID NO: 11224 - RNA, 384 nt, Artificial Sequence
  derived and/or modified sequence opt1 from anti-HIV-1_HeavyChain
cccgugcagcugguccagagcggcgccgaggugaagaagccgggggccuccgugaaggucagcugcuggaccuccgaggacaucuucgagcgcaccgagcucauccacugggugcggcaggcgcccggccaggggcuggaguggaucggcugggugaagacggucaccggggccgugaacuucggcagccuggacuuccgccaccggaucucccucacccgcgaccgggaccuguucaccgcccacauggacauccgcggccugacgcagggggacaccgccaccuacuucugcgcccggcagaaguucgagagccgcuacaccggcgggcagggcugguacuucgaccucugggggcggggcacgcacaucguggucuccagc

SEQ ID NO: 11225 - RNA, 399 nt, Artificial Sequence
  derived and/or modified sequence opt1 from anti-HIV-1_HeavyChain
cgcgaguaccuggagcagagcggcgggggcgugaagaagcucggggccuccguccgggugagcugccgcgccuccgaggaccuguucggcgacgaggcgaucuacgacgacgagcugauccacuggcuccgccaggugcccgggcagcggccggaguggaugggcuggauccggcccaagaccggcgcccgcaaccaggcccggcaguuccagccccgcaucaaccugagccgggaccgcgcccugaacaccgccuaccucgaccuguccagccugacguccgcggacagcgccaccuacuucugcgcccggcagaccuucaagcccgacuucuacuucgccgaccaggggugguccuucaaccucuggggccgcggggcgcgggucaucgugagcucc

SEQ ID NO: 11226 - RNA, 399 nt, Artificial Sequence
  derived and/or modified sequence opt1 from anti-HIV-1_HeavyChain
caggugcagcugguccagagcggcaccgaggugaagaagcccggggccucccuccgcgugagcugccgggccuccgaggaccuguucggcgacaagaucaucuacgacgacgaggucauccacuggcugcgccagcucccggggcagcggcccgaguggaugggcuggauccgccccaagagcggggcgcggaaccaggcccgccaguuccagccccggaucucccugacccgcgaccgggcccugagcacggccuaccucgaccugaacucccugaccagcgccgacuccggcaccuacuucugcgcgcgccagaccuucaagccggacuucuacuucgccgaccagggcuggagcuucaaccucugggggcggggcgcccacuucaucguguccagc

SEQ ID NO: 11227 - RNA, 399 nt, Artificial Sequence
  derived and/or modified sequence opt1 from anti-HIV-1_HeavyChain
caggcccaccuggagcagagcggcuccggggugaagaagcccggcgccagcguccggguguccugccgggcgagcgaggaccucuucggggacgagaucaucuacgacgacgaggugauccacuggcugcgccaggucccgggccagcggcccgaguggaugggguggauccgccccaagaccggcgcccggaaccaggcccgccaguuccagccccggaucucccugacccgcgaccgggcccucagcacggccuaccuggaccugaacucccucaccagcgcggacuccggcaccuacuucugcgcccgccagaccuucaagccggacuucuacuucgccgaccagggguggagcuucaaccuguggggccgcggggcccacuucaucguguccagc

SEQ ID NO: 11228 - RNA, 399 nt, Artificial Sequence
  derived and/or modified sequence opt1 from anti-HIV-1_HeavyChain
ggcaacaucuggagcgaguccgggggcggggugaagaagcccggcgccagcguccgcguguccugccgggccagcgaggaccuguucggggacgagaucaucuacgacgacgaggugauccacuggcuccgccaggucccgggccagcggcccgaguggaugggcuggauccgccccaagaacgggggccggaaccaggcgcgccaguuccagccccggaucucccugacccgcgaccgggcccugaacaccgccuaccucgaccugaacagccugacguccgccgacagcgggaccuacuucugcgcccgccagaccuucaagccggacuucuacuucgcggaccagggcugguccuucaaccucugggggcggggcgcccgcgugaucgugagcucc

SEQ ID NO: 11229 - RNA, 399 nt, Artificial Sequence
  derived and/or modified sequence opt1 from anti-HIV-1_HeavyChain
caggugcagcugguccagagcggcgccgaggugaagaagcccggggccucccuccgcgugccgugccgggcgagcgaggaccuguucggcgacgagaucaucuacgacgacgaggucauccacuggcugcgccaggugcccgggcagcggcccgaguggaugggcuggauccgccccaagaccggggcccggaaccaggcccgccaguuccagccgcggaucucccucacccgcgaccgggcccugagcacggccuaccuggaccucaacucccugaccagcgcggacuccggcaccuacuucugcgcccgccagaccuucaagcccgacuucuacuucgccgaccagggcuggagcuucaaccugugggggcggggcgcccacuucaucguguccagc

SEQ ID NO: 11230 - RNA, 390 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagaucguguccggcgccgugaacuucggcagccccaacuuccggcagcgcgucucccugacgcgggaccgcgaccucuucaccgcccacauggacauccgggggcugacccagggcgacaccgccacguacuucugcgcccgccagaaguucgagcgcgggggccagggguggaucuucgaccuguggggccggggcacccucaucgcggugagcuccgccagccgguccgcc

SEQ ID NO: 11231 - RNA, 393 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccugagcaccgcccacauggacauccgggggcucacccaggacgacaccgccacguacuucugcgcgcgccagaaguucgcccggggcgaccaggggugguucuucgaccuguggggccgcgggacccugaucgugguguccagcgccuccacccggagcacc

SEQ ID NO: 11232 - RNA, 414 nt, Artificial Sequence
  derived and/or modified sequence opt1 from anti-HIV-1_HeavyChain
caggugcagcugguccagagcggcgccgaggugaagaagcccggggccuccgugaccgucagcugcaaggcgucccgcuacaccuucaucaacuacuacauccacugggugcggcaggccccgggccaggggcucgaguggaucggcugggugaagcccgucagcggggccgugaacuucggcucccccaacuuccgccaccgggugagccugacgcgcgaccgggaccuguucaccgcccacauggacauccgcggccucacccagggggacaccgccacguacuucugcgcgcggcagaaguucgcccgcggcgaccaggggugguucuucgaccuguggggccgggggacccugaucgucguguccagcgccuccaccaagggccccagcguguucccgcacgaccuccgc

SEQ ID NO: 11233 - RNA, 414 nt, Artificial Sequence
  derived and/or modified sequence opt1 from anti-HIV-1_HeavyChain
caggugcagcugguccagagcggcgccgaggugaagaagcccggggccuccgugaaggucagcugcaaggcguccggcuacaccaucacccgccacuacaugcacugggugcggcaggccccggggcagggccucgaguggaucgggugggugaagacggucaccggcgccgugaacuucggcagccccaacuuccgccaccgggugucccugacccgcgaccgggaccuguucaccgcccacauggacauccgcgggcucacgcagggcgacaccgccaccuacuucugcgcgcggcagaaguucgagcgcgggggccaggggugguacuucgaccuguggggccggggcacccugaucgucgugagcuccgccagcacgaaggggcccuccguguucccccacgaccuccgc

SEQ ID NO: 11234 - RNA, 408 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagccccaacuuccgccaccgggucucccugacccgcgaccgggaccucuucaccgcccacauggacauccgcgggcugacccagggcgacacggccaccuacuucugcgcccggcagaaguacuacgccgggggccaggggugguacuucgaccuguggggccgcggcacccucaucguggugagcuccgcgagcaccaaggggcccuccgacgaccugcgg

SEQ ID NO: 11235 - RNA, 411 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagaucguguccggcgccgugaacuucggcagccccaacuuccggcagcgcgucucccugacgcgggaccgcgaccucuucaccgcccacauggacauccgggggcugacccagggcgacaccgccacguacuucugcgcccgccagaaguucgagcgcgggggccagggguggaucuucgaccuguggggccggggcacccucaucgcggugagcuccgccagcaccaaggggcccuccguguacgaccugcgg

SEQ ID NO: 11236 - RNA, 417 nt, Artificial Sequence
  derived and/or modified sequence opt1 from anti-HIV-1_HeavyChain
caggugcagcugguccagagcggcuccggggugaagaagcccggcgccagcgugcgcgucuccugcuggaccagcgaggacaucuucgagcggaccgagcucauccacugggugcgccaggccccggggcagggccuggaguggaucgggugggugaagacggucuccggcgcggugaacuucggcagccccaacuuccggcaccgcgugucccugacccgggaccgcgaccucuucaccgcccacauggacauccgggggcugacccagggcgacacggccaccuacuucugcgcccgccagaaguucgagcgcgggggccaggggugguacuucgaccuguggggccggggcacccucaucgucgugagcuccgccagcaccaaggggcccuccguguucccccacgaccugcgg

SEQ ID NO: 11237 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagccccaacuuccgccaccgggucucccugacccgcgaccgggaccucuucaccgcccacauggacauccgcgggcugacccagggcgacacggccaccuacuucugcgcccggcagaaguucgagcgcgggggccaggggugguacuucgaccuguggggccggggcacccucaucguggugagcuccgcgagcaccaaggggcccuccgucuuccccacgaucuacgug

SEQ ID NO: 11238 - RNA, 417 nt, Artificial Sequence
  derived and/or modified sequence opt1 from anti-HIV-1_HeavyChain
caggugcagcuggagcagagcggcuccggggucaagaagcucggcgccagcgugcgcguguccugcuggaccagcgaggacaucuucgaggacgagcugauccacuggguccggcaggcccccgggcagggccuggaguggaucgggugggugaaggcgguguccggcgccgucaacuacggcagccucgacuuccgccaccgggugucccugacccgcgaccgggaccuguucacggcccacauggacauccgcgggcucacccaggacgacaccgccaccuacuucugcgcccggcagaaguucgcgcgcggcgaccaggggugguucuucgaccuguggggccgggggacgcugaucguggucagcuccggccuccaccagggccccaucgggcugccgccccgccugagccgg

SEQ ID NO: 11239 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagaucguguccggcgccgugaacuucggcagccccaacuuccggcagcgcgucucccugacgcgggaccgcgaccucuucaccgcccacauggacauccgggggcugacccagggcgacaccgccacguacuucugcgcccgccagaaguucgagcgcgggggccagggguggaucuucgaccuguggggccggggcacccucaucgcggugagcuccgccagcccccgggcccaccgcuccagccccaccaucugcgug

SEQ ID NO: 11240 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcuccagcgacuuccggcagcgcgucucccugacccgggaccgcgaccucuucaccgcccacauggacauccgggggcugacgcagggcgacaccgccaccuacuucugcgcccgccagaaguucuacgccgggggccaggggugguacuucgaccuguggggccggggcacccucaucguggugagcuccgcgagcacgaaggggcccuccgucuucccccacgaccugcgc

SEQ ID NO: 11241 - RNA, 414 nt, Artificial Sequence
  derived and/or modified sequence opt1 from anti-HIV-1_HeavyChain
caggugcaccugguccagagcggcgccgaggugaagcgccccggggccuccgugaaggucagcugcaaggcguccggcuacaccuucaccgacuacuucauccacugggugcggcaggccccggggcagggccucgaguggaucgggugggugaagacggucagcggcgccgugaacuucggcucccugaacuuccgccaccgggugagccugacccgcgaccgggaccucuucaccgcccacauggacauccgcgggcugacccagggcgacacggccaccuacuucugcgcgcggcagaaguucgcccgcggggaccagggcugguucuucgaccugugggggcggggcacccucaucgucguguccagcgccuccaccaagggccccagcguguucccccacgaccugcgc

SEQ ID NO: 11242 - RNA, 420 nt, Artificial Sequence
  derived and/or modified sequence opt1 from anti-HIV-1_HeavyChain
caggugcagcugguccagagcggcgccgaggugaagaagcccggggccuccgugaaggucagcugcaaggcguccggcuacaucuucaccgggagcuacaugcacugggugcgccaggccccgggccagaccuucgaguggcucggguggaugaagcccgugacgggcgccgucaacuacgcccggcaguuccagggccgcguguccuucuaccggacccgcgagcuggggaucgccuacauggaccugcgggaccucaaguucgacgacaccgcgguguacuucugcgcccgcaagaccaagggcgacgucagcggggacgaccggggcuucuucuucgaccugugggggcgcggcacgcgggugaucguguccagcgccuccaccaagggccccagcgucuucccccacgaccugcgc

SEQ ID NO: 11243 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagccccaacuuccgccaccgggucucccugacccgcgaccgggaccucuucaccgcccacauggacauccgcgggcugacccagggcgacacggccaccuacuucugcgcccggcagaaguucgagcgcgggggccaggggugguacuucgaccuguggggccggggcacccucaucguggugagcuccgcgagcaccaaggggcccuccgucuucccccacgaccugcgc

SEQ ID NO: 11244 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagggguccgagcucauccacugggugcggcaggcgccgggccaggggcuggaguggaucggcugggucaagaccgugacgggcgccgugaacuucgggagccccaacuuccgccaccgggucucccugacccgcgaccgggaccucuucaccgcccacauggacauccgcggccugacccagggggacacggccaccuacuucugcgcccggcagaaguucgagcgcggcgggcagggcugguacuucgaccuguggggccgggggacccucaucguggugagcuccgcgagcaccaagggccccuccgucuucccccacgaccugcgc

SEQ ID NO: 11245 - RNA, 420 nt, Artificial Sequence
  derived and/or modified sequence opt1 from anti-HIV-1_HeavyChain
caggugcagcugguccagagcggcgccgaggugaagaagcccggggccuccgugaaggucagcugcaaggcguccggcuacaccuucaccggguacuacauccacugggugcgccaggccccgggccaggggcucgaguggaugggcuggaucaaccccaacagcggcgccacgaacuacgcccagaaguuccaggggcggcugaccaucgcccgcgacaccuccaucagcaccgcguacauggaccugcggaaccuccgcuucgacgacacggccguguacuucugcgcccggaagaccgccggcgacgucuccggggacaaccgcggcuacuucuucgaccugugggggcggggcagccgcgugaucguguccagcgcguccaccaagggccccagcgucuucccccacgaccugcgg

SEQ ID NO: 11246 - RNA, 414 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucuacgccgggggccaggggugguacuucgaccuguggggccgcggcacccucaucgugguguccagcgcguccaccaaggggcccagcgucuuccacgaccugcgg

SEQ ID NO: 11247 - RNA, 414 nt, Artificial Sequence
  derived and/or modified sequence opt1 from anti-HIV-1_HeavyChain
caggccacccuggagcagagcggcuccggggugaagaagcccggcgccagcguccgcguguccugcuggagcuccgaggacaucuucaagaccgagcucauccacugggugcggcaggcgccggggcagggccuggaguggaucgggugggucaaggccgugagcggcgccgugaacuacggcucccuggacuuccgccaccgggucagccucacgcgcgaccgggaccuguccaccgcccacauggacauccgcgggcugacccaggacgacaccgccacgcacuucugcgcgcggcagaaguucgcccgcggcgaccaggggugguucuucgaccucuggggccgggggacccugaucguggugagcuccgccagcaccaagggccccuccgucuuccccaccaucuacgug

SEQ ID NO: 11248 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacgcagggcgacaccgccaccuacuucugcgcccgccagaaguucgagcgcgggggccaggggugguacuucgaccuguggggccggggcacccucaucgugguguccagcgcguccacgaaggggcccagcgucuuccccaccaucugcgug

SEQ ID NO: 11249 - RNA, 414 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccccaacuuccggcaccgcgucucccugacccgggaccgcgaccucuucaccgcccacauggacauccgggggcugacccagggcgacacggccaccuacuucugcgcccgccagaaguucgagcgcgggggccagggguggaucuucgaccuguggggccggggcacccucaucgcggugagcuccgccagcccccgggcccaccgcuccagcccccgguccgcc

SEQ ID NO: 11250 - RNA, 414 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucgagcgcgggggccagggguggaucuucgaccuguggggccggggcacccucaucgcgguguccagcgccuccaccaaggggcccagcguguuccccacgaucugcguc

SEQ ID NO: 11251 - RNA, 414 nt, Artificial Sequence
  derived and/or modified sequence opt1 from anti-HIV-1_HeavyChain
caggcccaccuggagcagagcggccccggggugaagaagcucggcgccuccguccgcgugagcugcuggaccuccgaggacaucuucgagcggaccgagcugauccacugggugcgccaggcgccggggcagggccuggaguggaucgggugggucaaggccgugagcggcgccgugaacuacggcucccucgacuuccggcaccgcgucagccugacgcgggaccgcgaccuguucaccgcccacauggacauccgggggcucacccaggacgacaccgccaucuacuucugcgcgcgccagaaguucgcccggggcgaccaggggugguucuucgaccuguggggccgcgggacgcugaucgugguguccagcgccuccaccaaggcccaccggagcagcccccgcuccacc

SEQ ID NO: 11252 - RNA, 420 nt, Artificial Sequence
  derived and/or modified sequence opt1 from anti-HIV-1_HeavyChain
caggugcagcugguccagagcggcgccgagaugaagaagcccggggccuccgugaagcucagcugcaugaccuccggcuacguguucaccgacuucuacauccacuggguccgccaggcgccggggcagggccuggaguggaugggguggaucaaccccggcacgggcgggaccaucagcgcgccccgguuccugggccgcgugacccucacccgggacacguccaucagcgccgccuacaucgagaucaaccgcgugaccaucgacgacaccgccaccuacuucugcgcccggcagaaguucgccucccgcuacagcggggaccagggcuccuacuucgaccugugggggcggggcacgcugaucgucgugagcuccgccagcaccaagggcccccucgggcugccgccccgcuccgcc

SEQ ID NO: 11253 - RNA, 414 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccccggaggacaucuucgagcggaccgagcucauccacugggugcgccaggcgcccgggcagggccuggaguggaucgggugggucaagaucgugagcggcgccgugaacuucggcucccccaacuuccggcagcgcgucagccugacgcgggaccgcgaccucuucaccgcccacauggacauccgggggcugacccagggcgacaccgccacguacuucugcgcccgccagaaguucgagcgcgggggccagggguggaucuucgaccuguggggccggggcacccucaucgcgguguccagcgccagcccccgggcccaccgcuccuccccgcggagcgcc

SEQ ID NO: 11254 - RNA, 414 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagcccgugacgggcgccgugaaccuggcccccaacuuccggcaccgcgucucccucacccgggaccgcgaccuguucaccgcccacauggacauccggggccugacccagggggacacggccaccuacuucugcgcgcgccagaaguucgagcggggcgggcagggcugguacuucgaccucugggggcgcggcacccugaucguggugagcuccgccagcaccaagggccccuccgucuucccgcacgaccugcgg

SEQ ID NO: 11255 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaaggccgugagcggcgccgugaacuacggcucccuggacuuccggcaccgcgucagccucacccgggaccgcgaccuguccacggcccacauggacauccgggggcugacccaggacgacaccgccaccuacuucugcgcgcgccagaaguucgcccggggcgaccaggggugguucuucgaccucuggggccgcgggacgcugaucguggugagcuccgccagcaccaagggccccuccgucuucccccacgaccugcgg

SEQ ID NO: 11256 - RNA, 414 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcgguccgagcucauccacugggugcgccaggcgccggggcagggccuggaguggaucgggugggucaagaccgugacgggcgccgugaacuucggcagccccaacuuccggcagcgcgucucccugacccgggaccgcgaccucuucaccgcccacauggacauccgggggcugacccagggcgacacggccaccuacuucugcgcccgccagaaguucuacgccgggggccaggggugguacuucgaccuguggggccggggcacccucaucguggugagcuccgcgagcaccaaggcccaccgcuccagcccccgguccacg

SEQ ID NO: 11257 - RNA, 414 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucuacgccgggggccaggggugguacuucgaccuguggggccgcggcacccucaucgugguguccagcgcguccaccaaggggcccagcgucuuccccacgaucugcgug

SEQ ID NO: 11258 - RNA, 414 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucaagaccgagcugauccacugggugcggcaggcgcccgggcagggccuggaguggaucgggugggucaaggccguguccggcgccgugaacuacggcagccucgacuuccgccaccgggucucccugacgcgcgaccgggaccugagcaccgcccacauggacauccgcgggcucacccaggacgacaccgccacguacuucugcgcgcggcagaaguucgcccgcggcgaccaggggugguucuucgaccuguggggccgggggacccugaucgugguguccagcgccuccaccaagggcccgagcgucuucccccacgaccuccgc

SEQ ID NO: 11259 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucuacgccgggggccaggggugguacuucgaccuguggggccgcggcacccucaucgugguguccagcgcguccaccaaggggcccagcgucuuccccacgaucuacgug

SEQ ID NO: 11260 - RNA, 417 nt, Artificial Sequence
  derived and/or modified sequence opt1 from anti-HIV-1_HeavyChain
caggcccaccuggagcagagcggcuccggggugaagaagcccggcaccagcguccgcguguccugcuggaccagcgaggacaucuucgagcggacggagcucauccacugggugcgccaggccccggggcagggccuggaguggaucgggugggucaagaccgugaccggcgcggugaacuucggcucccccaacuuccggcaccgcgucagccugacccgggaccgcgaccucuucacggcccacauggacauccgggggcugacccagggcgacaccgccaccuacuucugcgcccgccagaaguucgcccgcggggaccagggcugguucuucgaccugugggggcggggcacgcucaucgugguguccagcgcguccaccaagggccccagcgucuuccccaccaucugcgug

SEQ ID NO: 11261 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucuacgccgggggccaggggugguacuucgaccuguggggccgcggcacccucaucgugguguccagcgcguccaccaaggggcccagcgucuucccccagaucuacgug

SEQ ID NO: 11262 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcagaccccggggcagggccuggaguggaucgggugggucaagacggugaccggcgcggugaacuucggcagcuccgacuuccgccagcgggucagccugacccgcgaccgggaccucuucaccgcccacauggacauccgcgggcugacgcagggcgacaccgccaccuacuucugcgcccggcagaaguucuacgccgggggccaggggugguacuucgaccuguggggccgcggcacccucaucgugguguccagcgcguccacgaaggggcccagcgucuuccccaccaucuacgug

SEQ ID NO: 11263 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagaucguguccggcgccgugaacuucggcagccccaacuuccggcagcgcgucucccugacgcgggaccgcgaccucuucaccgcccacauggggauccggggccugacccagggggacaccgccacguacuucugcgcccgccagaaguucgagcggggcgggcagggcuggaucuucgaccuguggggccgcgggacccucaucgcggugagcuccgccagcaccaagggccccuccguguuccccaccaucuacguc

SEQ ID NO: 11264 - RNA, 417 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccuguucaccgcccacauggacauccgggggcucacccaggacgacaccgccacguacuucugcgcgcgccagaaguucgcccggggcgaccaggggugguucuucgaccuguggggccgcgggacccugaucguggugagcuccgccagcaccaagggcccguccgucuucccccacgaccuccgg

SEQ ID NO: 11265 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacgcagggcgacaccgccaccuacuucugcgcccgccagaaguucgagcgcgggggccagggguggaucuucgaccuguggggccggggcacccucaucgcgguguccagcgccuccacgaaggggcccagcguguucccccgguccgccguc

SEQ ID NO: 11266 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucggguggaugaagaucgucuccggcgccgugaacuucggcagccccaacuuccggcagcgcgugucccugacgcgggaccgcgaccucuucaccgcccacauggacauccgggggcugacccagggcgacaccgccacguacuucugcgcccgccagaaguucgagcgcgggggccagggguggaucuucgaccuguggggccggggcacccucaucgcggucagcuccgccagcaccaaggggcccuccguguucccccacgaccugcgg

SEQ ID NO: 11267 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuccgaggggagcgagcucauccacugggugcggcaggcgccgggccaggggcuggaguggaucggcugggucaagaccgugacgggcgccgugaacuucggguccgccuacuuccgccaccgggucagccugacccgcgaccgggaccucuucaccgcccacauggacauccgcggccugacccagggggacacggccaccuacuucugcgcgcggcagaaguucuacaagggcgggcagggcugguacuucgaccuguggggccgcgggacccucaucgugguguccagcgccuccaccaagggccccagcgucuuccccacgaucugcgug

SEQ ID NO: 11268 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuacggcucccuggacuuccggcaccgcgucagccucacccgggaccgcgaccuguccaccgcccacauggacauccgggggcugacgcaggacgacaccgccaccuacuucugcgcccgccagaaguucgcgcggggcgaccaggggugguucuucgaccucuggggccgcgggacccugaucguggugagcuccgccagcacgaagggccccuccgucuucccccacgaccugcgg

SEQ ID NO: 11269 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaucgugagcggcgccgugaacuucggcucccccaacuuccggcagcgcgucagccugacccgggaccgcgaccucuucacggcccacauggacauccgggggcugacccagggcgacaccgccaccuacuucugcgcccgccagaaguucgagcgcgggggccagggguggaucuucgaccuguggggccggggcacgcucaucgcgguguccagcgccuccaccaaggggcccagcguguuccccaccaucuacguc

SEQ ID NO: 11270 - RNA, 417 nt, Artificial Sequence
  derived and/or modified sequence opt1 from anti-HIV-1_HeavyChain
caggcccaccuggagcagagcggcuccggggugaagcgccccggcgccagcguccggguguccugcuggaccagcgaggacaucuucgagaccacggagcucauccacugggugcgccaggcgccggggcagggccuggaguggaucgggugggucaagaccguguccggcgccgugaacuucggcagccugaacuuccggcaccgcgucucccucacccgggaccgcgaccuguucaccgcccacauggacauccgggggcugacgcagggcgacaccgccaccuacuucugcgcccgccagaaguucgcgcgcggggaccagggcugguucuucgaccucugggggcggggcacccugaucguggugagcuccgccagcacgaagggccccuccgucuuccccaccaucugcgug

SEQ ID NO: 11271 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaaccugggcucccccaacuuccggcaccgcgucagccucacccgggaccgcgaccuguucaccgcccacauggacauccgggggcugacgcagggcgacaccgccaccuacuucugcgcccgccagaaguucgagcgcgggggccaggggugguacuucgaccucuggggccggggcacccugaucgugguguccagcgcguccacgaaggggcccagcgucuucccccacgaccugcgg

SEQ ID NO: 11272 - RNA, 417 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccugagcaccgcccacauggacauccgggggcucacccaggacgacaccgccacguacuucugcgcgcgccagaaguucgagcggggcgggcagggcuggaucuucgaccugugggggcgcggcacccugaucgccguguccagcgccuccaccaagggcccgagcguguuccccaccaucugcguc

SEQ ID NO: 11273 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacgcagggcgacaccgccaccuacuucugcgcccgccagaaguucgagcgcgggggccaggggugguacuucgaccuguggggccggggcacccucaucgugguguccagcgcguccacgaaggggcccagcgucuucccccacgaccuggug

SEQ ID NO: 11274 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaaggccgugagcggcgccgugaacuacggcucccuggacuuccggcaccgcgucagccucacccgggaccgcgaccuguucacggcccacauggacauccgggggcugacccaggacgacaccgccaccuacuucugcgcgcgccagaaguucgcccggggcgaccaggggugguucuucgaccucuggggccgcgggacgcugaucgugguguccagcgccuccaccaagggccccagcgucuuccccaccaucuacgug

SEQ ID NO: 11275 - RNA, 420 nt, Artificial Sequence
  derived and/or modified sequence opt1 from anti-HIV-1_HeavyChain
caggugcaccuggagcagagcggcuccggggucaagaagcccggcgcccccgugcgcgugagcugcugguccagcgaggacaucuucgagcggaccgagcucauccacuggguccgccaggcccccgggcagggccuggaguggaucgggugggugaagaccgugacgggcgcggucaacuucggcucccuggacuuccggcaccgcaucagccucacccgggaccgcgaccuguucaccgcccacauggacauccgggggcugacccagggcgacacggccaccuacuucugcgcccgccagaaguucuacgccgggggccaggggugguacuucgaccucuggggccggggcacccugaucgugguguccagcgcguccaccaaggcccacagcguccugccgccccgcucccgggug

SEQ ID NO: 11276 - RNA, 417 nt, Artificial Sequence
  derived and/or modified sequence opt1 from anti-HIV-1_HeavyChain
caggcccaccuggagcagagcggcuccggggugaagaagcccggcgcccucguccgcgugagcugcuggaccuccgaggacaucuucgagaaguccgagcugauccacugggugcggcaggcgccggggcagggccuggaguggaucgggugggucaagaccgugacgggcgccgugaacuucggcagcagcgacuuccgccagcgggucucccucacccgcgaccgggaccuguucaccgcccacauggacauccgcgggcugacccagggcgacacggccaccuacuucugcgcccggcagaaguucuacgccgggggccaggggugguacuucgaccucuggggccgcggcacccugaucguggugagcuccgcgagcaccaaggggcccuccgucuucccccacgaccugcgg

SEQ ID NO: 11277 - RNA, 414 nt, Artificial Sequence
  derived and/or modified sequence opt1 from anti-HIV-1_HeavyChain
caggugcagcugguccagagcggcgccgaggugaagaagcccggggccuccgugaaggucagcugccagguguccggcuacacccucaccgagcugagcaugcacugggugcgccaggcgccggggcagggccuggaguggaucgggugggucaagacggugaccggcgccgugaacuucggcucccccaacuuccggcaccgcgucagccucacccgggaccgcgaccuguucaccgcccacauggacauccgggggcugacgcagggcgacaccgccaccuacuucugcgcccgccagaaguucgagcgcgggggccaggggugguacuucgaccucuggggccggggcacccugaucgugguguccagcgcguccacgaaggggcccagcgucuucccccacgaccugcgg

SEQ ID NO: 11278 - RNA, 414 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucaagaccgagcucauccacugggugcggcaggcgccggggcagggccuggaguggaucgggugggucaagaucguguccggcgccgugaacuucggcagccccaacuuccgccagcgggucucccugacgcgcgaccgggaccucuucaccgcccacauggacauccgcgggcugacccagggcgacaccgccacguacuucugcgcccggcagaaguucgagcgcgggggccagggguggaucuucgaccuguggggccggggcacccucaucgcggugagcuccgccagcaccaaggggcccuccguguucccccacgaccugcgc

SEQ ID NO: 11279 - RNA, 417 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccuguucaccgcccacauggacauccgggggcucacccaggacgacaccgccacguacuucugcgcgcgccagaaguucgcccggggcgaccaggggugguucuucgaccuguggggccgcgggacccugaucguggugagcuccgccagcaccaagggcccguccgucuuccccaccaucugcgug

SEQ ID NO: 11280 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggagugggucgggugggugaagaccgugacgggcgccgucaacuucggcagcuccgacuuccgccagcgggugagccugacccgcgaccgggaccucuucaccgcccacauggacauccgcgggcugacccagggcgacacggccaccuacuucugcgcccggcagaaguucuacgccgggggccaggggugguacuucgaccuguggggccgcggcacccucaucguggucuccagcgcguccaccaaggggcccagcguguucccccacgaccugcgg

SEQ ID NO: 11281 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucgagcgcgggggccaggggugguacuucgaccuguggggccggggcacccucaucgugguguccagcgcguccaccaaggggcccagcgucuuccccacgaucugcgug

SEQ ID NO: 11282 - RNA, 417 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccugagcaccgcccacauggacauccgggggcucacccaggacgacaccgccacguacuucugcgcgcgccagaaguucgcccggggcgaccaggggugguucuucgaccuguggggccgcgggacccugaucgugguguccagcgccuccaccaagggcccgagcgucuucccccagaucugcgug

SEQ ID NO: 11283 - RNA, 414 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggccaccagaucagcgaccgcgucucccugacccccgaccgggaccucuucaccgcccacauggacauccgcgggcugacccagggcgacacggccaccuacuucugcgcccggcagaaguucuacgccgggggccaggggugguacuucgaccuguggggccgcggcacccucaucguggugagcuccgcgagcaccaaggggcccuccgucuuccccacgaucugcgug

SEQ ID NO: 11284 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcgcgcgccggggcagggccuggaguggaucgggugggucaagaccgugacgggcgccgugaacuucggcagcuccgacuuccggcagcgcgucagccugacccgggaccgcgaccucuucaccgcccacauggacauccgggggcugacccagggcgacacggccaccuacuucugcgcccgccagaaguucuacgccgggggccaggggugguacuucgaccuguggggccggggcacccucaucgugguguccagcgcguccaccaaggcccaccgcagcucccccacgaucugcguc

SEQ ID NO: 11285 - RNA, 417 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccuguucaccgcccacauggacauccgggggcucacccaggacgacaccgccacguacuucugcgcgcgccagaaguucgcccggggcgaccaggggugguucuucgaccuguggggccgcgggacccugaucguggugagcuccgccccgaccaagggccccagcgucuuccccaccaucugcgug

SEQ ID NO: 11286 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcuccagcgacuuccggcagcgcgucucccugacccgggaccgcgaccucuucaccgcccacauggacauccgggggcugacgcagggcgacaccgccaccuacuucugcgcccgccagaaguucuacgccgggggccaggggugguacuucgaccuguggggccggggcacccucaucguggugagcuccgcgagcacgaaggggcccuccgucuucccccagaucuacgug

SEQ ID NO: 11287 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgggcgggaccucuucaccgcccacauggacauccgcggccugacccagggggacacggccaccuacuucugcgcccggcagaaguucuacgcgggcgggcagggcugguacuucgaccuguggggccgcgggacccucaucgugguguccagcgccuccaccaagggccccagcgucuuccccacgaucugcgug

SEQ ID NO: 11288 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuccaccgcccacauggacauccgggggcugacgcaggacgacaccgccaccuacuucugcgcccgccagaaguucgcgcggggcgaccaggggugguucuucgaccuguggggccgcgggacccucaucguggugagcuccgccagcacgaagggccccuccgucuucccccacgaccacgug

SEQ ID NO: 11289 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacgcagggcgacaccgccaccuacuucugcgcccgccagaaguucuacgccgggggccaggggugguacuucgaccuguggggccggggcacccucaucgugguguccagcgcguccacgaaggggcccagcgucuucccccagaucugcgug

SEQ ID NO: 11290 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagaucguguccggcgccgugaacuucggcagccccaacuuccggcagcgcgucucccugacgcgggaccgcgaccucuucaccgcccacauggacauccgggggcugacccagggcgacaccgccacguacuucugcgcccgccagaaguucgagcgcgggggccagggguggaucuucgaccuguggggccggggcacccucaucguggugagcuccgcgagcaccaaggggcccuccgucuuccccaccaucugcgug

SEQ ID NO: 11291 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcugggcgagcgaggacaucuucgagcggaccgagcucauccacugggugcgccaggccccggggcagggccuggaguggaucgggugggucaagaccgugacgggcgccgugaacuucggcucccccaacuuccggcaccgcgucagccugacccgggaccgcgaccucuucaccgcccacauggacauccgggggcugacccagggcgacacggccaccuacuucugcgcgcgccagaaguucuacgccgggggccaggggugguacuucgaccuguggggccggggcacccucaucgugguguccagcgccuccaccaaggggcccagcgucuucccccacgaccugcug

SEQ ID NO: 11292 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucgagcgcgggggccagggguggaucuucgaccuguggggccggggcacccucaucgcgguguccagcgccuccaccaaggggcccagcguguucccccacgaccugcgc

SEQ ID NO: 11293 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaaggccguguccggcgccgugaacuacggcagccuggacuuccggcaccgcgucucccucacgcgggaccgcgaccugagcaccgcccacauggacauccgggggcugacccaggacgacaccgccacguacuucugcgcgcgccagaaguucgcccggggcgaccaggggugguucuucgaccucuggggccgcgggacccugaucgugguguccagcgccuccaccaagggccccagcgucuucccccacgaccugcgg

SEQ ID NO: 11294 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcgguccgagcucauccacugggugcgccaggcgccggggcagggccuggaguggaucgggugggucaagaccgugacgggcgccgugaacuucggcagccccaacuuccggcaccgcgucucccugacccgggaccgcgaccucuucaccgcccacauggacauccgggggcugacccagggcgacacggccaccuacuucugcgcccgccagaaguacuacgccgggggccaggggugguacuucgaccuguggggccggggcacccucaucguggugagcuccgcgagcaccaaggggcccuccgucuuccccacgaucugccgc

SEQ ID NO: 11295 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucgagcgcgggggccaggggugguacuucgaccuguggggccggggcacccucaucgugguguccagcgcguccaccaaggggcccagcgucuucccccacgaccugcgc

SEQ ID NO: 11296 - RNA, 417 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccuguucaccgcccacauggacauccgggggcucacccaggacgacaccgccacguacuucugcgcgcgccagaaguucgcccggggcgaccaggggugguucuucgaccuguggggccgcgggacccugaucguggugagcuccgccagcaccaagggcccguccgucuuccccaccaucuacgug

SEQ ID NO: 11297 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucuacaagggcgggcaggggugguacuucgaccuguggggccgcggcacccucaucgugguguccagcgcguccaccaaggggcccagcgucuucccccacgaccugcgg

SEQ ID NO: 11298 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcaccgugaacuucggcucccugaacuuccggcagcgcgucagccucacccgggaccgcgaccuguucacggcccacauggacauccgggggcugacccaggacgacaccgccaccuacuucugcgcccgccagaaguucgcccggggcgaccaggggugguucuucgaccucuggggccgcgggacgcugaucgugguguccagcgcguccaccaagggccccagcgucuucccccacgaccugcgg

SEQ ID NO: 11299 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggccgagcgaggacaucuucgagaaguccgagcucauccacugggugcggcaggcgcccgggcagggccuggaguggaucgggugggucaagaccgugaccggcgccgugaacuucggcagcuccgacuuccgccagcgggucagccugacgcgcgaccgggaccucuucaccgcccacauggacauccgcgggcugacccagggcgacaccgccacguacuucugcgcccggcagaaguucgagcgcgggggccagggguggaucuucgaccuguggggccggggcacccucaucgcgguguccagcgccuccaccaaggggcccagcguguucccccacgaccugcgc

SEQ ID NO: 11300 - RNA, 417 nt, Artificial Sequence
  derived and/or modified sequence opt1 from anti-HIV-1_HeavyChain
caggcccaccuggagcagagcggcuccggggugaagcgccccggcgccagcguccggguguccugcuggaccagcgaggacaucuucgagaccacggagcucauccacugggugcgccaggcgccggggcagggccuggaguggaucgggugggucaagaccguguccggcgccgugaacuucggcagccugaacuuccggcaccgcgucucccucacccgggaccgcgaccuguucaccgcccacauggacauccgggggcugacgcagggcgacaccgccaccuacuucugcgcccgccagaaguucgcgcgcggggaccagggcugguucuucgaccucugggggcggggcacccugaucguggugagcuccgccagcacgaagggccccuccgucuucccccacgaccugcgg

SEQ ID NO: 11301 - RNA, 417 nt, Artificial Sequence
  derived and/or modified sequence opt1 from anti-HIV-1_HeavyChain
caggcccaccuggagcagagcggcuccgggguggagaagcccggcgccagcguccgcguguccugcuggaccagcgaggacaucuucgagcgguccgagcucauccacugggugcgccaggcgccggggcagggccuggaguggaucgggugggucaagaccgugacgggcgccgugaacuucggcagccccaacuuccggcaccgcgucucccugacccgggaccgcgaccucuucaccgcccacauggacauccgggggcugacccagggcgacacggccaccuacuucugcgcccgccagaaguacuacgccgggggccaggggugguacuucgaccuguggggccggggcacccucaucguggugagcuccgcgagcaccaaggggcccuccgucuucccccacgaccugcgc

SEQ ID NO: 11302 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagaucguguccggcgccgugaacuucggcagccccaacuuccggcagcgcgucucccugacgcgggaccgcgaccucuucaccgcccacauggacauccgggggcugacccagggcgacaccgccacguacuucugcgcccgccagaaguucgagcgcgggggccagggguggaucuucgaccuguggggccggggcacccucaucgcggugagcuccgccagcaccaaggggcccuccguguucccccacgaccugcgg

SEQ ID NO: 11303 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcaaccucuucaccgcccacauggacauccgggggcugacgcagggcgacaccgccaccuacuucugcgcccgccagaaguucgagcgcgggggccaggggugguacuucgaccuguggggccggggcacccucaucgugguguccagcgcguccacgaaggggcccagcgucuucccccacgaccugcgg

SEQ ID NO: 11304 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagaucguguccggcgccgugaacuucggcagccccaacuuccggcagcgcgucucccugacgcgggaccgcgaccucuucaccgcccacauggacauccgggggcugacccagggcgacaccgccacguacuucugcgcccgccagaaguucuacgccgggggccaggggugguacuucgaccuguggggccggggcacccucaucguggugagcuccgcgagcaccaaggggcccuccgucuucccccacgaccugcgc

SEQ ID NO: 11305 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuacggcucccugaacuuccggagccgcaucucccucacccgggaccgcgaccuguucaccgcccacauggacauccgggggcugacgcagggcgacaccgccaccuacuucugcgcccgccagaaguucgagcgcgggggccagggguggaucuucgaccucuggggccggggcacccugaucgcggucagcuccgccagcacgaaggggcccuccguguucccccacgaccugcgg

SEQ ID NO: 11306 - RNA, 417 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugacccagggcgacacggccaccuacuucugcgcccggcagaaguucuacgccgggggccaggggugguacuucgaccucuggggccgcgggacccugaucguggucuccagcgcguccaccaagggccccagcguguucccccacgaccugcgg

SEQ ID NO: 11307 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaucgagcucauccacugggugcgccaggcgccggggcagggccuggaguggaucgggugggucaagaccgugacgggcgccgugaacuucggcucccccaacuuccggcaccgcgucagccugacccgggaccgcgaccucuucaccgcccacauggacauccgggggcugacccagggcgacacggccaccuacuucugcgcccgccagaaguucgagcgcgggggccaggggugguacuucgaccuguggggccggggcacccucaucgugguguccagcgcguccaccaaggggcccagcgucuucccccacgaccugcgg

SEQ ID NO: 11308 - RNA, 417 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcagcgcgucucccugacgcgggaccgcgaccuguucaccgcccacauggacauccgggggcucacccagggcgacaccgccacguacuucugcgcgcgccagaaguucuacgccgggggccaggggugguacuucgaccuguggggccggggcacccugaucguggugagcuccgccagcaccaaggggccguccgucuucccccacgaccuccgc

SEQ ID NO: 11309 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcgggcggagcucauccacugggugcgccaggccccggggcagggccuggaguggaucgggugggucaagaccgugaccggcgccgugaacuucggcagccccaacuuccggcagcgcgucucccugacgcgggaccgcgaccucuucaccgcccacauggacauccgggggcugacccagggcgacaccgccacguacuucugcgcgcgccagaaguucgagcgcgggggccagggguggaucuucgaccuguggggccggggcacccucaucgccgugagcuccgccagcaccaaggggcccuccguguucccccacgaccugcgg

SEQ ID NO: 11310 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaaggccguguccggcgccgugaacuacggcagccuggacuuccggcaccgcgucucccucacgcgggaccgcgaccuguucaccgcccacauggacauccgggggcugacccaggacgacaccgccacguacuucugcgcgcgccagaaguucgcccggggcgaccaggggugguucuucgaccucuggggccgcgggacccugaucguggugagcuccgccagcaccaagggccccuccgucuucccccacgaccugcgg

SEQ ID NO: 11311 - RNA, 417 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugacccaggacgacacggccaccuacuucugcgcccggcagaaguucgagcgcggcgggcagggcugguacuucgaccucugggggcggggcacccugaucguggucuccagcgcguccaccaaggggcccagcguguucccccacgaccugcgc

SEQ ID NO: 11312 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccuggacuuccggcaccgcaucucccucacccgggaccgcgaccuguucaccgcccacauggacauccgggggcugacccagggcgacacggccaccuacuucugcgcccgccagaaguucuacgccgggggccaggggugguacuucgaccucuggggccggggcacccugaucgucgugagcuccgcgagcaccaaggggcccuccguguucccccacgaccugcgc

SEQ ID NO: 11313 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccaggacgacacggccaucuacuucugcgcccggcagaaguucgcgcgcggcgaccaggggugguucuucgaccuguggggccgggggacccucaucgugguguccagcgccuccaccaagggccccagcgucuucccccacgaccugcgc

SEQ ID NO: 11314 - RNA, 417 nt, Artificial Sequence
  derived and/or modified sequence opt1 from anti-HIV-1_HeavyChain
caggcccaccuggagcagagcggcuccggggugaagggccccggggccagcguccgcguguccugcuggaccagcgaggacaucuucgagaccacggagcucauccacugggugcggcaggcgccgggccaggggcuggaguggaucggcugggucaagaccguguccggcgccgugaacuucgggagccugaacuuccgccaccgggucucccucacccgcgaccgggaccuguucaccgcccacauggacauccgcggccugacgcagggggacaccgccaccuacuucugcgcccggcagaaguucgcgcgcggcgaccaggggugguucuucgaccucuggggccggggcacccugaucguggugagcuccgccagcacgaaggggcccuccgucuucccccacgaccugcgc

SEQ ID NO: 11315 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagggguccgagcucauccacugggugcggcaggcgccgggccaggggcuggaguggaucggcugggucaagaccgugacgggcgccgugaacuucgggagcgccuacuuccgccaccgggucccccugacccgcgaccgggaccucuucaccgcccacauggacauccgcggccugacccagggggacacggccaccuacuucugcgcgcggcagaaguucuacaagggcgggcagggcugguacuucgaccuguggggccgcgggacccucaucgugguguccagcgccuccaccaagggccccagcgucuucccccacgaccugcgg

SEQ ID NO: 11316 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacgcagggcgacaccgccaccuacuucugcgcccgccagaaguucgagcgcgggggccaggggugguacuucgaccuguggggccggggcacccucaucgugguguccagcgcguccacgaaggggcccagcgucuucccccacgaccugcgg

SEQ ID NO: 11317 - RNA, 417 nt, Artificial Sequence
  derived and/or modified sequence opt1 from anti-HIV-1_HeavyChain
caggcccaccuggagcagagcggcuccggggugaagaaggucggcgccagcgugcgcguguccugcuggaccagcgaggacaucuucgagcggaccgagcucauccacuggguccgccaggcgcccgggcagggccuggaguggaucgggugggugaaggccguguccggcgccgucaacuacggcagccuggacuuccggcaccgcgugucccucacgcgggaccgcgaccuguucaccgcccacauggacauccgggggcugacccagggcgacaccgccacguacuucugcgcgcgccagaaguucuacgccgggggccaggggugguacuucgaccucuggggccggggcacccugaucguggucagcuccgccagcaccaaggggccguccguguucccccacgaccugcgc

SEQ ID NO: 11318 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacgcaggacgacaccgccaccuacuucugcgcccgccagaaguucgcgcggggcgaccaggggugguucuucgaccuguggggccgcgggacccucaucgugguguccagcgccuccacgaagggccccagcgucuucccccacgaccugcgg

SEQ ID NO: 11319 - RNA, 417 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucaucuacugggugcgccaggcgccgggccgggggcuggaguggaucggcugggugaagacggucagcgggaccgugaacuucggcuccagcgacuuccgcaaccggaucucccugacccgcgaccgggaccucagcaccgcccacauggacauccgcggccugacgcaggacgacaccgccaccuacuucugcgcccggcagaaguucgcccgcggggaccagggcugguucuucgaccugugggggcggggcacccucaucguggucuccagcgcguccacgaaggggcccagcguguucccccacgaccugcgc

SEQ ID NO: 11320 - RNA, 417 nt, Artificial Sequence
  derived and/or modified sequence opt1 from anti-HIV-1_HeavyChain
caggcccaccuggagcagagcgaguccggcgugaagaagcucggggccagcguccgcguguccugcuggaccagcgaggacaucuucgagcggaccgagcugauccacugggugcgccaggcgcccggccaggggcuggaguggaucggcugggucaaggccguguccggggccgugaacuacggcagccucgacuuccggcaccgcgucucccugacgcgggaccgcgaccuguucaccgcccacauggacauccggggccucacccaggacgacaccgccacguacuucugcgcgcgccagaaguucgcccgcggggaccagggcugguucuucgaccugugggggcggggcacccugaucguggugagcuccgccagcaccaaggggccguccgucuucccccacgaccuccgg

SEQ ID NO: 11321 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucuacgccgggggccaggggugguacuucgaccuguggggccgcggcacccucaucgugguguccagcgcguccaccaaggggcccagcgucuuccccacgacccugcgg

SEQ ID NO: 11322 - RNA, 417 nt, Artificial Sequence
  derived and/or modified sequence opt1 from anti-HIV-1_HeavyChain
caggcccaccuggagcagagcggcuccggggugaagaaggucggcgccagcgugcgcguguccugcuggaccagcgaggacaucuucgagcggaccgagcucauccacuggguccgccaggcgcccgggcagggccuggaguggaucgggugggugaagacggugaccggcgccgucaacuucggcuccagcgacuuccggcagcgcgugucccugacccgggaccgcgaccucuucaccgcccacauggacauccgggggcugacgcagggcgacaccgccaccuacuucugcgcccgccagaaguucuacgccgggggccaggggugguacuucgaccuguggggccggggcacccucaucguggucagcuccgcgagcacgaaggggccguccguguucccccacgaccugcgc

SEQ ID NO: 11323 - RNA, 420 nt, Artificial Sequence
  derived and/or modified sequence opt1 from anti-HIV-1_HeavyChain
caggcccgccccggcgccaaccgggggagcggcgugaagaagccgggggcguccguccgcgugagcugcuggaccuccgaggacaucuucgagcggaccgagcugauccacugggugcgccaggcccccggccaggggcucgaguggaucggcugggucaagaucgugagcggcgccgugaacuucgggucccccaacuuccggcagcgcgucagccugacgcgggaccgcgaccuguucaccgcccacauggacauccggggccucacccagggggacaccgccacguacuucugcgcgcgccagaaguucgagcggggcgggcagggcuggaucuucgaccuguggggccgcgggacccugaucgccguguccagcgccuccaccaagggccccagcguguucccgcacgaccuccgg

SEQ ID NO: 11324 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcgguccgagcucauccacugggugcgccaggcgccggggcagggccuggaguggaucgggugggucaagaccgugacgggcgccgugaacuucggcagccccaacuuccggcaccgcgucucccugacccgggaccgcgaccucuucaccgcccacauggacauccgggggcugacccagggcgacacggccaccuacuucugcgcccgccagaaguacuacgccgggggccaggggugguacuucgaccuguggggccggggcacccucaucguggugagcuccgcgagcaccaaggggcccuccgucuucccccacgaccugcgc

SEQ ID NO: 11325 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagggguccgagcucauccacugggugcggcaggcgccgggccaggggcuggaguggaucggcugggucaagaccgugacgggcgccgugaacuucgggagcgccuacuuccgccaccgggucucccugacccgcgaccgggaccucuucaccgcccacauggacauccgcggccugacccagggggacacggccaccuacuucugcgcgcggcagaaguucuacaagggcgggcagggcugguacuucgaccuguggggccgcgggacccucaucguggugagcuccgccagcaccaagggccccuccgucuucccccacgaccugcgg

SEQ ID NO: 11326 - RNA, 417 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccugagcaccgcccacauggacauccgggggcucacccaggacgacaccgccacguacuucugcgcgcgccagaaguucgcccggggcgaccaggggugguucuucgaccuguggggccgcgggacccugaucgugguguccagcgccuccaccaagggccccagcguccucccgccccgguccgcc

SEQ ID NO: 11327 - RNA, 417 nt, Artificial Sequence
  derived and/or modified sequence opt1 from anti-HIV-1_HeavyChain
caggcccaccuggagcagagcggcuccgggaugaagaagcccggcgccagcgugcgcgucuccugcuggagcuccgaggacaucuucgagcggaccgagcucauccacugggugcgccaggcgccggggcagggccuggaguggaucgggugggugaagaccgucacgggcgccgugaacuucggcagcuccgacuuccggcagcgcgugagccugacccgggaccgcgaccucuucaccgcccacauggacauccgggggcugacccagggcgacacggccaccuacuucugcgcccgccagaaguucuacgccgggggccaggggugguacuucgaccuguggggccggggcacccucaucgucguguccagcgcguccaccaaggggcccagcguguucccccacgaccugcgc

SEQ ID NO: 11328 - RNA, 417 nt, Artificial Sequence
  derived and/or modified sequence opt1 from anti-HIV-1_HeavyChain
caggcccaccuggagcagagcggcuccggggugaaggagcccggcaccagcguccgcguguccugcuggaccagcgaggacaucuucgagcggacggagcucauccacugggugcgccaggccccggggcagggccuggaguggaucgggugggucaagaccgugaccggcgcggugaacuucggcucccccaacuuccggcaccgcgucagccugacccgggaccgcgaccucuucacggcccacauggacauccgggggcugacccagggcgacaccgccaccuacuucugcgcccgccagaaguucgagcgcgggggccagggguggaucuucgaccuguggggccggggcacgcucaucgccguguccagcgcguccaccaaggggcccagcguguucccccagacccugcgg

SEQ ID NO: 11329 - RNA, 417 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgccaccgggugagccucacccgcgaccgggaccuguccaccgcccacauggacauccgcggccugacgcaggacgacaccgccaccuacuucugcgcccggcagaaguucgcgcgcggcgaccaggggugguucuucgaccucuggggccgggggacccugaucgucgugagcuccgccagcacgaagggccccuccguguucccccacgaccugcgc

SEQ ID NO: 11330 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaccacggagcucauccacugggugcggcaggcgccggggcagggccuggaguggaucgggugggucaagaccguguccggcgccgugaacuucggcagccugaacuuccgccaccgggucucccucacccgcgaccgggaccuguucaccgcccacauggacauccgcgggcugacgcagggcgacaccgccaccuacuucugcgcccggcagaaguucgcgcgcggggaccagggcugguucuucgaccucugggggcggggcacccugaucguggugagcuccgccagcacgaagggccccuccgucuucccccacgaccugcgc

SEQ ID NO: 11331 - RNA, 417 nt, Artificial Sequence
  derived and/or modified sequence opt1 from anti-HIV-1_HeavyChain
caggcccaccuggagcagagcggcuccggggugaagaaggucggcgccagcgugcgcguguccugcuggaccagcgaggacaucuucgagcggaccgagcucauccacuggguccgccaggcgcccgggcagggccuggaguggaucgggugggugaagacggugaccggcgccgucaacuucggcuccccgaacuuccggcaccgcgugagccugacccgggaccgcgaccucuucaccgcccacauggacauccgggggcugacgcagggcgacaccgccaccuacuucugcgcccgccagaaguucgagcgcgggggccaggggugguacuucgaccuguggggccggggcacccucaucguggucuccagcgcguccacgaaggggcccagcguguucccccacgaccugcgg

SEQ ID NO: 11332 - RNA, 417 nt, Artificial Sequence
  derived and/or modified sequence opt1 from anti-HIV-1_HeavyChain
caggcccaccuggagcagagcggcgccggggugaagaagcccggcgcguccguccgcgugagcugcuggaccuccgaggacaucuucgagcggaccgagcucauccacugggugcgccaggccccggggcagggccuggaguggaucgggugggucaagacggugagcggcgccgugaacuucggcucccccaacuuccggcaccgcgucagccugacccgggaccgcgaccucuucaccgcccacauggacauccgggggcugacccagggcgacacggccaccuacuucugcgcgcgccagaaguucgagcgcgggggccaggggugguacuucgaccuguggggccggggcacccucaucgugguguccagcgccuccaccaaggggcccagcgucuucccccacgaccugcgg

SEQ ID NO: 11333 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuacggcucccugaacuuccggagccgcaucucccucacccgggaccgcgaccuguucaccgcccacauggacauccgggggcugacggagggcgacaccgccaccuacuucugcgcccgccagaaguucuacgccgggggccaggggugguacuucgaccucuggggccggggcacccugaucgucgugagcuccgcgagcacgaaggggcccuccguguucccccacgaccugcgc

SEQ ID NO: 11334 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugccucgcgagcgaggacaucuucgagcggaccgagcugauccacugggugcgccaggccccggggcagggccuggaguggaucgggugggucaagaccgugacgggcgccgugaacuucggcucccccaacuuccggcaccgcgucagccucacccgggaccgcgaccuguucaccgcccacauggacauccgggggcugacccagggcgacacggccaccuacuucugcgcgcgccagaaguucgagcgcgggggccaggggugguacuucgaccucuggggccggggcacccugaucgugguguccagcgccuccaccaaggggcccagcgucuucccccacgaccugcgg

SEQ ID NO: 11335 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccuggacuuccggcaccgcaucucccucacccgggaccgcgaccuguucaccgcccacauggacauccgggggcugacccagggcgacacggccaccuacuucugcgcccgccagaaguucgagcgcgggggccagggguggaucuucgaccucuggggccggggcacccugaucgcggucagcuccgccagcaccaaggggcccuccguguucccccacgaccugcgg

SEQ ID NO: 11336 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcagcgcgucagccugacccgggaccgcgaccucuucaccgcccacauggacauccgggggcugacgcagggcgacaccgccaccuacuucugcgcccgccagaaguucgagcgcgggggccaggggugguacuucgaccuguggggccggggcacccucaucgugguguccagcgcguccacgaaggggcccagcgucuucccccacgaccugcgg

SEQ ID NO: 11337 - RNA, 417 nt, Artificial Sequence
  derived and/or modified sequence opt1 from anti-HIV-1_HeavyChain
caggugcaccuggagcagagcggcuccggggucaagaagcccggcgccagcgugcgcguguccugcuggaccagcgaggacaucuucgagcggaccgagcucauccacuggguccgccaggccccggggcagggccuggaguggaucgggugggugaagacggugaccggcgcggucaacuucggcucccccaacuuccggcaccgcgugagccugacccgggaccgcgaccucuucaccgcccacauggacauccgggggcugacgcagggcgacaccgccaccuacuucugcgcccgccagaaguucgagcgcgggggccaggggugguacuucgaccuguggggccggggcacccucaucguggucuccagcgccuccacgaaggggcccagcguguucccccacgaccugcgg

SEQ ID NO: 11338 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccccaacuuccggcagcgcgucucccugacccgggaccgcgaccucuucaccgcccacauggacauccgggggcugacccagggcgacacggccaccuaccugugcgcccgccagaaguucgagcgcgggggccagggguggaucuucgaccucuggggccggggcacccugaucgcggugagcuccgccagcaccaaggggcccuccguguucccccacgaccugcgg

SEQ ID NO: 11339 - RNA, 417 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucaucuacugggugcgccaggcgccgggccgggggcuggaguggaucggcugggugaagacggucagcgggaccgugaacuucggcuccagcgacuuccgccaccgggugucccugacccgcgaccgggaccucuucaccgcccacauggacauccgcggccugacgcagggggacaccgccaccuacuucugcgcccggcagaaguucuacaagggcgggcagggcugguacuucgaccugugggggcgcggcacccucaucgucgugagcuccgccagcacgaagggccccuccguguucccccacgaccugcgg

SEQ ID NO: 11340 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccccgaccgcgaccucuucaccgcccacauggacauccgggggcugacccagggcgacacggccaccuacuucugcgcccgccagaaguucuacgccgggggccaggggugguacuucgaccuguggggccggggcacccucaucgugguguccagcgcguccaccaaggggagcuccgucuucccccacgaccugcgc

SEQ ID NO: 11341 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccccgaccgcgaccucuucaccgcccacauggacauccgggggcugacccagggcgacacggccaccuacuucugcgcccgccagaaguucuacgccgggggccaggggugguacuucgaccuguggggccggggcacccucaucgugguguccagcgcguccaccaaggggcccagcgucuucccccacgaccugcgc

SEQ ID NO: 11342 - RNA, 417 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccugagcaccgcccacauggacauccgggggcucacccaggacgacaccgccacguacuucugcgcgcgccagaaguucgcccggggcgaccaggggugguucuucgaccuguggggccgcgggacccugaucgugguguccagcgccuccaccaagggcccgagcgucuucccccacgaccuccgg

SEQ ID NO: 11343 - RNA, 417 nt, Artificial Sequence
  derived and/or modified sequence opt1 from anti-HIV-1_HeavyChain
caggugcaccuggagcagagcggcuccggggucaagaagcucggcgccagcgugcgcguguccugcuggaccagcgaggacaucuucgagcggaccgagcugauccacuggguccgccaggcccccgggcagggccuggaguggaucgggugggugaaggcgguguccggcgccgucaacuacggcagccucgacuuccggcaccgcgugucccugacgcgggaccgcgaccuguucaccgcccacauggacauccgggggcucacccaggacgacaccgccacguacuucugcgcccgccagaaguucgcgcggggcgaccaggggugguucuucgaccuguggggccgcgggacccugaucguggucagcuccgccagcaccaagggcccguccguguucccccaccggagcacc

SEQ ID NO: 11344 - RNA, 420 nt, Artificial Sequence
  derived and/or modified sequence opt1 from anti-HIV-1_HeavyChain
cagguguacauggagcaggccggcgccggggucaagaagcccggcgcgagcgugacccuguccugcaagaccgccgacgaggacguguucgacgccgccuacaugcacuggguccgccaggccccggggcagacguucgaguggcucggcuggaugaagcccgugaccggggcggugagcuacgcccggaaguuccagggccgcgucuccuucuacaugacccgggagcugggcauggccuacauggaccugcgcaaccuccgguucgacgacaccgccguguacuucugcgcgcgcaagacggccggggacgugagcggcgacaaccggggguacuucuucgaccuguggggccgcgggucccgggucaucgugagcuccgccagcaccaagggccccuccguguucaccaucuacguc

SEQ ID NO: 11345 - RNA, 417 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccuguucaccgcccacauggacauccgggggcucacccaggacgacaccgccacguacuucugcgcgcgccagaaguucgcccggggcgaccaggggugguucuucgaccuguggggccgcgggacccugaucguggugagcuccgccagcaccaagggcccguccgucuucccccacgaccccgcc

SEQ ID NO: 11346 - RNA, 417 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccugagcaccgcccacauggacauccgggggcucacccaggacgacaccgccacguacuucugcgcgcgccagaaguucgcccggggcgaccaggggugguucuucgaccuguggggccgcgggacccugaucgugguguccagcgccuccaccaagggccccagcguccucccgccccgguccacc

SEQ ID NO: 11347 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaaggccgugagcggcgccgugaacuacggcucccuggacuuccggcaccgcgucagccucacccgggaccgcgaccuguucacggcccacauggacauccgggggcugacccaggacgacaccgccaccuacuucugcgcgcgccagaaguucgcccggggcgaccaggggugguucuucgaccucuggggccgcgggacgcugaucgugguguccagcgccuccaccaagggccccagcgucuucccccacgaccugcgg

SEQ ID NO: 11348 - RNA, 417 nt, Artificial Sequence
  derived and/or modified sequence opt1 from anti-HIV-1_HeavyChain
caggcccaccuggagcagagcggcuccgaguggaagaagcucggggccagcgugcgcgucuccugcuggaccagcgaggacaucuucgagcggaccgagcugauccacugggugcgccaggcgcccggccaggggcuggaguggaucggcugggugaaggccgucuccggggccgugaacuacggcagccucgacuuccggcaccgcgugucccugacgcgggaccgcgaccugagcaccgcccacauggacauccggggccucacccaggacgacaccgccacguacuucugcgcgcgccagaaguucgcccgcggggaccagggcugguucuucgaccugugggggcggggcacccugaucgucguguccagcgccuccaccaaggggccgagcguguucccccacgaccuccgg

SEQ ID NO: 11349 - RNA, 417 nt, Artificial Sequence
  derived and/or modified sequence opt1 from anti-HIV-1_HeavyChain
caggcccaccuggagcagagcggcuccgaggugaagaagcccggggccagcguccgcguguccugcuggaccagcgaggacaucuucgagaaguccgagcucauccacugggugcggcaggcgccgggccaggggcuggaguggaucggcugggucaagaccgugacgggggccgugaacuucggcagcuccgacuuccgccagcgggucagccugacccgcgaccgggaccucuucaccgcccacauggacauccgcggccugacccagggggacacggccaccuacuucugcgcccggcagaaguucuacgcgggcgggcagggcugguacuucgaccugugggggcgcggcacccucaucgugguguccagcgccuccaccaagggccccagcgucuucccccacgaccugcgg

SEQ ID NO: 11350 - RNA, 417 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaagacggugaccggcgccgugaacuucggcuccccgaacuuccggcaccgcgucagccucacccgggaccgcgaccuguucaccgcccacauggacauccgggggcugacgcagggcgacaccgccaccuacuucugcgcccgccagaaguucgagcgcgggggccaggggugguacuucgaccucuggggccggggcacccugaucgugguguccagcgcguccacgaaggggcccagcgucuucccccacgaccugcgg

SEQ ID NO: 11351 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacauccuccggaaguccgagcugauccacugggugcgccaggcgccggggcagggccuggaguggaucgggugggucaagaccgugacgggcgccgugaacuucggcagcuccgacuuccggcagcgcgucagccucacccgggaccgcgaccuguucaccgcccacauggacauccgggggcugacccagggcgacacggccaccuacuucugcgcccgccagaaguucuacgccgggggccaggggugguacuucgaccucuggggccggggcacccugaucgugguguccagcgcguccaccaaggggcccagcgucuucccccacgaccugcgc

SEQ ID NO: 11352 - RNA, 417 nt, Artificial Sequence
  derived and/or modified sequence opt1 from anti-HIV-1_HeavyChain
caggcccaccuggagcagagcgccuccggcgugaagcgccccggggcgagcguccggguguccugccucgccagcgaggacaucuucgagcgcuccgagcugaucuacugggugcggcaggccccgggccaggggcuggaguggaucggcugggucaagaucgugagcggggccgugaacuucggcucccccaacuuccgccagcgggucagccucacccgcgaccgggaccuguucaccgcccacauggacauccgcggccugacgcagggggacaccgcgaccuacuucugcgcccggcagaaguucgagcgcggcgggcagggcuggaucuucgaccucugggggcggggcacccugaucgccguguccagcgccuccacgaagggccccagcguguucccccacgaccugcgc

SEQ ID NO: 11353 - RNA, 417 nt, Artificial Sequence
  derived and/or modified sequence opt1 from anti-HIV-1_HeavyChain
caggcccaccuggagcagagcggcuccggggugaagcgccccggcgccagcguccggguguccugcuggaccagcgaggacaucuucgagaccacggagcucauccacugggugcgccaggcgccggggcagggccuggaguggaucgggugggucaagaccgugaccggcgccgugaacuucggcuccgccuacuuccggcaccgcgucagccugacccgggaccgcgaccucuucacggcccacauggacauccgggggcugacccagggcgacaccgccaccuacuucugcgcgcgccagaaguucuacaagggcgggcaggggugguacuucgaccuguggggccggggcacgcucaucgugguguccagcgccuccaccaaggggcccagcgucuucccccacgaccugcgc

SEQ ID NO: 11354 - RNA, 417 nt, Artificial Sequence
  derived and/or modified sequence opt1 from anti-HIV-1_HeavyChain
caggcccaccuggagcagagcgccuccggcgugaagcgccccggggcgagcguccggguguccugcuggaccagcgaggacaucuucgagcgcuccgagcucaucuacugggugcggcaggccccgggccaggggcuggaguggaucggcugggucaagaccgugagcggggccgugaacuucggcuccacggacuuccgccaccgggucagccugacccgcgaccgggaccucuucaccgcccacauggacauccgcggccugacccagggggacacggccaccuacuucugcgcgcggcagaaguucgagcgcggcgggcagggcugguacuucgaccugugggggcggggcacccucaucgugguguccagcgccuccaccaagggccccagcgucuucccccacgaccugcgc

SEQ ID NO: 11355 - RNA, 417 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccugagcaccgcccacauggacauccgggggcucacccaggacgacaccgccacguacuucugcgcgcgccagaaguucgcccggggcgaccaggggugguucuucgaccuguggggccgcgggacccugaucgugguguccagcgccuccaccaagggccccagcggccucccgccccgguccgcc

SEQ ID NO: 11356 - RNA, 417 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugacccagggcgacacggccaccuacuucugcgcccggcagaaguucgagcgcgggggccagggguggaucuucgaccucuggggccgggggacccugaucgcgguguccagcgccuccaccaagggccccagcgucuucccccugcgcuccgcc

SEQ ID NO: 11357 - RNA, 423 nt, Artificial Sequence
  derived and/or modified sequence opt1 from anti-HIV-1_HeavyChain
caggugcagauggagcaggccggcgccgggaugaagaagcccggcgcgagcaugaccgucuccugcaagaccgccgacgaggacaucuucgacgccgccuacaugcacugggugcgccaggccccggggcagacguucgaguggcugggcuggaugaagcccgugaccggggcggucaacuacgcccggcaguuccagggccgcgccagcuucuaccggacccgcgagcucggcaucgccuacauggaccugcgggaccugaaguucgacgacaccgcgguguacuucugcgcccgcaagacgaagggggacguguccggcgacgaccggggguucuucuucgaccucuggggccgcgggacccgggucaucgugagcuccgccagcaccaagggccccuccguguucccccacgaccugcgc

SEQ ID NO: 11358 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccuggacuuccggcaccgcaucucccucacccgggaccgcgaccuguucaccgcccacauggacauccgggggcugacccagggcgacacggccaccuacuucugcgcccgccagaaguucuacaagggcgggcaggggugguacuucgaccucuggggccggggcacccugaucgucgugagcuccgcgagcaccaaggggcccuccguguucccccagaucugccgc

SEQ ID NO: 11359 - RNA, 414 nt, Artificial Sequence
  derived and/or modified sequence opt1 from anti-HIV-1_HeavyChain
caggcccaccuggagcagagcggcgccggggugaagaagcccggcgcguccguccgcgugagcugcuggaccuccgaggacaucuucgagaaguccgagcucauccacugggugcggcaggccccggggcagggccuggaguggaucgggugggucaagaccgugacgggcgccgugaaccugguccaccagaucagcgaccgcgugagccucacccgggaccgcgaccuguccaccgcccacauggacauccggggccugacccaggacgacacggccaccuacuucugcgcgcgccagaaguucgcccgcggggaccagggcugguucuucgaccucugggggcggggcacccugaucguggucagcuccgccagcaccaaggggcccuccguguucccccacgaccugcgg

SEQ ID NO: 11360 - RNA, 420 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccugagcaccgcccacauggacauccgggggcucacccaggacgacaccgccacguacuucugcgcgcgccagaaguucgcccggggcgaccaggggugguucuucgaccuguggggccgcgggacccugaucgugguguccagcgccuccaccaagggccccagcggccucccgccccggcugugcguc

SEQ ID NO: 11361 - RNA, 417 nt, Artificial Sequence
  derived and/or modified sequence opt1 from anti-HIV-1_HeavyChain
caggcccgccuggagcagagcggcuccggggugaagaagcccggcgccagcguccggguguccugcuggaccagcgaggacaucuucgagggguccgagcucauccacugggugcgccaggcgccgggccaggggcuggaguggaucggcugggucaagaccgugacgggcgccgugaacuucgggagcgccuacuuccggcaccgcgucucccugacccgggaccgcgaccucuucaccgcccacauggacauccggggccugacccagggggacacggccaccuacuucugcgcgcgccagaaguucgcccggggcgaccaggggugguucuucgaccuguggggccgcggcacccucaucguggugagcuccgccagcaccaaggggcccuccgucuucccccacgacagcgcc

SEQ ID NO: 11362 - RNA, 414 nt, Artificial Sequence
  derived and/or modified sequence opt1 from anti-HIV-1_HeavyChain
caggugcagcugguccagagcggcgccgaggugaagaagcccggguccagcgugaaggucuccugcaaggugagcggcgggguguucaccuccuacgccgucaccugggugcgccaggcgccgggccaggggcucgaguggaucggcugggugaaggccgucagcggcgccgugaacuacgggucccuggacuuccggcaccgcgugagccugacgcgggaccgcgaccucuucaccgcccacauggacauccggggccugacccaggacgacaccgccaucuacuucugcgcgcgccagaaguucgcccgcggggaccagggcugguucuucgaccugugggggcggggcacgcucaucgucguguccagcgccuccaccaagggccccagcguguucccccacgaccugcgg

SEQ ID NO: 11363 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccccaacuuccggcagcgcgucucccugacccgggaccgcgaccucuucaccgcccacauggacauccgggggcugacccagggcgacacggccaccuacuucugcgcccgccagaaguucgagcgcgggggccagggguggaucuucgaccuguggggccggggcacccucaucgcggugagcuccgccagcaccaaggggcccuccguguucccccacgaccugcgg

SEQ ID NO: 11364 - RNA, 417 nt, Artificial Sequence
  derived and/or modified sequence opt1 from anti-HIV-1_HeavyChain
cagagccaccuggagcaguccggcagcgccaugaagaagcccggggccuccgugaccgucagcugcuggaccuccgaggacaucuucgacacgaccgagcucaucuacugggugcgccaggcgccgggccaggggcuggaguggaucggcugggugaagaucgucagcgggaccgugaacuucgccucccuggacuuccggaaccgcaucagccucucccgggaccgcgaccugagcaccgcccacauggacauccggggccugacgcaggacgacaccgccaccuacuucugcgcccgccagaaguucgcgucccgguacagcggcgaccagggguccuacuucgaccucuggggccgcgggacccugaucaucgugagcuccgccagcacgaagggccccuccgacgaccugcgg

SEQ ID NO: 11365 - RNA, 414 nt, Artificial Sequence
  derived and/or modified sequence opt1 from anti-HIV-1_HeavyChain
caggugcagcugguccagagcggcgccgaggugaagaagcccggggccuccgugaaggucagcugcaaguccagcggcuacuccuucacccgcuucgacaucaccugggugcggcaggcgccggggcagggccucgaguggaucgggugggugaagacggucagcggcgccgugaacuucggcucccugaacuuccgccaccgggugagccugacccgcgaccgggaccucuucaccgcccacauggacauccgcgggcugacccagggcgacacggccaccuacuucugcgcccggcagaaguucgcgcgcggggaccagggcugguucuucgaccugugggggcggggcacccucaucgucguguccagcgccuccaccaagggccccagcguguucccccacgaccugcgc

SEQ ID NO: 11366 - RNA, 420 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgcccgggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucuacgccgggggccaggggugguacuucgaccuguggggccgcggcacccucaucgugguguccagcgcguccaccaaggggcccaucggccugccgccccggcugugcguc

SEQ ID NO: 11367 - RNA, 417 nt, Artificial Sequence
  derived and/or modified sequence opt1 from anti-HIV-1_HeavyChain
caggcccaccuggagcagagcggcgccggggugaagaagcccggcgcguccguccgcgugagcugcuggaccuccgaggacaucuucgagcggaccgagcucauccacugggugcgccaggccccggggcagggccuggaguggaucgggugggucaagacggugaccggcgccgugaacuucggcagccccaacuuccggcaccgcgucucccugacccgggaccgcgaccucuucaccgcccacauggacauccgggggcugacgcagggcgacaccgccaccuacuucugcgcgcgccagaaguucgagcgcgggggccaggggugguacuucgaccuguggggccggggcacccucaucguggugagcuccgccagcacgaaggggcccuccgucuucccccacgaccugcgg

SEQ ID NO: 11368 - RNA, 420 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccuguucaccgcccacauggacauccgggggcucacccaggacgacaccgccacguacuucugcgcgcgccagaaguucgcccggggcgaccaggggugguucuucgaccuguggggccgcgggacccugaucguggugagcuccgccagcaccaagggcccguccggccccagccccgagaucugcguc

SEQ ID NO: 11369 - RNA, 417 nt, Artificial Sequence
  derived and/or modified sequence opt1 from anti-HIV-1_HeavyChain
caggcccaccuggagcagagcggcgccggggugaagcgccccggcgcguccguccgggugagcugcuggaccuccgaggacaucuucgagaccacggagcucauccacugggugcgccaggccccggggcagggccuggaguggaucgggugggucaagaccgugagcggcgccgugaacuucggcucccugaacuuccggcaccgcgucagccucacccgggaccgcgaccuguucaccgcccacauggacauccgggggcugacgcagggcgacaccgccaccuacuucugcgcgcgccagaaguucgcccgcggggaccagggcugguucuucgaccucugggggcggggcacccugaucgugguguccagcgccuccacgaagggccccagcgucuucccccacgaccugcgg

SEQ ID NO: 11370 - RNA, 417 nt, Artificial Sequence
  derived and/or modified sequence opt1 from anti-HIV-1_HeavyChain
cgcgcccaccuggagcagagcggcuccggggugaagaagcucggcgccagcguccggguguccugcuggaccagcgaggacaucuucgagcgcaccgagcugauccacugggugcggcaggcgcccgggcagggccuggaguggaucgggugggucaaggccguguccggcgccgccaacuacggcagcccgaacuuccgccagcgggugucccucacgcgcgaccgggaccuguucaccgcccacauggacauccgcgggcugacccagggcgacaccgcgacguacuucugcgcccggcagaaguucgagcgcgggggccagggguggaucuucgaccucuggggccggggcacccugaucgccgucagcuccgccagcaccaaggggcccuccguguucccccacgaccugcgc

SEQ ID NO: 11371 - RNA, 417 nt, Artificial Sequence
  derived and/or modified sequence opt1 from anti-HIV-1_HeavyChain
caggugcaccuggagcagagcggcuccggggucaagaagcucggcgccagcgugcgcguguccugcuggaccagcgaggacaucuucgagcggaccgagcugauccacuggguccgccaggcccccgggcagggccuggaguggaucgggugggugaaggcgguguccggcgccgucaacuacggcagccucgacuuccggcaccgcgugucccugacgcgggaccgcgaccuguucaccgcccacauggacauccgggggcucacccaggacgacaccgccacguacuucugcgcccgccagaaguucgcgcggggcgaccaggggugguucuucgaccuguggggccgcgggacccugaucguggucagcuccgccagcaccaagggcccguccguguucccccacgaccuccgg

SEQ ID NO: 11372 - RNA, 417 nt, Artificial Sequence
  derived and/or modified sequence opt1 from anti-HIV-1_HeavyChain
cgcgcccaccuggagcagagcggcuccggggugaagaagcccggcgccagcguccggguguccugcuggaccagcgaggacaucuucgagcgcaccgagcucauccacugggugcggcaggcgccggggcagggccuggaguggaucgggugggucaagaucguguccggcgccgugaacuucggcagccccaacuuccgccagcgggccucccugacgcgcgaccgggaccucuucaccgcccacauggacauccgcgggcugacccagggcgacaccgccacguacuucugcgcgcggcagaaguucgagcgcgggggccagggguggaucuucgaccuguggggccggggcacccucaucgccgucagcuccgccagcaccaaggggcccuccguguuccccaccaucuacgug

SEQ ID NO: 11373 - RNA, 414 nt, Artificial Sequence
  derived and/or modified sequence opt1 from anti-HIV-1_HeavyChain
caggugcagcugguccagagcgaggccgaggugaagaagcccggcgccuccgugaagaucagcugcgcgaccuccggguacgccuucacccucuacuaccugcacuggguccgccaggccccgggccaggggcuggaguggaucggcugggugaagacggugaccggggccgucaacuucggcagcgccuacuuccggcaccgcgugucccucacccgggaccgcgaccuguucaccgcgcacauggacauccggggccugacgcagggggacaccgccaccuacuucugcgcccgccagaaguucuacaagggcgggcagggcugguacuucgaccucugggggcggggcacccugaucguggucagcuccgccagcacgaagggccccuccguguucccccacgaccugcgc

SEQ ID NO: 11374 - RNA, 420 nt, Artificial Sequence
  derived and/or modified sequence opt1 from anti-HIV-1_HeavyChain
caggcccaccccgagcagagcggcuccggggugaagaagccgggcgccagcguccgcguguccugcuggaccagcgaggacaucuucgagcggaccgagcugauccacugggugcgccaggcgcccgggcagggccucgaguggaucgggugggucaagaucguguccggcgccgugaacuucggcagccccaacuuccggcagcgcgucucccugacgcgggaccgcgaccuguucaccgcccacauggacauccgggggcucacccagggcgacaccgccacguacuucugcgcccgccagaaguucgagcgcgggggccagggguggaucuucgaccuguggggccggggcacccugaucgcggugagcuccgccagcaccaaggggcccuccggccucccgccccggcugugcgug

SEQ ID NO: 11375 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccccaacuuccggcaccgcgucucccugacccgggaccgcgaccucuucaccgcccacauggacauccgggggcugacccagggcgacacggccaccuacuucugcgcccgccagaaguucgagcgcgggggccaggggugguacuucgaccuguggggccggggcacccucaucguggugagcuccgcgagcaccaaggggcccuccgucuucccgccccggagcacg

SEQ ID NO: 11376 - RNA, 417 nt, Artificial Sequence
  derived and/or modified sequence opt1 from anti-HIV-1_HeavyChain
caggcccaccuggagcagagcggcuccggggugaagcgccccggcgccagcguccggguguccugcuggaccagcgaggacaucuucgagaaguccgagcucauccacugggugcgccaggcgccggggcagggccuggaguggaucgggugggucaagaccgugacgggcgccgugaacuucggcagccccaacuuccggcaccgcgucucccugacccgggaccgcgaccucuucaccgcccacauggacauccgggggcugacccagggcgacacggccaccuacuucugcgcccgccagaaguucgagcgcgggggccaggggugguacuucgaccuguggggccggggcacccucaucguggugagcuccgcgagcaccaaggggcccuccgucuucccccacgaccugcgg

SEQ ID NO: 11377 - RNA, 417 nt, Artificial Sequence
  derived and/or modified sequence opt1 from anti-HIV-1_HeavyChain
ggcgcccaccuggagcagagcggguccggcgugaagaagcccggggccagcguccgcguguccugcuggaccagcgaggacaucuucgagaaguccgagcucauccacugggugcggcaggcgccgggccaggggcuggaguggaucggcugggucaagaccgugacgggcgccgugaacuucgggagcuccgacuuccgccagcgggucagccugacccgcgaccgggaccucuucaccgcccacauggacauccgcggccugacccagggggacacggccaccuacuucugcgcccggcagaaguucuacgcgggcgggcagggcugguacuucgaccuguggggccgcgggacccucaucgugguguccagcgccuccaccaagggccccagcgucuucccccacgaccugcgg

SEQ ID NO: 11378 - RNA, 417 nt, Artificial Sequence
  derived and/or modified sequence opt1 from anti-HIV-1_HeavyChain
cgccacgaccuggagcagagcggcuccggggugaagaagcccggcgccagcguccggguguccugcuggaccagcgaggacaucuucgagcgcaccgagcucauccacugggugcggcaggccccggggcagggccuggaguggaucgggugggucaagaucguguccggcgcggugaacuucggcagccccaacuuccgccagcgggucucccugacgcgcgaccgggaccucuucaccgcccacauggacauccgcgggcugacccagggcgacaccgccacguacuucugcgcccggcagaaguucgagcgcgggggccagggguggaucuucgaccuguggggccggggcacccucaucgccgugagcuccgcgagcaccaaggggcccuccguguucccccacgaccugcgc

SEQ ID NO: 11379 - RNA, 420 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccuggacuuccggcaccgcaucucccucacccgggaccgcgaccuguucaccgcccacauggacauccgggggcugacccagggcgacacggccaccuacuucugcgcccgccagaaguucgagagccgguacaccgggggccaggggugguacuucgaccucuggggccgcggcacccacaucgucguguccagcgcguccacgaaggggcccagcgugaccaucuacguc

SEQ ID NO: 11380 - RNA, 414 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucuacgccgggggccaggggugguacuucgaccuguggggccgcggcacccucaucgugguguccagcgcgucccccgggcccaucggccccagcccgcgguccgcc

SEQ ID NO: 11381 - RNA, 417 nt, Artificial Sequence
  derived and/or modified sequence opt1 from anti-HIV-1_HeavyChain
caggcccaccuggagcagagcgccuccggcgugaagcgccccggggcgagcguccggguguccugcuggaccagcgaggacaucuucgagcgcaccgagcucauccacugggugcggcaggccccgggccaggggcuggaguggaucggcugggucaagacggugaccggggccgugaacuucggcuccagcgacuuccgccagcgggucucccugacccgcgaccgggaccucuucaccgcccacauggacauccgcggccugacgcagggggacaccgccaccuacuucugcgcgcggcagaaguucuacgccggcgggcagggcugguacuucgaccugugggggcgcggcacccucaucguggugagcuccgccagcacgaagggccccuccgucuucccccacgaccugcgg

SEQ ID NO: 11382 - RNA, 417 nt, Artificial Sequence
  derived and/or modified sequence opt1 from anti-HIV-1_HeavyChain
caggugcagcugguccagagcggcgccgaggugaagaagcccggggccuccgugcgcgucagcugcuggaccuccgaggacaucuucgagaaguccgagcucauccacugggugcggcaggcgccgggccaggggcuggaguggaucggcugggugaagaccgucacgggggccgugaacuucggcagcagcgacuuccgccagcgggugucccugacccgcgaccgggaccucuucaccgcccacauggacauccgcggccugacccagggggacacggccaccuacuucugcgcccggcagaaguucuacgcgggcgggcagggcugguacuucgaccugugggggcgcggcacccucaucgucgugagcuccgccagcaccaagggccccuccguguuccccacgaucuacguc

SEQ ID NO: 11383 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggagcggaucgggugggucaagacggugaccggcgccgugaacuucggcucccccaacuuccgccaccgggucagccugacccgcgaccgggaccucuucaccgcccacauggacauccgcgggcugacgcagggcgacaccgccaccuacuucugcgcccggcagaaguucgagcgcgggggccaggggugguacuucgaccuguggggccggggcacccucaucgugguguccagcgcguccacgaaggggcccagcgucuuccccaccaucugcgug

SEQ ID NO: 11384 - RNA, 420 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucauccacugggugcggcaggcgccgggccaggggcuggaguggaucggcugggugaagaccgucagcggggccgugaacuucggcucccugaacuuccgccaccgggugagccucacccgcgaccgggaccuguucaccgcccacauggacauccgcggccugacgcagggggacaccgccaccuacuucugcgcccggcagaaguucgcgcgcggcgaccaggggugguucuucgaccucuggggccgggggacccugaucgucguguccagcgccuccacgaacggccccaucggccccagccccaccgaccugcgc

SEQ ID NO: 11385 - RNA, 417 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccagugggugcgccaggcgcccgggcagggccuggaguggauggggugggucaaggccguguccggcgccgugaacuacggcagccucgacuuccggcaccgcgucucccugacgcgggaccgcgaccuguucaccgcccacauggacauccgggggcucacccaggacgacaccgccacguacuucugcgcgcgccagaaguucgcccggggcgaccaggggugguucuucgaccuguggggccgcgggacccugaucguggugagcuccgccagcaccaagggcccguccgucuucccccacgaccuccgg

SEQ ID NO: 11386 - RNA, 417 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaaggccgucagcggggccgugaacuacggcucccuggacuuccgccaccgggugagccucacccgcgaccgggaccuguccaccgcccacauggacauccgcggccugacccaggacgacacggccaccuacuucugcgcgcggcagaaguucgcccgcggggaccagggcugguucuucgaccucugggggcggggcacccugaucgucgugagcuccgccagcaccaaggggcccuccguguucccccacgaccugcgc

SEQ ID NO: 11387 - RNA, 417 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccugagcaccgcccacauggacauccgggggcucacccaggacgacaccgccacguacuucugcgcgcgccagaaguucgcccggggcgaccaggggugguucuucgaccuguggggccgcgggacccugaucgugguguccagcgccuccaccaagggcccgagcgucuuccccaccaucuacgug

SEQ ID NO: 11388 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacgcagggcgacaccgccaccuacuucugcgcccgccagaaguucgagcgcgggggccaggggugguacuucgaccuguggggccggggcacccucaucgugguguccagcgcguccacgaaggggcccagcgucuucccccacgacccgcgg

SEQ ID NO: 11389 - RNA, 423 nt, Artificial Sequence
  derived and/or modified sequence opt1 from anti-HIV-1_HeavyChain
cagguguacauggagcaggccggcgccgggaugaagaagcccggcgcgagcaugaccgucuccugcaagaccgccgacgaggacaucuucgacgccgccuacaugcacugggugcgccaggccccggggcagacguucgaguggcugggcuggaugaagcccgugaccggggcggucaacuacgcccggcaguuccagggccgcgugagcuucuaccggacccgcgagcucggcaucgccuacauggaccugcgggaccugaaguucgacgacaccgccguguacuucugcgcgcgcaagacgaagggggacgucuccggcgacgaccggggguucuucuucgaccucuggggccgcgggacccgggugaucgugagcuccgccagcaccaagggccccuccgucuucccccacgaccugcgc

SEQ ID NO: 11390 - RNA, 423 nt, Artificial Sequence
  derived and/or modified sequence opt1 from anti-HIV-1_HeavyChain
cagguguacauggagcaggccggcgggggcaugaagaagcccggggccagcaugaccgucuccugcaagaccgcggacgaggacaucuucgacgccgccuacaugcacugggugcgccaggcccggggccagacguucgaguggcugggguggaugaagccggugaccggcgccgucaacuacgcgcgccaguuccagggccgggugagcuucuaccgcacccgggagcucgggaucgccuacauggaccugcgcgaccugaaguucgacgacaccgccguguacuucugcgcccggaagacgaagggcgacgucuccggggacgaccgcggcuucuucuucgaccucugggggcggggcacccgcgugaucgugagcuccgcgagcaccaagggccccuccgucuuccccaccaucuacgug

SEQ ID NO: 11391 - RNA, 423 nt, Artificial Sequence
  derived and/or modified sequence opt1 from anti-HIV-1_HeavyChain
cagguguacauggagcaggccggcgccggggucaagaagcccggcgcgagcgugacccuguccugcaagaccgccgacgaggacguguucgacgccgccuacaugcacuggguccgccaggccccggggcagacguucgaguggcucggcuggaugaagcccgugaccggggcggugagcuacgcccggaaguuccagggccgcgucuccuucuacaugacccgggagcugggcauggccuacauggaccugcgcaaccuccgguucgacgacaccgccguguacuucugcgcgcgcaagacggccggggacgugagcggcgacaaccggggguacuucuucgaccuguggggccgcgggucccgggucaucgugagcuccgccagcaccaagggccccuccguguuccccaccaucuacguc

SEQ ID NO: 11392 - RNA, 423 nt, Artificial Sequence
  derived and/or modified sequence opt1 from anti-HIV-1_HeavyChain
cagguguacagcggcgccgggcgcggcggggucaagaagcccggcgccuccgugacccugagcugcaagaccgcggacgaggacguguucgacgccgccuacaugcacuggguccggcaggccccggggcagacguucgaguggcucggcuggaugaagcccgugaccggcgccgugaacuacgcgcgcaaguuccaggggcgggucuccuucuaccgcacccgggagcugggcaucgccuacauggaccugcgcaaccuccgguucgacgacaccgccguguacuucugcgcccgcaagacggcgggggacgugagcggcgacaagcggggguucuucuucgaccuguggggccgcggcucccgggucaucgugagcuccgccagcaccaaggggcccuccguguuccccaccaucuacguc

SEQ ID NO: 11393 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccccaacuuccggcaccgcgucucccugacccgggaccgcgaccucuucaccgcccacauggacauccgggggcugacccagggcgacacggccaccuacuucugcgcccgccagaaguucgagcgcgggggccaggggugguacuucgaccuguggggccggggcacccucaucguggugagcuccgcguucaccaaggggcccagcgucuucccccacgaccugcgg

SEQ ID NO: 11394 - RNA, 414 nt, Artificial Sequence
  derived and/or modified sequence opt1 from anti-HIV-1_HeavyChain
caggugcagcugggccagagcggggccgagaugaagaagcccggcuccagcgucaagguguccugcaaggccagcgggggcaccuuccgccacuccccgaucagcugggugcggcaggcgcccgggcagggccucgaguggaucggcugggucaaggccguguccggggccgugaacuacggcagccuggacuuccgccaccgggucucccugacccgcgaccgggaccucagcacggcccacauggacauccgcgggcugacccaggacgacaccgccaccuacuucugcgcgcggcagaaguucgcccgcggcgaccaggggugguucuucgaccuguggggccggggcacgcucaucgugguguccagcgccuccaccaaggggcccagcgucuucccccacgaccugcgc

SEQ ID NO: 11395 - RNA, 417 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaccgucaccggggccgugaacuucggcagccccaacuuccgccaccgggugucccugacccgcgaccgggaccucuucacggcccacauggacauccgcggccugacccagggggacaccgccaccuacuucugcgcccggcagaaguucgagcgcggcgggcagggcugguacuucgaccugugggggcggggcacgcucaucgucgugagcuccgcgagcaccaagggccccuccguguucccccacgaccugcgc

SEQ ID NO: 11396 - RNA, 423 nt, Artificial Sequence
  derived and/or modified sequence opt1 from anti-HIV-1_HeavyChain
cagguguacauggagcaggccggcgccggggucaagaagcccggcgcgagcgugacccuguccugcaagaccgccgacgaggacguguucgacgccgccuacaugcacuggguccgccaggccccggggcagacguucgaguggcucggcuggaugaagcccgugaccggggcggugagcuacgcccggaaguuccagggccgcgucuccuucuacaugacccgggagcugggcauggccuacauggaccugcgcaaccuccgguucgacgacaccgccguguacuucugcgcgcgcaagacggccggggacgugagcggcgacaaccggggguacuucuucgaccuguggggccgcggguccugggucaucgugagcuccgccagcaccaagggccccuccguguucccccacgaccugcgg

SEQ ID NO: 11397 - RNA, 423 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugaacuacgcgcggaaguuccagggccgcgucagcuucuaccggacccgcgagcuggggaucgccuacauggaccugcggaaccuccgcuucgacgacaccgccguguacuucugcgcccggaagacggcgggcgacguguccggggacaagcgcggcuucuucuucgaccugugggggcggggcagccgcgucaucguguccagcgccuccaccaagggccccagcguguuccccaccaucugcguc

SEQ ID NO: 11398 - RNA, 417 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcggggccuggaguggaucgggugggucaaggccguguccggcgccgugaacuacggcagccucgacuuccgccaccgggucucccugacgcgcgaccgggaccuguucaccgcccacauggacauccgcgggcucacccaggacgacaccgccacguacuucugcgcgcggcagaaguucgcccgcggcgaccaggggugguucuucgaccuguggggccgggggacccugaucguggugagcuccgccagcaccaagggcccguccgucuucccccacgaccuccgc

SEQ ID NO: 11399 - RNA, 423 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugaacuacgcgcggaaguuccagggccgcgucagcuucuaccggacccgcgagcuggggaucgccuacauggaccugcggaaccuccgcuucgacgacaccgccguguacuucugcgcccggaagacggcgggcgacguguccggggacaagcgcggcuucuucuucgaccugugggggcggggcagccgcgucaucguguccagcgccuccaccaagggccccagcguguuccccaccaucuacguc

SEQ ID NO: 11400 - RNA, 423 nt, Artificial Sequence
  derived and/or modified sequence opt1 from anti-HIV-1_HeavyChain
cagguguucauggagcaggccggcgccgggaugaagaagcccggcgcgagcaugaccgucuccugcaagaccgccgacgaggacguguucgacgccgccuacaugcacugggugcgccaggccccggggcagacguucgaguggcugggcuggaugaagcccgucaccggggcggugaacuacgcccggaaguuccagggccgcgugagcuucuaccggacccgcgagcucggcaucgccuacauggaccugcggaaccugcgcuucgacgacaccgccgucuacuucugcgcgcggaagacggccggggacguguccggcgacaagcgcggguucuucuucgaccucuggggccgggggagccgcgugaucgucuccagcgccuccaccaagggccccagcguguucccccacgaccugcgg

SEQ ID NO: 11401 - RNA, 423 nt, Artificial Sequence
  derived and/or modified sequence opt1 from anti-HIV-1_HeavyChain
cagguguacauggagcaggccggcgccggggucaagaagcccggcgcgagcgugacccuguccugcaagaccgccgacgaggacguguucgacgccgccuacaugcacuggguccgccaggccccggggcagacguucgaguggcucggcuggaugaagcccgugaccggggcggugaacuacgcccggaaguuccagggccgcgucagcuucuaccggacccgcgagcugggcaucgccuacauggaccugcggaaccuccgccuggacgacaccgccguguacuucugcgcgcggaagacggccggggacguguccggcgacaagcgcggguucuucuucgaccuguggggccgggggagccgcgucaucguguccagcgccuccaccaagggccccagcguguucccccacgaccuccgg

SEQ ID NO: 11402 - RNA, 420 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucaucuacugggugcgccaggcgccgggccgggggcuggaguggaucggcugggugaagacggucagcgggaccgugaacuucggcuccagcgacuuccgcaaccggaucucccugacccgcgaccgggaccucagcaccgcccacauggacauccgcggccugacgcaggacgacaccgccaccuacuucugcgcccggcagaaguucgagucccuguacagcgacgaccagggguccuacuucgaccucuggggccgcgggacccugaucaucgugagcuccgccagcacgaagggccccuccgucuuccccaccauc

SEQ ID NO: 11403 - RNA, 423 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugagcuacgcgcggaaguuccagggccgcgucuccuucuacaugacccgggagcuggggauggccuacauggaccugcgcaaccuccgguucgacgacaccgccguguacuucugcgcccgcaagacggcgggcgacgugagcggggacaaccggggcuacuucuucgaccugugggggcgcggcucccgggucaucgugagcuccgccagcaccaagggccccuccguguuccccaccaucugcguc

SEQ ID NO: 11404 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguacuacgccgggggccaggggugguacuucgaccuguggggccgcggcacccucaucgugguguccagcgcguccaccaaggggcccagcgucuucccccacgaccugcgg

SEQ ID NO: 11405 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccuggacuuccggcaccgcaucucccucacccgggaccgcgaccuguucaccgcccacauggacauccgggggcugacccagggcgacacggccaccuacuucugcgcccgccagaaguucgagagccgguacaccgggggccaggggugguacuucgaccucuggggccgcggcacccacaucgucguguccagcgcguccacgaaggggcccagcguguucccccacgaccugcgg

SEQ ID NO: 11406 - RNA, 423 nt, Artificial Sequence
  derived and/or modified sequence opt1 from anti-HIV-1_HeavyChain
cagguguacaugggcgccgggcgcggcggggucaagaagcccggcgccagcgugacccuguccugcaagaccgcggacgaggacguguucgacgccgccuacaugcacuggguccggcaggccccggggcagacguucgaguggcucggcuggaugaagcccgugaccggcgccgugaacuacgcgcgcaaguuccaggggcgggucagcuucuaccgcacccgggagcugggcaucgccuacauggaccugcgcaaccuccgguucgacgacaccgccguguacuucugcgcccgcaagacggcgggggacguguccggcgacaagcggggguucuucuucgaccuguggggccgcggcagccgggucaucguguccagcgccuccaccaaggggcccagcguguuccccaccaucuacguc

SEQ ID NO: 11407 - RNA, 423 nt, Artificial Sequence
  derived and/or modified sequence opt1 from anti-HIV-1_HeavyChain
cagguguacauggagcaggccggcgggggcaugaagaagcccggggccagcaugaccgucuccugcaagaccgcggacgaggacaucuucgacgccgccuacaugcacugggugcgccaggccccgggccagacguucgaguggcugggguggaugaagcccgugaccggcgccgucaacuacgcgcggcaguuccagggccgcgugagcuucuaccggacccgcgagcucgggaucgccuacauggaccugcgggaccugaaguucgacgacaccgccguguacuucugcgcccgcaagacgaagggcgacgucuccggggacgaccggggcuucuucuucgaccucugggggcgcggcacccgggugaucgugagcuccgcgagcaccaagggccccuccgucuuccccaccaucugcgug

SEQ ID NO: 11408 - RNA, 423 nt, Artificial Sequence
  derived and/or modified sequence opt1 from anti-HIV-1_HeavyChain
cagguguacauggagcaggccggcgggggcaugaagaagcccggggccagcaugaccgucuccugcaagaccgcggacgaggacaucuucgacgccgccuacaugcacugggugcgccaggccccgggccagacguucgaguggcugggguggaugaagcccgugaccggcgccgucaacuacgcgcggcaguuccagggccgcgugagcuucuaccggacccgcgagcucgggaucgccuacauggaccugcgggaccugaaguucgacgacaccgccguguacuucugcgcccgcaagacgaagggcgacgucuccggggacgaccggggcuucuucuucgaccucugggggcgcggcacccgggugaucgugagcuccgcgagcaccaagggccccuccgucuucccccacgaccugcgc

SEQ ID NO: 11409 - RNA, 423 nt, Artificial Sequence
  derived and/or modified sequence opt1 from anti-HIV-1_HeavyChain
cagguguacauggagcaggccggcgccggggucaagaagcccggcgcgagcgugacccuguccugcaagaccgccgacgaggacguguucgacgccgccuacaugcacuggguccgccaggccccggggcagacguucgaguggcucggcuggaugaagcccgugaccggggcggugaacuacgcccggaaguuccagggcaaggucagcuucuaccgcacccgggagcugggcaucgccuacauggaccugcgcaaccuccgguucgacgacaccgccguguacuucugcgcgcgcaagacggccggggacguguccggcgacaagcggggguucuucuucgaccuguggggccgcgggagccgggucaucguguccagcgccuccaccaagggccccagcguguucccccacgaccugcgc

SEQ ID NO: 11410 - RNA, 423 nt, Artificial Sequence
  derived and/or modified sequence opt1 from anti-HIV-1_HeavyChain
cagguguacauggagcaggccggcgccggggucaagaagcccggcgcgagcgugacccuguccugcaagaccgccgacgaggacguguucgacgccgccuacaugcacuggguccgccaggccccggggcagacguucgaguggcucggcuggaugaagcccgugaccggggcggugaacuacgcccggaaguuccagagccgcgucuccuucuacggcacccgggagcugggcaucgccuacauggaccugcgcaaccuccgguucgacgacaccgccguguacuucugcgcgcgcaagacggccggggacgugagcggcgacaagcggggguucuucuucgaccuguggggccgcgggucccgggucaucgugagcuccgccagcaccaagggccccuccguguucccccacgaccugcgc

SEQ ID NO: 11411 - RNA, 420 nt, Artificial Sequence
  derived and/or modified sequence opt1 from anti-HIV-1_HeavyChain
cagggccacaccguggagcagagcggguccggcgucaagaagcugggggccagcgugcgcguguccugcuggaccagcgaggacaucuucgagacgaccgagcucauccacuggguccggcaggcccccggccaggggcuggaguggaucggcugggugaagaccguguccggcgcggucaacuucgggagccugaacuuccgccaccgggugucccucacccgcgaccgggaccuguucacggcccacauggacauccgcggccugacccagggggacaccgccaccuacuucugcgcccggcagaaguucgcccgcggcgaccaggggugguucuucgaccucuggggccggggcacgcugaucguggucagcuccgcgagcaccaaggggccguccguguucccccacgaccugcgc

SEQ ID NO: 11412 - RNA, 420 nt, Artificial Sequence
  derived and/or modified sequence opt1 from anti-HIV-1_HeavyChain
caggccacccccuggagcaaccugggccgcggggugaagaagcucggcgccuccguccgggugagcugcuggaccuccgaggacaucuucgagcgcacggagcugauccacugggugcggcaggcgccggggcagggccuggaguggaucgggugggucaagaccgugaccggcgccgugaacuucggcagccccaacuuccgccaccgggucucccucacccgcgaccgggaccuguucacggcccacauggacauccgcgggcugacccagggcgacaccgccaccuacuucugcgcccggcagaaguucgagcgcgggggccaggggugguacuucgaccucuggggccggggcacgcugaucguggugagcuccgcgagcaccaaggggcccuccgucuucccccacgaccugcgc

SEQ ID NO: 11413 - RNA, 423 nt, Artificial Sequence
  derived and/or modified sequence opt1 from anti-HIV-1_HeavyChain
cagguguucauggagcaggccggcgccgggaugaagaagcccggcgcgagcaugaccgucuccugcaagaccgccgacgaggacguguucgacgccgccuacaugcacugggugcgccaggccccggggcagacguucgaguggcugggcuggaugaagcccgucaccggggcggugagcuacgcccggaaguuccagggccgcguguccuucuacaugacccgggagcucggcauggccuacauggaccugcgcaaccugcgguucgacgacaccgccgucuacuucugcgcgcgcaagacggccggggacgugagcggcgacaaccggggguacuucuucgaccucuggggccgcgggucccgggugaucgucagcuccgccagcaccaagggccccuccguguucccccacgaccugcgc

SEQ ID NO: 11414 - RNA, 423 nt, Artificial Sequence
  derived and/or modified sequence opt1 from anti-HIV-1_HeavyChain
cagguguacauggagcagagcggcgggggcgucaagaagcccggggccuccgugacccugagcugcaagaccgccgacgaggacguguucgacgcggccuacaugcacuggguccgccaggccccgggccagacguucgaguggcucggguggaugaagcccgugaccggcgccguguccuacgcccggaaguuccagggccgcgucagcuucuaccggacccgcgagcuggggaucgcguacauggaccugcggaaccuccgcuucgacgacaccgccguguacuucugcgcccggaagacggccggcgacguguccggggacaagcgcggcuucuucuucgaccugugggggcggggcagccgcgucaucguguccagcgcguccaccaagggccccagcguguucccccacgaccugcgg

SEQ ID NO: 11415 - RNA, 423 nt, Artificial Sequence
  derived and/or modified sequence opt1 from anti-HIV-1_HeavyChain
cagguguacauggagcgcggccgcgggggcgucaagaagcccggggccagcgugacccuguccugcaagaccgccgacgaggacguguucgacgcggccuacaugcacuggguccggcaggccccgggccagacguucgaguggcucggguggaugaagcccgugaccggcgccgugaacuacgcccggaaguuccagggccgcgucagcuucuaccggacccgcgagcuggggaucgcguacauggaccugcggaaccuccgcuucgacgacaccgccguguacuucugcgcccggaagacggccggcgacguguccggggacaagcgcggcuucuucuucgaccugugggggcggggcagccgcgucaucguguccagcgcguccaccaagggccccagcguguucccccacgaccugcgg

SEQ ID NO: 11416 - RNA, 423 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugagcuacgcgcggcgcuuccagggccgggucuccuucuacaugacccgcgagcuggggauggccuacauggaccugcggaaccuccgcuucgacgacaccgccguguacuucugcgcccggaagacggcgggcgacgugagcggggacaaccgcggcuacuucuucgaccugugggggcggggcucccgcgucaucgugagcuccgccagcaccaagggccccuccguguuccccaccaucugcguc

SEQ ID NO: 11417 - RNA, 423 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugagcuacgcgcggaaguuccagggccgcgucuccuucuacaugacccgggagcuggggauggccuacauggaccugcgcaaccuccgguucgacgacaccgccguguacuucugcgcccgcaagacggcgggcgacgugagcggggacaaccggggcuacuucuucgaccugugggggcgcggcucccgggucaucgugagcuccgccagcaccaagggccccuccguguucccccacgaccugcgc

SEQ ID NO: 11418 - RNA, 423 nt, Artificial Sequence
  derived and/or modified sequence opt1 from anti-HIV-1_HeavyChain
cagguguucauggagcaggccggcgggggcaugaagaagcccggggccagcaugaccgucuccugcaagaccgcggacgaggacaucuucgacgccgccuacaugcacugggugcgccaggccccgggccagacguucgaguggcugggguggaugaagcccgugaccggcgccgucaacuacgcgcggcaguuccagggccgcgugagcuucuaccggacccgcgagcucgggaucgccuacauggaccugcgggaccugaaguucgacgacaccgccguguacuucugcgcccgcaagacgaagggcgacgucuccggggacgaccggggcuucuucuucgaccucugggggcgcggcacccgggugaucgugagcuccgcgagcaccaagggccccuccgucuucccccacgaccugcgc

SEQ ID NO: 11419 - RNA, 423 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccuggacuuccggcaccgcaucagccucacccgggaccgcgaccuguucaccgcccacauggacauccgggggcugacgcagggcgacaccgccaccuacuucugcgcccgccagaaguucgcgucccgguacagcggggaccagggcuccuacuucgaccucugggggcgcggcacccugaucgucgugagcuccgccagcacgaagggccccuccguguucccccacgaccug

SEQ ID NO: 11420 - RNA, 423 nt, Artificial Sequence
  derived and/or modified sequence opt1 from anti-HIV-1_HeavyChain
cagguguucauggagcaggccggcgccgggaugaagaagcccggcgcgagcaugaccgucuccugcaagaccgccgacgaggacguguucgacgccgccuacaugcacugggugcgccaggccccggggcccgaccuggaguggcucggcuggaugaagcccgucacgggggcggugaacuacgcccggaaguuccagggccgcgugagcuucuaccggacccgcgagcugggcaucgccuacauggaccugcgggaccuccgcuucgacgacaccgccgucuacuucugcgcgcggaagaccgccggggacguguccggcgacaagcgcggguucuucuucgaccuguggggccgggggagccgcgugaucgucuccagcgccuccacgaaggcccaccggagcucccccaccaucugcgug

SEQ ID NO: 11421 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcaucagccugacccgggaccgcgaccucuucaccgcccacauggacauccgggggcugacgcagggcgacaccgccaccuacuucugcgcccgccagaaguucgagucccgguacaccgggggccaggggugguacuucgaccuguggggccgcggcacgcacaucgucgugagcuccgcgagcaccaaggggcccuccguguucccccacgaccuccgg

SEQ ID NO: 11422 - RNA, 423 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugagcuacgcgcggaaguuccagggccgcgucuccuucuacaugacccgggagcuggggauggccuacauggaccugcgcaaccuccgguucaacgacaccgccguguacuucugcgcccgcaagacggcgggcgacgugagcggggacaaccggggcuacuucuucgaccugugggggcgcggcucccgggucaucgugagcuccgccagcaccaagggccccuccguguucccccacgaccugcgc

SEQ ID NO: 11423 - RNA, 423 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugaacuacgcgcggaaguuccagggccgcgucagcuucuaccggacccgcgagcuggggaucgccuacauggaccugcggaaccuccgcuucgacgacaccgccguguacuucugcgcccggaagacggcgggcgacguguccggggacaaccgcggcuacuucuucgaccugugggggcggggcagccgcgucaucguguccagcgccuccaccaagggccccagcgggcugccccacgaccuccgg

SEQ ID NO: 11424 - RNA, 423 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugaacuacgcgcggaaguuccagggccgcgucagcuucuaccggacccgcgagcuggggaucgccuacauggaccugcggaaccuccgcuucgacggcaccgccguguacuucugcgcccggaagacggcgggggacguguccggcgacaagcgcggguucuucuucgaccuguggggccggggcagccgcgucaucguguccagcgccuccaccaaggggcccagcguguucccccacgaccugcgg

SEQ ID NO: 11425 - RNA, 423 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugaacuacgcgcggaaguuccagggccgcgucagcuucuaccggacccgcgagcuggggaucgccuacauggaccugcggaaccuccgcuucgacgacaccgccguguacuucugcgcccggaagacggcgggcgacguguccggggacaagcgcggcuucuucuucgaccugugggggcggggcagccgcgucaucguguccagcgccuccaccaagggccccagcguguucccccacgaccugcgg

SEQ ID NO: 11426 - RNA, 423 nt, Artificial Sequence
  derived and/or modified sequence opt1 from anti-HIV-1_HeavyChain
caggugcagcugguccagagcggcgccgaggugaagaagcccggggccucccucaaggugagcugcaaggcguccggcuacaccuucaccgacuacuacauccacuggguccgccaggccccggggcagggccuggaguggaucgggugggugaagaucgugagcggcacggucaacuucgccucccuggacuuccggaaccgcaucagccucucccgggaccgcgaccugagcaccgccuacauggacauccggggccugacccaggacgacaccgccacguacuucugcgcgcgccagaaguucgccucccgguacagcggggaccagggcuccuacuucgaccucugggggcgcggcacccugaucguggugagcuccgccagcaccaaggggcccuccgucuucccccacgaccugcgg

SEQ ID NO: 11427 - RNA, 423 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccuggacuuccggcaccgcaucucccucacccgggaccgcgaccuguucaccgcccacauggacauccgggggcugacccagggcgacacggccaccuacuucugcgcccgccagaaguucgagagccgguacaccgggggccaggggugguacuucgaccucuggggccgcggcacccugaucgucguguccagcgcguccacgcgggcccaccgcagcccccacgaccugcgg

SEQ ID NO: 11428 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcagcgcgucagccugacccgggaccgcgaccucuucaccgcccacauggacauccgggggcugacgcagggcgacaccgccaccuacuucugcgcccgccagaaguucgagucccgguacaccgggggccaggggugguacuucgaccuguggggccgcggcacgcacaucguggugagcuccgcgagcaccaaggggcccuccgucuucccccacgaccuccgg

SEQ ID NO: 11429 - RNA, 426 nt, Artificial Sequence
  derived and/or modified sequence opt1 from anti-HIV-1_HeavyChain
caggugcagcugguccagagcggcgccgaggugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgccuacauggacauccgcggccugacccaggacgacacggccaccuacuucugcgcccggcagaaguucgcgucccgcuacagcggcgaccagggguccuacuucgaccucuggggccgggggacccugaucguggucagcuccgccagcaccaagggccccuccguguucccccagaucugcgug

SEQ ID NO: 11430 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucaucuacugggugcgccaggcgccgggccgggggcuggaguggaucggcuggaugaagacggugagcgggaccgucaacuucggcuccagcgacuuccgcaaccggaucucccugacccgcgaccgggaccucagcaccgcccacauggacauccgcggccugacgcaggacgacaccgccaccuacuucugcgcccggcagaaguucgagucccuguacagcgacgaccagggguccuacuucgaccucuggggccgcgggacccugaucaucgugagcuccgccagcacgaaggcgcaccgguccagccccaccacccugcgc

SEQ ID NO: 11431 - RNA, 423 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugacccaggacgacacggccaccuacuucugcgcccggcagaaguucgcgucccgcuacagcggcgaccagggguccuacuucgaccucuggggccgggggacccugaucaucgugagcuccgccagcaccaagggccccuccgucuucccccgcagcgcc

SEQ ID NO: 11432 - RNA, 423 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggccaccagaucagcgaccgcgucucccugagccgggaccgcgaccucuccaccgccuacauggacauccgggggcugacccaggacgacaccgccacguacuucugcgcccgccagaaguucgcgagccgguacuccggcgaccaggggagcuacuucgaccuguggggccgcgggacccucaucgugguguccagcgccuccaccaagggccccagcgucuucccccacgaccugcgg

SEQ ID NO: 11433 - RNA, 423 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugacccaggacgacacggccaccuacuucugcgcccggcagaaguucgcgucccgcuacagcggcgaccagggguccuacuucgaccucuggggccgggggacccugaucaucgugagcuccgccagcacccgcgcccaccgguccagcccccgcuccgcc

SEQ ID NO: 11434 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccaccggaucagccugacccgcgaccgggaccucuucaccgcccacauggacauccgcgggcugacccagggcgacacggccaccuacuucugcgcccggcagaaguucgagucccgcuacaccgggggccaggggugguacuucgaccuguggggccggggcacccacaucgucgugagcuccgcgagcacgaaggggcccuccguguucccccacgaccuccgc

SEQ ID NO: 11435 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucggcuccagcgacuuccgcaaccggaucucccugacccgcgaccgggaccucagcaccgcccacauggacauccgcggccugacgcaggacgacaccgccaccuacuucugcgcccggcagaaguucgagucccuguacagcgacgaccagggguccuacuucgaccucuggggccgcgggacccugaucaucgugagcuccgccagcacgaagggccccuccgucuuccccaccaucuacgug

SEQ ID NO: 11436 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgccuacauggacauccgcggccugacccaggacgacacggccaccuacuucugcgcccggcagaaguucgcgucccgcuacagcggcgaccagggguccuacuucgaccucuggggccgggggacccugaucguggucagcuccgccagcaccaagggccccuccguguucccccacgaccugcgc

SEQ ID NO: 11437 - RNA, 423 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugacccaggacgacacggccaccuacuucugcgcccggcagaaguucgcgucccgcuacagcggcgaccagggguccuacuucgaccucuggggccgggggacccugaucaucgugagcuccgccagcaccaagggccccuccgucuuccccacgaucugc

SEQ ID NO: 11438 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuccaccgcccacauggacauccgggggcugacgcaggacgacaccgccaccuacuucugcgcccgccagaaguucgcgcggggcgaccaggggugguucuucgaccuguggggccgcgggacccucaucguggugagcuccgcccugcaccagggccccaucggccugcccccgcggagcacg

SEQ ID NO: 11439 - RNA, 423 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugaacuacgcgcggaaguuccagggccgcgucagcuucuaccggacccgcgagcuggggaucgccuacauggaccugcggaaccuccgcuucgacgacaccgccguguacuucugcgcccggaagacggcgggcgacguguccggggacaagcgcggcuucuucuucgaccugugggggcggggcagccgcgucaucguguccagcgccuccaccaagggccccagcgugcugcccccgcgguccgcc

SEQ ID NO: 11440 - RNA, 423 nt, Artificial Sequence
  derived and/or modified sequence opt1 from anti-HIV-1_HeavyChain
caggugcagcugguccagagcggcgccgaggugaagaagcccggggccuccgugaagaucagcugcaaggcguccggcuacaccuucauccgccacgggauccacuggcuccggcagguccccggccagcgccccgaguggaugggguggauccggcccaagaccggcgcccgcaaccaggcccggcaguuccagccccgcaucagccuggcccgggaccgcgcccuguccacggcguaccucgaccugaacagccugaccuccgccgacagcggcaccuacuucugcgcccggcagaccuucaagccggacuucuacuucgccgaccaggggugguccuucaaccucuggggccgcggggcgcacuucaucgugagcuccgcccugcaccagggccccaucgggcugccgccccggagcacg

SEQ ID NO: 11441 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucaucuacugggugcgccaggcgccgggccaggggcuggaguggaucggcugggugaagaucgucagcgggacggugaacuucgccucccuggacuuccggaaccgcaucagccucucccgggaccgcgaccugagcaccgccuacauggacauccggggccugacccaggacgacaccgccacguacuucugcgcccgccagaaguucgcgucccgguacagcggcgaccagggguccuacuucgaccucuggggccgcgggacccugaucguggucagcuccgccagcaccaagggccccuccguguucccccacgaccugcgg

SEQ ID NO: 11442 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccuggacuuccggcaccgcaucagccucacccgggaccgcgaccuguucaccgcccacauggacauccgggggcugacgcagggcgacaccgccaccuaccucugcgcccgccagaaguucgagucccgguacaccgggggccaggggugguacuucgaccuguggggccgcggcacgcacaucgucgugagcuccgcgagcaccaaggggcccuccguguuccccaccaucugcguc

SEQ ID NO: 11443 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgacaccacggagcucaucuacugggugcggcaggcgccggggcagggccuggaguggaucgggugggucaagaucguguccggcaccgugaacuucgccagccuggacuuccgcaaccggaucucccucagccgcgaccgggaccuguccaccgccuacauggacauccgcggccugacccaggacgacacggccaccuacuucugcgcccggcagaaguucgcgagccgcuacuccggggaccagggcagcuacuucgaccucugggggcggggcacccugaucgucguguccagcgccuccaccaaggggcccagcguguucccccagaucugcguc

SEQ ID NO: 11444 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccuggacuuccggcaccgcaucagccucacccgggaccgcgaccuguucaccgcccacauggacauccgggggcugacgcagggcgacaccgccaccuacuucugcgcccgccagaaguucgagucccgguacaccgggggccaggggugguacuucgaccucuggggccgcggcacgcacaucgucgugagcuccgcgagcaccaaggggcccuccguguuccccaccaucugcguc

SEQ ID NO: 11445 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucgagucccuguacagcgacgaccagggguccuacuucgaccucuggggccgcgggacccugaucaucgugagcuccgcgagcaccaagggccccuccguguuccccacgaucugcguc

SEQ ID NO: 11446 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccccaacuuccggcaccgcgucucccugacccgggaccgcgaccucuucaccgcccacauggacauccgggggcugacccagggcgacacggccaccuacuucugcgcccgccagaaguucgagagccgguacaccgggggccaggggugguacuucgaccuguggggccgcggcacccacaucgugguguccagcgcguccacgaaggggcccagcgucuucccccacgaccuccgg

SEQ ID NO: 11447 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugacccaggacgacacggccaccuacuucugcgcccggcagaaguucgcgucccgcuacagcggcgaccagggguccuacuucgaccucuggggccgggggacccugaucaucgugagcuccgccagcaccaagggccccuccgucuuccccacgaucugcgug

SEQ ID NO: 11448 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcaccgugaacuucggcucccugaacuuccggcagcgcgucagccucacccgggaccgcgaccuguucacggcccacauggacauccgggggcugacccaggacgacaccgccaccuacuucugcgcccgccagaaguucgccucccgguacagcggcgaccagggguccuacuucgaccucuggggccgcgggacgcugaucguggugagcuccgcgagcaccaagggccccuccgucuuccccaccaucugcgug

SEQ ID NO: 11449 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugacccaggacgacacggccaccuacuucugcgcccggcagaaguucgcgucccgcuacagcggcgaccagggguccuacuucgaccucuggggccgggggacccugaucaucgugagcuccgccagcaccaagggccaccgcuccagccccacgaucugcguc

SEQ ID NO: 11450 - RNA, 423 nt, Artificial Sequence
  derived and/or modified sequence opt1 from anti-HIV-1_HeavyChain
cagguguacauggagcaggccggcgccgggaugaagaagcccggcgcgagcaugaccgucuccugcaagaccgccgacgaggacguguucgacgccgccuacaugcacugggugcgccaggccccggggcagacguucgaguggcugggcuggaugaagcccgucaccggggcggugaacuacgcccggaaguuccagggccgcgugagcuucuaccggacccgcgagcucggcaucgccuacauggaccugcggaaccugcgcuucgacgacaccgccgucuacuucugcgcgcggaagacggccggggacguguccggcgacaagcgcggguucuucuucgaccucuggggccgggggagccgcgugaucgucuccagcgccuccaccaagggccccagcguguuccccaccaucuacgug

SEQ ID NO: 11451 - RNA, 423 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucuacugggugcggcaggcgccgggccaggggcuggaguggaucggcugggugaagaucgucagcgggaccgugaacuucgccucccuggacuuccgcaaccggaucagccucucccgcgaccgggaccugagcaccgccuacauggacauccgcggccugacccaggacgacacggccaccuacuucugcgcccggcagaaguucgcgucccgcuacagcggcgaccagggguccuacuucgaccucuggggccgggggacccugaucguggucagcuccgccagcaccaagggccccuccguguucccccacgaccugcgc

SEQ ID NO: 11452 - RNA, 423 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgcccgccaguuccagggccggguguccuucuaccgcacccgggagcugggcaucgccuacauggaccuccgcgaccugaaguucgacgacaccgccgucuacuucugcgcccggaagacgaagggggacgugagcggcgacgaccgcggguucuucuucgaccuguggggccgggggacccgcgugaucgucuccagcgcguccaccaagggccccagcguguucccccacgaccccgcc

SEQ ID NO: 11453 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucgagucccgcuacaccgggggccaggggugguacuucgaccuguggggccggggcacccacaucguggugagcuccgcgagcacgaaggggcccuccgucuuccccaccaucugcgug

SEQ ID NO: 11454 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcgguccgagcucauccacugggugcgccaggcgccggggcagggccuggaguggaucgggugggucaagaccgugacgggcgccgugaacuucggcagccccaacuuccggcagcgcgucucccugacccgggaccgcgaccucagcaccgcccacauggacauccgggggcugacccaggacgacacggccaccuacuucugcgcccgccagaaguucgagucccuguacagcgacgaccagggcuccuacuucgaccucugggggcggggcacccugaucaucgugagcuccgcgagcaccaaggggcccuccguguuccccacgaucugcguc

SEQ ID NO: 11455 - RNA, 426 nt, Artificial Sequence
  derived and/or modified sequence opt1 from anti-HIV-1_HeavyChain
caggcccaccuggagcagagcgccuccggcgugaagcgccccggggcgagcguccggguguccugcuggaccagcgaggacaucuucgagcgcaccgagcucaucuacugggugcggcaggccccgggccaggggcuggaguggaucggcugggucaagacgguguccggggccgugaacuucggcagccaggacuuccgcgaccgguucucccugacccgcgaccgggaccucuucaccgcccacauggacauccgcggccugacccagggggacacggccaccuacuucugcgcgcggcagaaguucgccagccgcuacuccggcgaccaggggagcuacuucgaccuguggggccgggggacccucaucgucguguccagcgccuccaccaagggccccagcguguuccccacgaucugcguc

SEQ ID NO: 11456 - RNA, 426 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccuguucaccgcccacauggacauccgggggcucacccaggacgacaccgccacguacuucugcgcgcgccagaaguucgagagccgguacaccggcgggcagggcugguacuucgaccugugggggcgcggcacccacaucgugguguccagcgccuccaccaagggcccgagcgucuuccccacgaucugcgug

SEQ ID NO: 11457 - RNA, 423 nt, Artificial Sequence
  derived and/or modified sequence opt1 from anti-HIV-1_HeavyChain
caggugcacauggagcaggccggcgggggcaugaagaagcccggggccagcaugaccgucuccugcaagaccgcggacgaggacaucuucgacgccgccuacaugcacugggugcgccaggccccgggccagacguucgaguggcugggguggaugaagcccgugaccggcgccgucaacuacgcgcggcaguuccagggccgcgugagcuuccuccaggaccaggggauccggaucgccuacauggaccugcgcgaccugaaguucgacgacaccgccguguacuucugcgcccggaagaccaagggcgacgucuccggggacgaccgcggcuucuucuucgaccucugggggcggggcacgcgcgugaucgugagcuccagccugcaccagggccccaucgggcugcccccgcgguccgcg

SEQ ID NO: 11458 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccaccggaucagccugacccgcgaccgggaccucuucaccgcccacauggacauccgcgggcugacccagggcgacacggccaccuacuucugcgcccggcagaaguucgagucccgcuacaccgggggccaggggugguacuucgaccuguggggccggggcacccacaucgucgugagcuccgcgagcacgaaggggcccuccguguuccccaccaucuacguc

SEQ ID NO: 11459 - RNA, 426 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugaacuacgcgcggaacuuccagggccgcgucagcuucuaccggacccgcgagcuggggaucgccuacauggaccugcggaaccuccgcuucgacgacaccgccguguacuucugcgcccggaagacgaagggcgacguguccggggacgaccgcggcuucuucuucgaccugugggggcggggcacccgcgucaucgugagcuccggccugcaccagcgggcgcaccgcagcucccccaccaucugcgug

SEQ ID NO: 11460 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgccuacauggacauccgcggccugacccaggacgacacggccaccuacuucugcgcccggcagaaguucgcgucccgcuacagcggcgaccagggguccuacuucgaccucuggggccgggggacccugaucguggucagcuccgccagcaccaagggccccuccguguuccccacgaucugcgug

SEQ ID NO: 11461 - RNA, 423 nt, Artificial Sequence
  derived and/or modified sequence opt1 from anti-HIV-1_HeavyChain
cagguguacauggagcaggccggcgucggggugaagaagcccggcgccagcgugacccuguccugcaagaccgcggacgaggacgucuucgacgccgccuacaugcacugggugcgccaggccccggggcccgaccucgaguggcugggcuggaugaagcccgugacgggggccgucaacuacgcgcggaaguuccagggccgcgugagcuucuaccggacccgcgagcugggcaucgccuacauggaccuccggaaccugcgcuucgacgacaccgccguguacuucugcgcccggaagaccgcgggggacgucuccggcgacaagcgcggguucuucuucgaccuguggggccgggggagccgcgugaucguguccagcgccuccacgaagggccccagcgucuucccgaccaucugcgug

SEQ ID NO: 11462 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugacccaggacgacacggccaccuacuucugcgcccggcagaaguucgcgucccgcuacagcggcgaccagggguccuacuucgaccucuggggccgggggacccugaucaucgugagcuccgccagcaccaagggccccuccgucuucccccacgaccugcgc

SEQ ID NO: 11463 - RNA, 426 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccgugacgggcgccgugaacuucggcucccucgacuuccggcaccgcaucagccugacccgggaccgcgaccuguucaccgcccacauggacauccgggggcucacccagggcgacacggccaccuacuucugcgcgcgccagaaguucgagucccgguacaccgggggccaggggugguacuucgaccuguggggccgcggcacccacaucgucgugagcuccgccagcacgaaggggccguccguguucccccacgaccugcgg

SEQ ID NO: 11464 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggagcggaucgggugggucaagacggugaccggcgccgugaacuucggcucccuggacuuccgccaccggaucagccucacccgcgaccgggaccuguucaccgcccacauggacauccgcgggcugacgcagggcgacaccgccaccuacuucugcgcccggcagaaguucgagucccgcuacaccgggggccaggggugguacuucgaccucuggggccggggcacgcacaucgucgugagcuccgcgagcaccaaggggcccuccguguuccccaccaucugcguc

SEQ ID NO: 11465 - RNA, 423 nt, Artificial Sequence
  derived and/or modified sequence opt1 from anti-HIV-1_HeavyChain
gagguguacauggagcgcggccgcgggggcgucaagaagcccggggccagcgccacccuguccugcaagaccgcggacgaggacguguucgacgccgccuacaugcacugggugcggcaggccccgggccagacguucgaguggcucggguggaugaagcccgucaccggcgccgugagcuacgcgcggaaguuccagggccgcguguccuucuacaugacccgggagcuggggauggccuacauggaccugcgcaaccuccgguucgacgacaccgccgucuacuucugcgcccgcaagacggcgggcgacgugagcggggacaaccggggcuacuucuucgaccugugggggcgcggcucccgggugaucgucagcuccgccagcaccaagggccccuccguguucccccacgaccugcgc

SEQ ID NO: 11466 - RNA, 426 nt, Artificial Sequence
  derived and/or modified sequence opt1 from anti-HIV-1_HeavyChain
caggcccaccuggagcagagcggcuccggggugaagaagcccggcgccagcgcgcgcgucuccugcuggagcuccgaggacaucuucgagcggaucgagcucauccacugggugcgccaggccccggggcagggccuggaguggaucgggugggugaagaccgucgccggcgccgugaacuucggcagccuggacuuccggcaccgcaucucccucacccgggaccgcgaccuguucacggcccacauggacauccgggggcugacccagggcgacaccgcgaccuacuucugcgcccgccagaaguucgagagccgguacaccgggggccaggggugguacuucgaccucuggggccgcggcacgcacaucguggucuccagcgccuccaccaaggggcccagcguguucccccacgaccugcgg

SEQ ID NO: 11467 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugcggcaggacgacaccgccacguacuucugcgcccgccagaaguucgagucccgguacagcggcgaccagggguccuacuucgaccucuggggccgcgggacccugaucaucgugagcuccgcgagcaccaagggccccuccgucuuccccaccaucuacgug

SEQ ID NO: 11468 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaacggcaucagccucucccgggaccgcgaccugagcaccgccuacauggacauccggggccugacccaggacgacacggccaccuacuucugcgcccgccagaaguucgcgucccgguacagcggggaccagggcuccuacuucgaccucugggggcgcggcacccugaucguggucagcuccgccagcaccaaggggcccuccguguucccccacgaccugcgg

SEQ ID NO: 11469 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugacccaggacgacacggccaccuacuucugcgcccggcagaaguucgcgucccgcuacagcggcgaccagggguccuacuucgaccucuggggccgggggacccugaucguggucagcuccgccagcaccaagggccccuccguguucccccacgaccugcgc

SEQ ID NO: 11470 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcggggacauccuccggaaguccgagcugauccacugggugcgccaggcgccgggccaggggcuggaguggaucggcugggucaagaccgugacgggcgccgugaacuucgggagccucgacuuccggcaccgcaucucccugacccgggaccgcgaccuguucaccgcccacauggacauccggggccucacccagggggacacggccaccuacuucugcgcccgccagaaguucgagagccgguacaccggcgggcagggcugguacuucgaccuguggggccgcgggacccacaucgucguguccagcgcguccacgaagggccccagcguguucccccacgaccugcgg

SEQ ID NO: 11471 - RNA, 426 nt, Artificial Sequence
  derived and/or modified sequence opt1 from anti-HIV-1_HeavyChain
caggugcaccuggagcagagcggcuccggggucaagaagcccggcgccagcgugcgcguguccugcuggagcuccgaggacaucuucgagcggaccgagcucauccacuggguccgccaggccccggggcagggccuggaguggaucgggugggugaagaccgugacgggcgcggucaacuucggcagccuggacuuccggcaccgcaucucccucacccgggaccgcgaccuguucaccgcccacauggacauccgggggcugacccagggcgacacggccaccuacuucugcgcccgccagaaguucgagagccgguacaccgggggccaggggugguacuucgaccucuggggccgcggcacccacaucgugguguccagcgccugcacgaaggggcccuccgucuucccccacgaccugcgg

SEQ ID NO: 11472 - RNA, 426 nt, Artificial Sequence
  derived and/or modified sequence opt1 from anti-HIV-1_HeavyChain
caggcccaccuggagcagagcugguccggcgugaagaagcccggggccagcguccgcguguccugcuggagcuccgaggacaucuucgagcggaccgagcucauccacugggugcgccaggcgccgggccaggggcuggaguggaucggcugggucaagaccgugacgggggccgugaacuucggcagccuggacuuccggcaccgcaucucccucacccgggaccgcgaccuguucaccgcccacauggacauccggggccugacccagggggacacggccaccuacuucugcgcccgccagaaguucgagagccgguacaccggcgggcagggcugguacuucgaccucugggggcgcggcacccacaucgucguguccagcgcguccacgaagggccccagcguguucccccacgaccugcgg

SEQ ID NO: 11473 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucaucuacugggugcgccaggcgccgggccgggggcccgaguggaucggcugggugaagacggucagcgggaccgugaacuucggcuccagcgacuuccgcaaccggaucucccugacccgcgaccgggaccugagcaccgcccacauggacauccgcggccucacgcaggacgacaccgccaccuacuucugcgcccggcagaaguucgagucccuguacagcgacgaccagggguccuacuucgaccuguggggccgcgggacccucaucaucgugagcuccgccagcacgaagggccccuccgucuucccccacgaccugcgg

SEQ ID NO: 11474 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccuggacuuccggcaccgcaucucccucacccgggaccgcgaccuguucaccgcccacauggacauccgggggcugacccagggcgacacggccaccuacuucugcgcccgccagaaguucgagagccgguacaccgggggccaggggugguacuucgaccucuggggccgcggcacccacaucgucguguccagcgcguccacgaaggggcccagcguguuccccaccauccugcgg

SEQ ID NO: 11475 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucaucuacugggugcgccaggcgccgggccgggggcuggaguggaucggcugggugaagacggucagcgggaccgugaacuucggcuccagcgacuuccgcaaccggaucucccugacccgcgaccgggaccucagcaccgcccacauggacauccgcggccugacgcaggacgacaccgccaccuacuucugcgcccggcagaaguucgagucccuguacagcgacgaccagggguccuacuucgaccucuggggccgcgggacccugaucgccgugagcuccgcgagcacgaagggccccuccgucuucccccacgaccugcgg

SEQ ID NO: 11476 - RNA, 426 nt, Artificial Sequence
  derived and/or modified sequence opt1 from anti-HIV-1_HeavyChain
cagagccaccugaagcaguccggcagcgccaugaagaagcccggggccuccgugcgcgucagcugcuggaccuccgaggacaucuucgagcggaccgagcucaucuacugggugcgccaggcgccgggccgggggcuggaguggaucggcugggugaagacggucagcgggaccgugaacuucggcuccagcgacuuccgcaaccggaucucccugacccgcgaccgggaccucagcaccgcccacauggacauccgcggccugacgcaggacgacaccgccaccuacuucugcgcccggcagaaguucgagucccuguacagcgacgaccagggguccuacuucgaccucuggggccgcgggacccugaucaucgugagcuccgccagcacgaagggccccuccgucuucccccacgaccugcgg

SEQ ID NO: 11477 - RNA, 426 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgagugggucaaggccguguccggggccgugaacuacggcagccucgacuuccggcaccgcgucucccugacgcgggaccgcgaccuguucaccgcccacauggacauccggggccucacccaggacgacaccgccacguacuucugcgcgcgccagaaguucgagagccgguacaccgggggccaggggugguacuucgaccuguggggccgcgggacccacaucgugguguccagcgccuccaccaagggcccgagcgucuucccccacgaccugcgg

SEQ ID NO: 11478 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugacccaggacgacacggccaccuacuucugcgcccggcagaaguucgagucccgcuacagcggcgaccagggguccuacuucgaccucuggggccgggggacccugaucaucgugagcuccgcgagcaccaagggccccuccgucuucccccacgaccugcgc

SEQ ID NO: 11479 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagccuggacuuccgcaaccggaucucccucagccgcgaccgggaccuguccaccgccuacauggacauccgcgggcugacccaggacgacaccgccacguacuucugcgcccggcagaaguucgcgagccgcuacuccggcgaccaggggagcuacuucgaccucuggggccgggggacccugaucgucguguccagcgccuccaccaagggccccagcguguucccccacgaccugcgc

SEQ ID NO: 11480 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcgguccgagcucauccacugggugcgccaggcgccggggcagggccuggaguggaucgggugggucaagaccgugacgggcgccgugaacuucggcagccccaacuuccggcagcgcgucucccugagccgggaccgcgaccucuccaccgcccacauggacauccgggggcugacccaggacgacaccgccacguacuucugcgcccgccagaaguucgcgagccgguacuccggcgaccaggggagcuacuucgaccuguggggccgcgggacccucaucaucguguccagcgccuccaccaagggccccagcguguucccccacgaccugcgg

SEQ ID NO: 11481 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucaucuacugggugcgccaggcgccgggccgggggcuggaguggaucggcugggugaagacggucagcgggaccgugaacuucggcuccagcgacuuccgcaaccggaucucccugacccgcgaccgggaccucagcaccgcccacauggacauccgcggccugacgcaggacgacaccgccaccuacuucugcgcccggcagaaguucgagucccuguacagcgacgaccagggguccuacuucgaccucuggggccgcgggacccugaucaucgugagcuccgccagcacgaagggccccuccgucuucccccacgaccugcgg

SEQ ID NO: 11482 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcggggccuggaguggaucgggugggucaagacgguguccggcaccgugaacuucggcagcuccgacuuccgcaaccggaucagccugacccgcgaccgggaccucuccaccgcccacauggacauccgcgggcugacgcaggacgacaccgccaccuacuucugcgcccggcagaaguucgagagccuguacuccgacgaccagggcagcuacuucgaccucugggggcgcggcacccugaucaucgucuccagcgccuccacgaaggggcccagcguguucccccacgaccugcgg

SEQ ID NO: 11483 - RNA, 426 nt, Artificial Sequence
  derived and/or modified sequence opt1 from anti-HIV-1_HeavyChain
caggugcaccuggagcagagcggcuccggggucaagaagcccggcgccagcgugcgcguguccugcuggagcuccgaggacaucuucgagcggaccgagcucauccacuggguccgccaggccccggggcagggccuggaguggaucgggugggugaagaccgugacgggcgcggucaacuucggcagccuggacuuccggcaccgcaucucccucacccgggaccgcgaccuguucaccgcccacauggacauccgggggcugacccagggcgacacggccaccuacuucugcgcccgccagaaguucgagagccgguacaccgggggccaggggugguacuucgaccucuggggccgcggcacccacaucgugguguccagcgccuccacgaaggggcccagcgucuucccccacgaccugcgg

SEQ ID NO: 11484 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugcggcaggacgacaccgccacguacuucugcgcccgccagaaguucgagucccgguacagcggcgaccagggguccuacuucgaccucuggggccgcgggacccugaucaucgugagcuccgcgagcaccaagggccccuccgucuucccccacgaccugcgg

SEQ ID NO: 11485 - RNA, 423 nt, Artificial Sequence
  derived and/or modified sequence opt1 from anti-HIV-1_HeavyChain
cagguguacauggagcaggccggcgccggggucaagaagcccggcgcgagcgugacccuguccugcaagaccgccgacgaggacguguucgacgccgccuacaugcacuggguccgccaggccccggggcagacguucgaguggcucggcuggaugaagcccgugaccggggcggugagcuacgcccggaaguuccagggccgcgucuccuucuacaugacccgggagcugggcguggccuacauggaccugcgcaaccuccgguucgacgacaccgccguguacuucugcgcgcgcaagacggccggggacgucagcggcgacaaccggggguacuucuucgaccuguggggccgcgggucccgggugaucgugagcuccgccagcaccaagggccccuccgucuucccccacgaccugcgc

SEQ ID NO: 11486 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccggaaccugagcaccgcccacauggacauccgcggccugcggcaggacgacaccgccacguacuucugcgcccgccagaaguucgagucccgguacagcggcgaccagggguccuacuucgaccucuggggccgcgggacccugaucaucgugagcuccgcgagcaccaagggccccuccgucuucccccacgaccugcgg

SEQ ID NO: 11487 - RNA, 423 nt, Artificial Sequence
  derived and/or modified sequence opt1 from anti-HIV-1_HeavyChain
caggugcagcugguccagagcggcgccgaggugaagaagcccggggccuccgugacccucagcugcaagaccgcggacgaggacgucuucgacgccgccuacaugcacugggugcgccaggccccgggccagacguucgaguggcugggguggaugaagcccgugaccggcgccgucuccuacgcgcggaaguuccaggggcgcgugagcuucuacaugacccgggagcugggcauggccuacauggaccuccgcaaccugcgguucgacgacaccgccguguacuucugcgcccgcaagacggcgggcgacgucuccggggacaaccggggcuacuucuucgaccugugggggcgcggcagccgggugaucguguccagcgccuccaccaaggggcccagcgucuuccccaccaucuacgug

SEQ ID NO: 11488 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucgugcacuggguccgccaggcgccggggcagggccuggaguggaucgggugggugaagacggugaccggcgccgucaacuucggcucccccaacuuccggcagcgcgugagccugacccgggaccgcgaccucuucaccgcccacauggacauccgggggcugacgcaggacgacaccgccaccuacuucugcgcccgccagaaguucgcgucccgguacagcggcgaccagggguccuacuucgaccuguggggccgcgggacccucaucguggucagcuccgccagcacgaagggccccuccguguucccccacgaccugcgg

SEQ ID NO: 11489 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgccuacauggacauccgcggccugacccaggacgacacggccaccuacuucugcgcccggcagaaguucgcgucccgcuacagcggcgaccagggguccuacuucgaccucuggggccgggggacccugaucaucgugagcuccgccagcaccaagggcccccuggggcucccccacgaccugcgc

SEQ ID NO: 11490 - RNA, 426 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccugagcaccgcccacauggacauccgggggcucacccaggacgacaccgccacguacuucugcgcgcgccagaaguucgccucccgguacagcggcgaccagggguccuacuucgaccuguggggccgcgggacccugaucguggugagcuccgccagcaccaagggcccguccgucuucccccacgaccuccgg

SEQ ID NO: 11491 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucaucuacugggugcgccaggcgccggggcagggccuggaguggaucgggugggucaagaucguguccggcacggugaacuucgccagccuggacuuccggaaccgcaucucccucagccgggaccgcgaccuguccaccgcccacauggacauccggggccugacccaggacgacaccgccacguacuucugcgcccgccagaaguucgcgagccgguacuccggggaccagggcagcuacuucgaccucugggggcgcggcacccugaucaucgucuccagcgccuccaccaaggggcccagcguguucccccacgaccugcgg

SEQ ID NO: 11492 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggaaccgcaucagccugacccgggaccgcgaccucuccaccgcccacauggacauccgggggcugacgcaggacgacaccgccaccuacuucugcgcccgccagaaguucgagagccuguacuccgacgaccagggcagcuacuucgaccucugggggcggggcacccugaucaucgucuccagcgcguccacgaaggggcccagcguguucccccacgaccugcgc

SEQ ID NO: 11493 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucgagucccuguacagcgacgaccagggguccuacuucgaccucuggggccgcgggacccugaucaucgugagcuccgcgagcaccaagggccccuccguguucccccacgaccugcgg

SEQ ID NO: 11494 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcuccagcgacuuccggaaccgcaucucccugacccgggaccgcgaccucagcaccgcccacauggacauccgggggcugacgcaggacgacaccgccaccuacuucugcgcccgccagaaguucgagucccuguacagcgacgaccagggcuccuacuucgaccucugggggcggggcacccugaucaucgucagcuccgcgagcacgaaggggcccuccguguucccccacgaccugcgc

SEQ ID NO: 11495 - RNA, 426 nt, Artificial Sequence
  derived and/or modified sequence opt1 from anti-HIV-1_HeavyChain
cagagccaccuggagcaguccggcagcgccaugaagaagcccggggccuccgcgcgcgugagcugcuggaccuccgaggacaucuucgacaccacggagcucaucuacuggguccggcaggccccgggccaggggcuggaguggaucggcugggugaagaucgugagcgggaccgucaacuucgccucccuggacuuccgcaaccggaucagccucucccgcgaccgggaccugagcaccgcccacauggacauccgcggccugacccaggacgacacggccaccuacuucugcgcgcggcagaaguucgccucccgcuacagcggcgaccagggguccuacuucgaccucuggggccgggggacccacaucguggugagcuccgccagcaccaagggccccuccgucuucccccacgaccugcgc

SEQ ID NO: 11496 - RNA, 426 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccuguucaccgcccacauggacauccgggggcucacccaggacgacaccgccacguacuucugcgcgcgccagaaguucgagagccgguacaccggcgggcagggcugguacuucgaccugugggggcgcggcacccacaucgugguguccagcgccuccaccaagggcccgagcgucuucccccacgaccugcgg

SEQ ID NO: 11497 - RNA, 426 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccugagcaccgcccacauggacauccgggggcucacccaggacgacaccgccacguacuucugcgcgcgccagaaguucgagucccgguacaccggcgggcagggcugguacuucgaccugugggggcgcggcacccacaucguggugagcuccgccagcaccaagggcccguccgucuucccccacgaccugcgg

SEQ ID NO: 11498 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucaucuacugggugcgccaggcgccgggccgggggcuggaguggaucggcugggugaagacggucagcgggaccgugaacuucggcuccagcgacuuccgcaaccggaucucccugacccgcgaccgggaccucagcaccgcccacauggacauccgcggccugacgcaggacgacaccgccaccuacuucugcgcccggcagaaguucgccucccgcuacagcggggaccagggcuccuacuucgaccugugggggcggggcacccucaucaucgugagcuccgcgagcacgaaggggcccuccgucuucccccacgaccugcgc

SEQ ID NO: 11499 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucaucuacugggugcgccaggcgccgggccgggggcuggaguggaucggcugggugaagacggucagcgggaccgugaacuucggcuccagcgacuuccgcaaccggaucucccugacccgcgaccgggaccucagcaccgcccgcauggacauccggggccugacgcaggacgacaccgccaccuacuucugcgcccgccagaaguucgagucccuguacagcgacgaccagggguccuacuucgaccucuggggccgggggacccugaucaucgugagcuccgccagcacgaagggccccuccgucuuccccaccgaccugcgc

SEQ ID NO: 11500 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccaggacgacacggccaccuacuucugcgcccggcagaaguucgcgucccgcuacagcggcgaccagggguccuacuucgaccuguggggccgggggacccucaucguggugagcuccgccagcaccaagggccccuccgucuucccccacgaccugcgc

SEQ ID NO: 11501 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucaucuacugggugcgccaggcgccgggccgggggcuggaguggaucggcugggugaagacggucagcgggaccgugaacuucggcuccagcgacuuccgcaaccggaucucccugacccgcgaccgggaccucagcaccgcccacauggacauccgcggccugacgcaggacgacaccgccaccuacuucugcgcccggcagaaguucgagucccuguacagcgacgaccagggguccuacuucgaccucuggggccgcgggacccugaucaucgugagcuccgccagcacgaacggccccaucgggcugccccacgaccuccgg

SEQ ID NO: 11502 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucgagucccgcuacaccgggggccaggggugguacuucgaccuguggggccggggcacccacaucguggugagcuccgcgagcacgaaggggcccuccgucuucccccacgaccuccgc

SEQ ID NO: 11503 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacgcaggacgacaccgccaccuacuucugcgcccgccagaaguucgcgucccgguacagcggcgaccagggguccuacuucgaccuguggggccgcgggacccucaucguggugagcuccgccagcacgaagggccccuccgucuucccccacgaccugcgg

SEQ ID NO: 11504 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccggccucaucuacugggugcgccaggcgccggggcggggccuggaguggaucgggugggugaagacggucagcggcaccgugaacuucggcuccagcgacuuccgcaaccggaucucccugacccgcgaccgggaccucagcaccgcccacauggacauccgcgggcugacgcaggacgacaccgccaccuacuucugcgcccggcagaaguucgagucccuguacagcgacgaccagggcuccuacuucgaccucugggggcgcggcacccugaucaucgugagcuccgccagcacgaaggggcccuccgucuucccccacgaccugcgg

SEQ ID NO: 11505 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccagaucuuccggcaccgcaucagccugacccgggaccgcgaccucuucaccgcccacauggacauccgggggcugacgcagggcgacaccgccaccuacuucugcgcccgccagaaguucgagucccgguacaccgggggccaggggugguacuucgaccuguggggccgcggcacgcacaucgucgugagcuccgcgagcaccaaggggcccuccguguucccccacgaccuccgg

SEQ ID NO: 11506 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucauccacugggugcggcaggcgccgggccaggggcuggaguggaucggcugggugaagaccgucaccggggccgugaacuucggcagccuggacuuccgccaccggaucucccucacccgcgaccgggaccuguucacggcccacauggacauccgcggccugacccagggggacaccgccaccuacuucugcgcccggcagaaguucgagagccgcuacacgggcgggcagggcugguacuucgaccucugggggcggggcacccacaucguggucuccagcgcguccaccaagggccccagcguguucccccacgaccugcgc

SEQ ID NO: 11507 - RNA, 426 nt, Artificial Sequence
  derived and/or modified sequence opt1 from anti-HIV-1_HeavyChain
cagagccaccuggagcaguccggcagcgaggugaagaagcccggggccuccguccgcgugagcugcuggaccuccgaggacaucuucgagcggaccgagcucaucuacugggugcgccaggccccgggccgggggcuggaguggaucggcugggucaagacggugagcgggaccgugaacuucggcuccagcgacuuccgcaaccggaucucccugacccgcgaccgggaccucagcaccgcgcacauggacauccgcggccugacgcaggacgacaccgccaccuacuucugcgcccggcagaaguucgagucccuguacagcgacgaccagggguccuacuucgaccucuggggccgcgggacccugaucaucgucagcuccgccagcacgaagggccccuccguguucccccacgaccugcgg

SEQ ID NO: 11508 - RNA, 423 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacaucuucgacgccgccuacaugcacugggugcgccaggccccgggccagacguucgaguggcucggguggaugaagcccgucaccggcgccgugaacuacgcgcggcaguuccagggccgcgugagcuucuaccggacccgcgagcuggggaucgccuacauggaccugcgggaccucaaguucgacgacaccgccgucuacuucugcgcccgcaagacgaagggcgacguguccggggacgaccggggcuucuucuucgaccugugggggcgcggcacccgggugaucgucagcuccgcgagcaccaagggccccuccguguucccccacgaccugcgc

SEQ ID NO: 11509 - RNA, 426 nt, Artificial Sequence
  derived and/or modified sequence opt1 from anti-HIV-1_HeavyChain
cagagccaccuggagcaguccggcagcgaggugaagaagcccggggccuccguccgcgugagcugcuggaccuccgaggacaucuucgacaccacggagcucaucuacugggugcggcaggccccgggccaggggcuggaguggaucggcugggucaagaucgugagcgggaccgugaacuucgcgucccuggacuuccgcaaccggaucagccucucccgcgaccgggaccugagcaccgcccacauggacauccgcggccugacccaggacgacacggccaccuacuucugcgcccggcagaaguucgccucccgcuacagcggcgaccagggguccuacuucgaccucuggggccgggggacccugaucaucgucagcuccgcgagcaccaagggccccuccguguucccccacgaccugcgc

SEQ ID NO: 11510 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccccaacuuccggcaccgcgucucccugagccgggaccgcgaccucuccaccgccuacauggacauccgggggcugacccaggacgacaccgccacguacuucugcgcccgccagaaguucgcgagccgguacuccggcgaccaggggagcuacuucgaccuguggggccgcgggacccucaucgugguguccagcgccuccaccaagggccccagcgucuucccccacgaccugcgg

SEQ ID NO: 11511 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccuggacuuccggcaccgcaucucccucacccgggaccgcgaccuguucaccgcccacauggacauccgggggcugacccagggcgacacggccaccuacuucugcgcccgccagaaguucgagagccgguacaccgggggccaggggugguacuucgaccucuggggccgcggcacccacaucgucguguccagcgcguccgccaaggggcccagcguguucccccacgaccugcgg

SEQ ID NO: 11512 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgagcggaccgagcucaucuacugggugcgccaggcgcccggccgggggcuggaguggaucggcugggugaagacggucagcgggaccgugaacuucggcuccagcgacuuccgcaaccggaucucccugacccgcgaccgggaccucagcaccgcccacauggacauccgcggccugacgcaggacgacaccgccaccuacuucugcgcccggcagaaguucgagucccuguacagcgacgaccagggguccuacuucgaccucuggggccgcgggacccugaucguggucagcuccgccagcacgaagggccccuccguguucccgccccggagcgcg

SEQ ID NO: 11513 - RNA, 426 nt, Artificial Sequence
  derived and/or modified sequence opt1 from anti-HIV-1_HeavyChain
caggugcacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugaacuacgcgcggaaguuccagggccgcgucagcuucuaccggacccgcgagcuggggaucgccuacauggaccugcggaaccuccgcuucgacgacaccgccguguacuucugcgcccggaagacgaagggcgacguguccggggacgaccgcggcuucuucuucgaccugugggggcggggcacccgcgucaucgugagcuccgcgagcaccaagggcccccugcgguccuucccccgccggagcgcc

SEQ ID NO: 11514 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccuggacuuccggcaccgcaucucccucacccgggaccgcgaccuguucaccgcccacauggacauccgggggcugacccagggcgacacggccaccuacuucugcgcccgccagaaguucgagagccgguacaccgggggccaggggugguacuucgaccucuggggccgcggcacccacaucgucguguccagcgcguccacgaaggggcccagcguguuccccaccaucuacguc

SEQ ID NO: 11515 - RNA, 426 nt, Artificial Sequence
  derived and/or modified sequence opt1 from anti-HIV-1_HeavyChain
gagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugacccaggacgacacggccaccuacuucugcgcccggcagaaguucgcgucccgcuacagcggcgaccagggguccuacuucgaccucuggggccgggggacccugaucaucgugagcuccgccagcaccaagggccccuccgucuucccccacgaccugcgc

SEQ ID NO: 11516 - RNA, 429 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagaucguguccggcgccgugaacuucggcagccccaacuuccggcagcgcgucucccugacgcgggaccgcgaccucuucaccgcccacauggacauccgggggcugacccaggacgacaccgccacguacuucugcgcccgccagaaguucgcgagccgguacuccggcgaccaggggagcuacuucgaccuguggggccgcgggacccucaucgugguguccagcgccuccaccaagggccccagcggccugcccccgcgguccugcguc

SEQ ID NO: 11517 - RNA, 423 nt, Artificial Sequence
  derived and/or modified sequence opt1 from anti-HIV-1_HeavyChain
caggugcaccugguccagagcggcgccgaggugaagaagcccggggccuccgugaaggucagcugcaaggcguccggcuacaccuucaccacgagcgggauccacuggcuccgccaggugccgggccagcggcccgaguggaugggguggauccgccccaagaccggcgcccggaaccaggcccgccaguuccagccccggaucucccugacccgcgaccgggcccugagcaccgccuaccucgaccugaacucccugacgagcgcggacuccggcaccuacuucugcgcccgccagaccuucaagccggacuucuacuucgccgaccagggguggagcuucaaccucuggggccgcggggcccacuucaucguguccagcgcguccaccaagggccccagcgucuucccccacgaccugcgg

SEQ ID NO: 11518 - RNA, 429 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgcccgggcagggccuggaguggaucgggugggucaagaccgugacgggcgccgugaacuucggcagccuggacuuccggcaccgcaucucccucacccgggaccgcgaccuguucaccgcccacauggacauccgggggcugacccagggcgacacggccaccuacuucugcgcccgccagaaguucgagagccgguacaccgggggccaggggugguacuucgaccucuggggccgcggcacccacaucgucguguccagcgcguccacgcaggggcccaucggccugccgccccggcugugcgug

SEQ ID NO: 11519 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgcccggccaggggcuggaguggaucggcugggugaagaucgucagcgggaccgugaacuucgccucccuggacuuccgcaaccggaucagccucucccgcgaccgggaccugagcaccgcccacauggacauccgcggccugacccaggacgacacggccaccuacuucugcgcccggcagaaguucgcgucccgcuacagcggcgaccagggguccuacuucgaccucuggggccgggggacccugaucaucgugagcuccgccagcaccaagggccccaucgggcugccgccccgcuccacg

SEQ ID NO: 11520 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagccuggacuuccgccaccggaucucccucacccgcgaccgggaccuguucaccgcccacauggacauccgcgggcugacccagggcgacacggccaccuacuucugcgcccggcagaaguucgagagccgcuacaccgggggccaggggugguacuucgaccucuggggccggggcacccacaucgucguguccagcgcguccacgaaggggcccagcguguuccccaccaucugcguc

SEQ ID NO: 11521 - RNA, 426 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccuguucaccgcccacauggacauccgggggcucacccagggcgacaccgccacguacuucugcgcgcgccagaaguucgagagccgguacaccgggggccaggggugguacuucgaccuguggggccgcggcacccacaucgugguguccagcgcccugcaccaggggcccaucggccucccgccccgguccacc

SEQ ID NO: 11522 - RNA, 429 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccgggugagccucucccgcgaccgggaccugagcaccgccuacauggacauccgcggccugacccaggacgacacggccaccuacuucugcgcccggcagaaguucgcgucccgcuacagcggcgaccagggguccuacuucgaccucuggggccgggggacccugaucgucgugagcuccgcccugcaccagggccccaucgggcccagccccaccauccuccgc

SEQ ID NO: 11523 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugacccaggacgacacggccaccuacuucugcgcccggcagaaguucgcgucccgcuacagcggcgaccagggguccuacuucgaccucuggggccgggggacccugaucaucgugagcuccgccagcaccaagggccccuccgucuuccccacgaucuacgug

SEQ ID NO: 11524 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgccuacauggacauccgcggccugacccaggacgacacggccaccuacuucugcgcccggcagaaguucgagucccgcuacaccggcgggcagggcugguacuucgaccucugggggcggggcacccacaucguggucagcuccgcgagcacgaaggggcccuccguguuccccaccaucugcgug

SEQ ID NO: 11525 - RNA, 426 nt, Artificial Sequence
  derived and/or modified sequence opt1 from anti-HIV-1_HeavyChain
caggugcagcugguccagagcggcgccgaggugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugacccaggacgacacggccaccuacuucugcgcccggcagaaguucgagucccgcuacaccggcgggcagggcugguacuucgaccucugggggcggggcacccacaucguggucagcuccgcgagcacgaaggggcccuccguguuccccaccaucugcgug

SEQ ID NO: 11526 - RNA, 426 nt, Artificial Sequence
  derived and/or modified sequence opt1 from anti-HIV-1_HeavyChain
cgccggcaccuggagcagagcggcuccggggugaagaagcccggcgccagcguccgcguguccugcuggagcuccgaggacaucuucgagcggaccgagcucauccacugggugcgccaggccccggggcagggccuggaguggaucgggugggucaagaccgugacgggcgcggugaacuucggcagccuggacuuccggcaccgcaucucccucacccgggaccgcgaccuguucaccgcccacauggacauccgggggcugacccagggcgacacggccaccuacuucugcgcccgccagaaguucgagagccgguacaccgggggccaggggugguacuucgaccucuggggccgcggcacccacaucgucguguccagcgccuccacgaaggggcccagcguguucccccacgaccugcgg

SEQ ID NO: 11527 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgccuacauggacauccgcggccugacccaggacgacacggccaccuacuucugcgcccggcagaaguucgagucccgcuacagcggcgaccagggguccuacuucgaccucuggggccgggggacccugaucaucgugagcuccgcgagcaccaagggccccuccgucuuccccacgaucugcgug

SEQ ID NO: 11528 - RNA, 429 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccuggacuuccggcaccgcaucagccucacccgggaccgcgaccuguucaccgcccacauggacauccgggggcugacgcagggcgacaccgccaccuacuucugcgcccgccagaaguucgagucccgguacaccgggggccaggggugguacuucgaccucuggggccgcggcacgcacaucgucgugagcuccgcgagcaccaaggggccccaccccguguucccccacgaccugccg

SEQ ID NO: 11529 - RNA, 426 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugaucuacugggugcgccaggcgcccgggcagggccuggaguggaucgggugggucaagaucguguccggcacggugaacuucgccagccucgacuuccggaaccgcaucucccugagccgggaccgcgaccuguccaccgccuacauggacauccggggccucacccaggacgacaccgccacguacuucugcgcccgccagaaguucgcgagccgguacuccggggaccagggcagcuacuucgaccugugggggcgcggcacccugaucgucguguccagcgccuccaccaaggggccgagcguguuccccaccaucuacguc

SEQ ID NO: 11530 - RNA, 429 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggcgcgccaggcccccgggcagggccuggaguggaucgggugggugaagacggucaccggcgccgugaacuucggcucccuggacuuccggcaccgcaucagccucacccgggaccgcgaccuguucaccgcccacauggacauccgggggcugacgcagggcgacaccgccaccuacuucugcgcgcgccagaaguucgagucccgguacaccgggggccaggggugguacuucgaccucuggggccgcggcacgcacaucguggucagcuccgccagcaccaaggggccccugggccugccgccccggcucucccgc

SEQ ID NO: 11531 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgcccggccaggggcuggaguggaucggcugggugaagaucgucagcgggaccgugaacuucgccucccuggacuuccgcaaccggaucagccucucccgcgaccgggaccugagcaccgcccacauggacauccgcggccugacccaggacgacacggccaccuacuucugcgcccggcagaaguucgcgucccgcuacagcggcgaccagggguccuacuucgaccucuggggccgggggacccugaucaucgugagcuccgccagcaccaagggccccuccgggcugccgccccgcagcgcc

SEQ ID NO: 11532 - RNA, 426 nt, Artificial Sequence
  derived and/or modified sequence opt1 from anti-HIV-1_HeavyChain
caggugcagcugguccagagcggcgccgaggugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgcccacauggacauccgcggccugcggcaggacgacaccgccacguacuucugcgcccgccagaaguucgagucccgguacagcggcgaccagggguccuacuucgaccucuggggccgcgggacccugaucaucgugagcuccgcgagcaccaagggccccuccgucuucccccacgaccugcgg

SEQ ID NO: 11533 - RNA, 426 nt, Artificial Sequence
  derived and/or modified sequence opt1 from anti-HIV-1_HeavyChain
gaggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagaucguguccggcacggugaacuucgccagccuggacuuccggaaccgcaucucccucagccgggaccgcgaccuguccaccgccuacauggacauccggggccugacccaggacgacaccgccacguacuucugcgcccgccagaaguucgcgagccgguacuccggggaccagggcagcuacuucgaccucugggggcgcggcacccugaucgucguguccagcgccuccaccaaggggcccagcguguucccccacgaccugcgg

SEQ ID NO: 11534 - RNA, 423 nt, Artificial Sequence
  derived and/or modified sequence opt1 from anti-HIV-1_HeavyChain
caggugcagcugguccagagcggcgccgaggugaagaagcccggggccuccgugaaggucagcugccgcgcguccggcuacaccuucgggaaccacgccaucagcugggugcggcaggccccgggccaggggcucgaguggaugggcuggauccgccccaagaccggcgcccggaaccaggcccgccaguuccagccccggaucucccugacgcgcgaccgggcgcugagcaccgccuaccucgaccugaacucccugaccagcgccgacuccgggaccuacuucugcgcccgccagacguucaagcccgacuucuacuucgcggaccagggcuggagcuucaaccucugggggcggggcgcccacuucaucguguccagcgccuccaccaaggggccgagcgucuucccccacgaccugcgc

SEQ ID NO: 11535 - RNA, 429 nt, Artificial Sequence
  derived and/or modified sequence opt1 from anti-HIV-1_HeavyChain
cagggccacaaccuggagcagagcggguccgaggugaagaagcccggcgccagcguccgcguguccugcuggaccagcgaggacaucuucgagcggaccgagcucauccacugggugcgccaggccccggggcagggccuggaguggaucgggugggucaagacggugaccggcgcggugaacuucggcucccuggacuuccggcaccgcaucagccucacccgggaccgcgaccuguucaccgcccacauggacauccgggggcugacgcagggcgacaccgccaccuacuucugcgcccgccagaaguucgagucccgguacaccgggggccaggggugguacuucgaccucuggggccgcggcacgcacaucgucgugagcuccgccagcaccaaggggcccuccguguucccccacgaccugcgg

SEQ ID NO: 11536 - RNA, 426 nt, Artificial Sequence
  derived and/or modified sequence opt1 from anti-HIV-1_HeavyChain
cccaccaccuggaacaagagcggcuccgacgugaagaagccgggggccagcguccgcguguccugcuggacgagcgaggacaucuucgagcggaccgagcugauccacugggugcgccaggcccccggccaggggcucgaguggaucggcugggucaagaccgugaccggggcggugaacuucggcucccccaacuuccggcaccgcgucagccugacgcgggaccgcgaccuguccaccgcccacauggacauccggggccucacccaggacgacaccgccacguacuucugcgcccgccagaaguucgagagccuguacuccgacgaccaggggagcuacuucgaccuguggggccgggggacccucaucaucguguccagcgccuccaccaagggccccagcguguucccgcacgaccugcgc

SEQ ID NO: 11537 - RNA, 432 nt, Artificial Sequence
  derived and/or modified sequence opt1 from anti-HIV-1_HeavyChain
cacgugacccccuggaacgaguacgucggccgcgccaugaagaagccggggcggagcgugcgcguguccugcuggaccagcgaggacaucuucgacacgaccgagcugaucuacuggguccggcaggcccccggccaggggcucgaguggaucggcugggugaagaucguguccgggaccgucaacuucgcgagccuggacuuccgcaaccggaucucccugagccgcgaccgggaccucuccaccgccuacauggacauccgcggccugacgcaggacgacaccgccaccuacuucugcgcccggcagaaguucgccagccgcuacuccggcgaccaggggagcuacuucgaccuguggggccgggggacccucaucgugguguccagcgcguccacgaagggccccagcgucuucccccacgaccugcgc

SEQ ID NO: 11538 - RNA, 372 nt, Artificial Sequence
  derived and/or modified sequence opt1 from anti-HIV-1_HeavyChain
caggugcagcugguccagagcggcgccgaggugcgccggcccggggccuccgugaaggucagcugcaaggcguccggcuucagcuuccucgggcacuacauccacugggugcgccaggccccgggccaggggcuggaguggaucggcugggugaaggccgucuccggcgccgugaacuacgggagccuggacuuccggcaccgcgugucccucacccgggaccgcgaccugagcaccgcccacauggacauccggggccugacgcaggacgacaccgcgaccuacuucugcgcccgccagaaguucgcccgcggggaccagggcugguucuucgaccucugggggcggggcacccugaucgucguguccagc

SEQ ID NO: 11539 - RNA, 372 nt, Artificial Sequence
  derived and/or modified sequence opt1 from anti-HIV-1_HeavyChain
caggugcagcugguccagagcggcgccgaggugaagaagcccggggccuccgugaaggucagcugcaaggcguccggcuacaccuucaccagcuacgggaucuccugggugcgccaggccccgggccaggggcucgaguggaucggcugggugaagaucgucagcggcgccgugaacuucgggucccccaacuuccggcagcgcgugagccugacgcgggaccgcgaccuguucaccgcccacauggacauccggggccucacccagggggacaccgccacguacuucugcgcgcgccagaaguucgagcggggcgggcagggcuggaucuucgaccuguggggccgcgggacccugaucgccgucuccagc

SEQ ID NO: 11540 - RNA, 372 nt, Artificial Sequence
  derived and/or modified sequence opt1 from anti-HIV-1_HeavyChain
caggugcagcugguccagagcgaggccgaggugaagaagcccggcgccuccgugaagaucagcugcgcgaccuccggguacgccuucacccucuacuaccugcacuggguccgccaggccccgggccaggggcuggaguggaucggcugggugaagacggugaccggggccgucaacuucggcagcgccuacuuccggcaccgcgugucccucacccgggaccgcgaccuguucaccgcgcacauggacauccggggccugacgcagggggacaccgccaccuacuucugcgcccgccagaaguucuacaagggcgggcagggcugguacuucgaccucugggggcggggcacccugaucguggucagcucc

SEQ ID NO: 11541 - RNA, 372 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucaagaccgagcucauccacugggugcggcaggcgccggggcagggccuggaguggaucgggugggucaagacggugaccggcgccgugaacuucggcucccccaacuuccgccaccgggucagccugacccgcgaccgggaccucuucaccgcccacauggacauccgcgggcugacgcagggcgacaccgccaccuacuucugcgcccggcagaaguucgagcgcgggggccaggggugguacuucgaccuguggggccggggcacccucaucgugguguccagc

SEQ ID NO: 11542 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcggggccuggaguggaucgggugggucaaggccguguccggcgccgugaacuacggcagccucgacuuccgccaccgggucccgcugacgcgcgaccgggaccuguucaccgcccacauggacauccgcgggcucacccaggacgacaccgccacguacuucugcgcgcggcagaaguucgcccgcggcgaccaggggugguucuucgaccuguggggccgggggacccugaucgugguguccagc

SEQ ID NO: 11543 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccccggaggacaucuucgagcggaccgagcucauccacugggugcgccaggcgcccgggcagggccuggaguggaucgggugggucaagaucgugagcggcgccgugaacuucggcucccccaacuuccggcagcgcgucagccugacgcgggaccgcgaccucuucaccgcccacauggacauccgggggcugacccagggcgacaccgccacguacuucugcgcccgccagaaguucgagcgcgggggccagggguggaucuucgaccuguggggccggggcacccucaucgcgguguccagc

SEQ ID NO: 11544 - RNA, 375 nt, Artificial Sequence
  derived and/or modified sequence opt1 from anti-HIV-1_HeavyChain
caggcccaccuggagcagagcgccuccggcgugaagcgccccggggcgagcguccggguguccugcuggaccagcgaggacaucuucgagggcuccgagcucauccacugggugcgccaggccccggggcagggccuggaguggaucgggugggucaagaccgugacgggcgccgugaacuucggcagcgccuacuuccggcaccgcgucucccugacccgggaccgcgaccucuucaccgcccacauggacauccgggggcugacccagggcgacacggcgaccuacuucugcgcccgccagaaguucuacaagggcgggcaggggugguacuucgaccuguggggccggggcacccucaucguggugagcucc

SEQ ID NO: 11545 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccccaacuuccggcaccgcgucucccugacccgggaccgcgaccucuucaccgcccacauggacauccgggggcugacccagggcgacacggccaccuacuucugcgcccgccagaaguucuacgccgggggccaggggugguacuucgaccuguggggccggggcacccucaucguggugagcucc

SEQ ID NO: 11546 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcgggcggagcucauccacugggugcgccaggccccggggcagggccuggaguggaucgggugggucaagaccgugaccggcgccgugaacuucggcagccccaacuuccggcagcgcgucucccugacgcgggaccgcgaccucuucaccgcccacauggacauccgggggcugacccagggcgacaccgccacguacuucugcgcgcgccagaaguucgagcgcgggggccagggguggaucuucgaccuguggggccggggcacccucaucgccgugagcucc

SEQ ID NO: 11547 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccuggacuuccggcaccgcaucagccucacccgggaccgcgaccuguucaccgcccacauggacauccgggggcugacgcagggcgacaccgccaccuacuucugcgcccgccagaaguucgagcgcgggggccaggggugguacuucgaccucuggggccggggcacccugaucgucguguccagc

SEQ ID NO: 11548 - RNA, 375 nt, Artificial Sequence
  derived and/or modified sequence opt1 from anti-HIV-1_HeavyChain
caggugcaccuggagcagagcggcuccggggucaagaagcucggcgccagcgugcgcguguccugcuggaccagcgaggacaucuucgagcggaccgagcugauccacuggguccgccaggcccccgggcagggccuggaguggaucgggugggugaaggcgguguccggcgccgucaacuacggcagccucgacuuccggcaccgcgugucccugacgcgggaccgcgaccugagcaccgcccacauggacauccgggggcucacccaggacgacaccgccacguacuucugcgcccgccagaaguucgcgcggggcgaccaggggugguucuucgaccuguggggccgcgggacccugaucguggucuccagc

SEQ ID NO: 11549 - RNA, 375 nt, Artificial Sequence
  derived and/or modified sequence opt1 from anti-HIV-1_HeavyChain
caggccuaccuggagcagagcggcuccaucaugaagaagcccggggccagcgugcgcgucuccugcuggaccagcgaggacaucuucgaccggaccgagcucaucuacugggugcgccaggcgccgggccaggggcuggaguggaucggcugggugaagaucgucuccggggccgugaacuucggcagccuggacuuccggaaccgcgugucccucacgcgggaccgcgaccuguucaccgcccacauggacauccggggccugacccagggggacaccgccacguacuucugcgcccgccagaaguucgagcggggcgggcagggcugguacuucgaccucugggggcgcggcacccugaucgucgugagcucc

SEQ ID NO: 11550 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucaucaacugggugcgccaggcgccggggcagggccuggaguggaucgggugggucaaggccguguccggcgccgugaacuacggcagccuggacuuccggcaccgcgucucccucacgcgggaccgcgaccugagcaccgcccacauggacauccgggggcugacccaggacgacaccgccacguacuucugcgcgcgccagaaguucgcccggggcgaccaggggugguucuucgaccucuggggccgcgggacccugaucgugguguccagc

SEQ ID NO: 11551 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccuggacuuccggcaccgcaucucccucacccgggaccgcgaccuguucaccgcccacauggacauccgggggcugacccagggcgacacggccaccuacuucugcgcccgccagaaguucgagcgcgggggccaggggugguacuucgaccucuggggccggggcacccugaucgucgugagcucc

SEQ ID NO: 11552 - RNA, 375 nt, Artificial Sequence
  derived and/or modified sequence opt1 from anti-HIV-1_HeavyChain
caggcccaccuggagcagagcggcuccggggugaagaagcccggcaccagcguccgcguguccugcuggaccagcgaggacaucuucgagcggacggagcucauccacugggugcgccaggccccggggcagggccuggaguggaucgggugggucaagaucguguccggcgcggugaacuucggcagccccaacuuccggcagcgcgucucccugacccgggaccgcgaccucuucaccgcccacauggacauccgggggcugacccagggcgacacggccaccuacuucugcgcccgccagaaguucgagcgcgggggccagggguggaucuucgaccuguggggccggggcacccucaucgccgugagcucc

SEQ ID NO: 11553 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcggggacaucuucgagcggaccgagcugauccacugggugcgccaggcgcccggccaggggcuggaguggaucggcugggucaaggccguguccggcgccgugaacuacgggagccucgacuuccggcaccgcgucucccugacgcgggaccgcgaccuguucaccgcccacauggacauccggggccucacccaggacgacaccgccacguacuucugcgcgcgccagaaguucgcccgcggggaccagggcugguucuucgaccugugggggcggggcacccugaucguggugagcucc

SEQ ID NO: 11554 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagaucguguccggcgccgugaacuucggcagccccaacuuccggcagcgcgucucccugacgcgggaccgcgaccucuucaccgcccacaccgacauccgggggcugacccagggcgacacggccaccuacuucugcgcccgccagaaguucgagcgcgggggccaggggugguacuucgaccuguggggccggggcacccucaucguggugagcucc

SEQ ID NO: 11555 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugccucgcgagcgaggacaucuucgagcggaccgagcugauccacugggugcgccaggccccggggcagggccuggaguggaucgggugggucaagaccgugacgggcgccgugaacuucggcucccccaacuuccggcaccgcgucagccucacccgggaccgcgaccuguucaccgcccacauggacauccgggggcugacccagggcgacacggccaccuacuucugcgcgcgccagaaguucgagcgcgggggccaggggugguacuucgaccucuggggccggggcacccugaucgugguguccagc

SEQ ID NO: 11556 - RNA, 375 nt, Artificial Sequence
  derived and/or modified sequence opt1 from anti-HIV-1_HeavyChain
caggcccaccuggagcagagcggcgccggggugaagcgccccggcgcguccguccgggugagcugcuggaccuccgaggacaucuucgagaccacggagcucauccacugggugcgccaggccccggggcagggccuggaguggaucgggugggucaagaccgugagcggcgccgugaacuucggcucccugaacuuccggcaccgcgucagccucacccgggaccgcgaccuguucaccgcccacauggacauccgggggcugacgcagggcgacaccgccaccuacuucugcgcgcgccagaaguucgcccgcggggaccagggcugguucuucgaccucugggggcggggcacccugaucgugguguccagc

SEQ ID NO: 11557 - RNA, 375 nt, Artificial Sequence
  derived and/or modified sequence opt1 from anti-HIV-1_HeavyChain
cgccacaccuggaacaagagcggcuccggggugaagaagcccggcgccagcguccggguguccugcuggaccagcgaggacaucuucgagaaguccgagcugauccacugggugcgccaggccccggggcagggccucgaguggaucgggugggucaagacggugaccggcgcggugaacuucggcagcuccgacuuccggcagcgcgucagccugacccgggaccgcgaccuguucaccgcccacauggacauccgggggcucacgcagggcgacaccgccaccuacuucugcgcccgccagaaguucuacgccgggggccaggggugguacuucgaccuguggggccggggcacccugaucgugguguccagc

SEQ ID NO: 11558 - RNA, 375 nt, Artificial Sequence
  derived and/or modified sequence opt1 from anti-HIV-1_HeavyChain
ggcacccccgggagcgaguccggcagcggggugaagaagccgggcgccuccguccgcgugagcugcuggaccuccgaggacaucuucgagcggacggagcugauccacugggugcgccaggcccccgggcagggccucgaguggaucggcugggucaagaucgugagcggggcggugaacuucggcucccccaacuuccggcagcgcgucagccugacccgggaccgcgaccuguucaccgcccacauggacauccgggggcucacccagggcgacacggccaccuacuucugcgcccgccagaaguucgagcgcgggggccagggcuggaucuucgaccugugggggcggggcacccugaucgccguguccagc

SEQ ID NO: 11559 - RNA, 378 nt, Artificial Sequence
  derived and/or modified sequence opt1 from anti-HIV-1_HeavyChain
caggugcagcugguccagagcggcaccgaggugcagaagcccggggccuccgugaaggucagcugcaaggccuucggcuacuccuucaccgacuacuacguguacugggugcgccaggcgccggggcagggccucgaguacgucgccuggaucaaccccagcaacggguacacgaaguacgcccagaaguuccaggacugggugacccugacccgggacuccagcaucaacaccgccuaccugcagcucgcccgcgugacguccgacgacaccgcgaucuacuacugcgcccggcagaaguucgccagccgcuacuccggcgaccagggcagcuacuucgaccugugggggcggggcacccugaucgucguguccagc

SEQ ID NO: 11560 - RNA, 378 nt, Artificial Sequence
  derived and/or modified sequence opt1 from anti-HIV-1_HeavyChain
caggugcagcugguccagagcggcgccgccgugaagaagcccggguccagcgugaaggucuccugcaaggcgagcggcuacaucuucaccggguacuacauccacuggauccgccaggccccgggccaggggcucgaguggaugggcuggaucaaccccuccaccggcgacacgaaguucgcccggcaguuccaggggcgcgugagcuucuaccggacccgcgagcugggcaucgccuacauggaccugcgggaccucaaguucgacgacaccgccguguacuucugcgcgcgcaagaccaagggggacgucuccggcgacgaccggggguucuucuucgaccuguggggccgcggcacgcgggugaucgugagcucc

SEQ ID NO: 11561 - RNA, 381 nt, Artificial Sequence
  derived and/or modified sequence opt1 from anti-HIV-1_HeavyChain
cagguguacauggagcaggccggcgccgggaugaagaagcccggcgcgagcaugaccgucuccugcaagaccgccgacgaggacaucuucgacgccgccuacaugcacugggugcgccaggccccggggcagacguucgaguggcugggcuggaugaagcccgugaccggggcggucaacuacgcccggcaguuccagggccgcgugagcuucuaccggacccgcgagcucggcaucgccuacauggaccugcgggaccugaaguucgacgacaccgccguguacuucugcgcgcgcaagacgaagggggacgucuccggcgacgaccggggguucuucuucgaccucuggggccgcgggacccgggugaucgugagcucc

SEQ ID NO: 11562 - RNA, 381 nt, Artificial Sequence
  derived and/or modified sequence opt1 from anti-HIV-1_HeavyChain
cagguguucauggagcaggccggcgggggcaugaagaagcccggggccagcaugaccgucuccugcaagaccgcggacgaggacguguucgacgccgccuacaugcacugggugcgccaggccccgggccagacguucgaguggcugggguggaugaagcccgucaccggcgccgugaacuacgcgcggaaguuccagggccgcgugagcuucuaccggacccgcgagcucgggaucgccuacauggaccugcgggaccugaaguucgacgacaccgccgucuacuucugcgcccgcaagacgaagggcgacguguccggggacgaccggggcuucuucuucgaccucugggggcgcggcacccgggugaucgucagcucc

SEQ ID NO: 11563 - RNA, 381 nt, Artificial Sequence
  derived and/or modified sequence opt1 from anti-HIV-1_HeavyChain
cagguguucauggagcaggccggcgggggcaugaagaagcccggggccagcaugaccgucuccugcaagaccgcggacgaggacguguucgacgccgccuacaugcacugggugcgccaggccccgggccagacguucgaguggcugggguggaugaagcccgucaccggcgccgugaacuacgcgcggcaguuccagggccgcgugagcuucuaccggacccgcgagcucgggaucgccuacauggaccugcgggaccugaaguucgacgacaccgccgucuacuucugcgcccgcaagacgaagggcgacguguccggggacgaccggggcuucuucuucgaccucugggggcgcggcacccgggugaucgucagcucc

SEQ ID NO: 11564 - RNA, 381 nt, Artificial Sequence
  derived and/or modified sequence opt1 from anti-HIV-1_HeavyChain
caggugcacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugagcuacgcgcggaaguuccagggccgcgucuccuucuacaugacccgggagcuggggauggccuacauggaccugcgcaaccuccgguucgacgacaccgccguguacuucugcgcccgcaagacggcgggcgacgugagcggggacaaccggggcuacuucuucgaccugugggggcgcggcucccgggucaucgugagcucc

SEQ ID NO: 11565 - RNA, 381 nt, Artificial Sequence
  derived and/or modified sequence opt1 from anti-HIV-1_HeavyChain
cagguguacauggagcaggccggcgggggcaugaagaagcccggggccagcaugaccgucuccugcaagaccgcggacgaggacaucuucgacgccgccuacaugcacugggugcgccaggccccgggccagacguucgaguggcugggguggaugaagcccgugaccggcgccgucaacuacgcgcggcaguuccagggccgcgugagcuucuaccggacccgcgagcucgggauggccuacauggaccugcggaaccugcgcuucgacgacaccgccguguacuucugcgcccggaagacggcgggcgacgucuccggggacaaccgcggcuacuucuucgaccucugggggcggggcagccgcgugaucguguccagc

SEQ ID NO: 11566 - RNA, 381 nt, Artificial Sequence
  derived and/or modified sequence opt1 from anti-HIV-1_HeavyChain
cagguguacauggagcaggccggcgggggcgucaagaagcccggggccagcgugacccuguccugcaagaccgcggacgaggacguguucgacgccgccuacaugcacuggguccgccaggccccgggccagacguucgaguggcucggguggaugaagcccgugaccggcgccgugagcuacgcgcggaaguuccagggccgcgucuccuucuacaugacccgggagcuggggauggccuacauggaccugcgcaaccuccgguucgacgacaccgccguguacuucugcgcccgcaagacggcgggcgacgugagcggggacaaccggggcuacuucuucgaccugugggggcgcggcuccugggucaucgugagcucc

SEQ ID NO: 11567 - RNA, 381 nt, Artificial Sequence
  derived and/or modified sequence opt1 from anti-HIV-1_HeavyChain
caggugcagcugguccagagcggcgccgaggugaagaagcccggggccuccgugacccucagcugcaagaccgcggacgaggacgucuucgacgccgccuacaugcacugggugcgccaggccccgggccagacguucgaguggcugggguggaugaagcccgugaccggcgccgucaacuacgcgcggaaguuccaggggcgcguguccuucuaccggacccgcgagcugggcaucgccuacauggaccuccggaaccugcgcuucgacgacaccgccguguacuucugcgcccggaagacggcgggcgacgucagcggggacaagcgcggcuucuucuucgaccugugggggcggggcucccgcgugaucgugagcucc

SEQ ID NO: 11568 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccggggccugagcaccgccuacauggacauccgcggccugacccaggacgacacggccaccuacuucugcgcccggcagaaguucgcgucccgcuacagcggggaccagggcuccuacuucgaccucugggggcggggcacccugaucguggucagcucc

SEQ ID NO: 11569 - RNA, 384 nt, Artificial Sequence
  derived and/or modified sequence opt1 from anti-HIV-1_HeavyChain
caggcccaccuggagcagagcgccuccggcgugcgccggcccggggcgagcguccgcguguccugcuggaccagcgaggacaucuucgagcgguccgagcucaucuacugggugcgccaggccccgggccgggggcuggaguggaucggcuggaucaagcuggucagcggggccgugaacuucggcuccguggacuuccgcgaccgggucagccucacccgcgaccgggaccuguucacggcccacauggacauccgcggccugacccagggggacaccgccaccuacuucugcgcgcggcagaaguucgagucccgcuacacgggcgggcagggcugguacuucgaccucugggggcggggcacccacaucguggugagcucc

SEQ ID NO: 11570 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuacggcucccugaacuuccggagccgcaucucccucacccgggaccgcgaccuguucaccgcccacauggacauccgggggcugacgcagggcgacaccgccaccuacuucugcgcccgccagaaguucgagagccgguacaccgggggccaggggugguacuucgaccucuggggccgcggcacgcacaucgucguguccagc

SEQ ID NO: 11571 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacgguguccggcgccgugaacuucggcagccccaacuuccggcaccgcgucucccugacccgggaccgcgaccucuucaccgcccacauggacauccgggggcugacccagggcgacacggccaccuacuucugcgcccgccagaaguucgagagccgguacaccgggggccaggggugguacuucgaccuguggggccgcggcacccacaucgugguguccagc

SEQ ID NO: 11572 - RNA, 384 nt, Artificial Sequence
  derived and/or modified sequence opt1 from anti-HIV-1_HeavyChain
caggugcaccuggagcagagcggcuccggggucaagaagcccggcgccagcgugcgcguguccugcuggagcuccgaggacaucuucgagcggaccgagcucauccacuggguccgccaggccccggggcagggccuggaguggaucgggugggugaagaccgugacgggcgcggucaacuucggcagccuggacuuccggcaccgcaucucccucacccgggaccgcgaccuguucaccgcccacauggacauccgggggcugacccagggcgacacggccaccuacuucugcgcccgccagaaguucgagagccgguacaccgggggccaggggugguacuucgaccucuggggccgcggcacccacaucgugguguccagc

SEQ ID NO: 11573 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucggccgcgaccgggaccuguccaccgccuacauggacauccgcggccugacccaggacgacacggccaccuacuucugcgcccggcagaaguucgcgagccgcuacuccggggaccagggcagcuacuucgaccucugggggcggggcacccugaucguggucuccagc

SEQ ID NO: 11574 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcaccgugaacuucggcucccugaacuuccggcagcgcgucagccucacccgggaccgcgaccuguucacggcccacauggacauccgggggcugacccagggcgacaccgccaccuacuucugcgcccgccagaaguucgagucccgguacaccgggggccaggggugguacuucgaccucuggggccgcggcacgcacaucguggugagcucc

SEQ ID NO: 11575 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgagggcaucuucgacaccacggagcucaucuacugggugcggcaggcgccggggcagggccuggaguggaucgggugggugaagaucgucagcggcaccgugaacuucgccucccuggacuuccgcaaccggaucagccucucccgcgaccgggaccugagcaccgccuacauggacauccgcggccugacccaggacgacacggccaccuacuucugcgcccggcagaaguucgcgucccgcuacagcggggaccagggcuccuacuucgaccucugggggcggggcacccugaucguggucagcucc

SEQ ID NO: 11576 - RNA, 384 nt, Artificial Sequence
  derived and/or modified sequence opt1 from anti-HIV-1_HeavyChain
cagagccgccuggagcaguccggcagcgccaugaagaagcccggggccuccgugcgggucagcugcuggaccuccgaggacaucuucgacaccacggagcucaucuacugggugcgccaggcgccgggccaggggcuggaguggaucggcugggugaagaucgucagcgggaccgugaacuucgccucccuggacuuccggaaccgcaucagccucucccgggaccgcgaccugagcaccgcccacauggacauccggggccugacccaggacgacacggccaccuacuucugcgcccgccagaaguucgcgucccgguacagcggcgaccagggguccuacuucgaccucuggggccgcgggacccugaucaucgugagcucc

SEQ ID NO: 11577 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucgagucccgcuacaccgggggccaggggugguacuucgaccuguggggccggggcacccacaucguggugagcucc

SEQ ID NO: 11578 - RNA, 384 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccuccagcgacuuccgcaaccggaucucccugagccgcgaccgggaccucuccaccgccuacauggacauccgcggccugacccaggacgacacggccaccuacuucugcgcccggcagaaguucgcgagccgcuacuccggcgaccaggggagcuacuucgaccuguggggccgggggacccucaucaucguguccagc

SEQ ID NO: 11579 - RNA, 384 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagaucguguccggcacggugaacuucgccagccuggacuuccggaaccgcaucucccucagccgggaccgcgaccuguccaccgccuacauggacauccggggccugacccaggacgacaccgccacguacuucugcgcccgccagaaguucgcgagccgguacuccggggaccagggcagcuacuucgaccucugggggcgcggcacccugaucgucguguccagc

SEQ ID NO: 11580 - RNA, 384 nt, Artificial Sequence
  derived and/or modified sequence opt1 from anti-HIV-1_HeavyChain
cgccacaccugggagcagagcggcuccggggugaagaagcccggcgccagcguccggguguccugcuggagcuccgaggacaucuucgagcgcaccgagcugauccacugggugcggcaggccccggggcagggccucgaguggaucgggugggucaagacggugaccggcgcggugaacuucggcagccuggacuuccgccaccggaucucccugacccgcgaccgggaccucuucaccgcccacauggacauccgcgggcugacgcagggcgacaccgccaccuacuucugcgcccggcagaaguucgagagccgcuacaccgggggccaggggugguacuucgaccuguggggccggggcacgcacaucgucguguccagc

SEQ ID NO: 11581 - RNA, 384 nt, Artificial Sequence
  derived and/or modified sequence opt1 from anti-HIV-1_HeavyChain
cgccacaccugggagcagagcggcuccggggugaagaagcccggcgccagcguccggguguccugcuggaccagcgaggacaucuucgagcgcacggagcugauccacugggugcggcaggccccggggcagggccucgaguggaucgggugggucaagaccgugaccggcgcggugaacuucggcucccuggacuuccgccaccggaucagccugacccgcgaccgggaccucuucacggcccacauggacauccgcgggcugacccagggcgacaccgccaccuacuucugcgcccggcagaaguucgagucccgcuacaccgggggccaggggugguacuucgaccuguggggccggggcacgcacaucgucgugagcucc

SEQ ID NO: 11582 - RNA, 414 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcgguccgagcucauccacugggugcgccaggcgccggggcagggccuggaguggaucgggugggucaagaccgugacgggcgccgugaacuucggcagccccaacuuccggcaccgcgucucccugacccgggaccgcgaccucuucaccgcccacauggacauccgggggcugacccagggcgacacggccaccuacuucugcgcccgccagaaguacuacgccgggggccaggggugguacuucgaccuguggggccggggcacccucaucguggugagcuccgcgagcaccaaggggcccuccgucuuccacgaccugcgc

SEQ ID NO: 11583 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagaucguguccggcgccgugaacuucggcagccccaacuuccggcagcgcgucucccugacgcgggaccgcgaccucuucaccgcccacauggacauccgggggcugacccagggcgacaccgccacguacuucugcgcccgccagaaguucgagcgcgggggccagggguggaucuucgaccuguggggccggggcacccucaucgcggugagcuccgccagcaccaaggggcccuccguguuccccaccaucugcguc

SEQ ID NO: 11584 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaaggccgugagcggcgccgugaacuacggcucccuggacuuccgccaccgggucagccucacccgcgaccgggaccuguucacggcccacauggacauccgcgggcugacccaggacgacaccgccaucuacuucugcgcgcggcagaaguucgcccgcggcgaccaggggugguucuucgaccucuggggccgggggacccugaucgugguguccagcgccuccacgaagggccccagcgucuucccccacgaccugcgc

SEQ ID NO: 11585 - RNA, 417 nt, Artificial Sequence
  derived and/or modified sequence opt1 from anti-HIV-1_HeavyChain
caggcccaccuggagcagagcggcuccggggugaagaaggucggcgccagcgugcgcguguccugcuggaccagcgaggacaucuucgagcggaccgagcucauccacuggguccgccaggcgcccgggcagggccuggaguggaucgggugggugaaggccguguccggcgccgucaacuacggcagccuggacuuccggcaccgcgugucccucacgcgggaccgcgaccuguucaccgcccacauggacauccgggggcugacccaggacgacaccgccaucuacuucugcgcgcgccagaaguucgcccggggcgaccaggggugguucuucgaccucuggggccgcgggacgcugaucguggucagcuccgccagcaccaagggcccguccguguucccccacgaccugcgg

SEQ ID NO: 11586 - RNA, 417 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccuguucaccgcccacauggacauccgggggcucacccagggcgacaccgccacguacuucugcgcgcgccagaaguucuacgccgggggccaggggugguacuucgaccuguggggccggggcacccugaucguggugagcuccgccagcaccaaggggccguccgucuucccccacgaccuccgc

SEQ ID NO: 11587 - RNA, 423 nt, Artificial Sequence
  derived and/or modified sequence opt1 from anti-HIV-1_HeavyChain
cagguguacauggagcaggccggcgccggggucaagaagcccggcgcgagcgugacccuguccugcaagaccgccgacgaggacguguucgacgccgccuacaugcacuggguccgccaggccccggggcagacguucgaguggcucggcuggaugaagcccgugaccggggcggugagcuacgcccggaaguuccagggccgcgucuccuucuacaugacccgggagcugggcauggccuacauggaccugcgcaaccuccgguucgacgacaccgccguguacuucugcgcgcgcaagacggccggggacgugagcggcgacaaccggggguacuucuucgaccuguggggccgcgggucccgggucaucgugagcuccgccagcaccaagggccccuccguguucccccacgaccugcgc

SEQ ID NO: 11588 - RNA, 426 nt, Artificial Sequence
  derived and/or modified sequence opt1 from anti-HIV-1_HeavyChain
cagagccaccuggagcaguccggcagcgccaugaagaagcccggggccuccgugcgcgucagcugcuggaccuccgaggacaucuucgacaccacggagcucaucuacugggugcggcaggcgccgggccaggggcuggaguggaucggcugggugaagaucgucagcgggaccgugaacuucgccucccuggacuuccgcaaccggaucagccucucccgcgaccgggaccugagcaccgccuacauggacauccgcggccugacccaggacgacacggccaccuacuucugcgcccggcagaaguucgcgucccgcuacagcggcgaccagggguccuacuucgaccucuggggccgggggacccugaucguggucagcuccgccagcaccaagggccccuccguguuccccacgaucuacgug

SEQ ID NO: 11589 - RNA, 372 nt, Artificial Sequence
  derived and/or modified sequence opt1 from anti-HIV-1_HeavyChain
caggugcagcugguccagagcggcgccgaggugaagaagcccggggccuccgugaaggucagcugcaaggcguccggcgggacccucagcuccuacgccaucagcugggugcgccaggccccgggccaggggcuggaguggaucggcugggugaagaccgucacgggcgccgugaacuucggguccgccugcuuccggcaccgcgugagccugacccgggaccgcgaccucuucaccgcgcacauggacauccggggccugacccagggggacacggccaccuacuucugcgcccgccagaaguucuacaagggcgggcagggcugguacuucgaccuguggggccgggggacccucaucgucguguccagc

SEQ ID NO: 11590 - RNA, 372 nt, Artificial Sequence
  derived and/or modified sequence opt1 from anti-HIV-1_HeavyChain
cacgugcgccugguccagagcggcgccgagguggagaagcccggggccuccgugaaggucagcugcgagaccuccaacuacccguucaacauguacggcaugaccugggugcggcaggcgcccgggcagggccucgaguggaucgggugggugaagaucgucagcggcgccgugaacuucggcucccccaacuuccgccagcgggugagccugacgcgcgaccgggaccuguucaccgcccacauggacauccgcgggcucacccagggcgacaccgccacguacuucugcgcccggcagaaguucgagcgcgggggccagggguggaucuucgaccuguggggccggggcacccugaucgcggucuccagc

SEQ ID NO: 11591 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacguguucgagcggaccgagcugauccacuggguccgccaggcgcccgggcagggccuggaguggaucgggugggugaaggccguguccggcgccgucaacuacggcagccucgacuuccggcaccgcgugucccugacgcgggaccgcgaccuguucaccgcccacauggacauccgggggcucacccaggacgacaccgccacguacuucugcgcgcgccagaaguucuacgccggcgggcagggcugguacuucgaccugugggggcggggcacccugaucguggucagcucc

SEQ ID NO: 11592 - RNA, 375 nt, Artificial Sequence
  derived and/or modified sequence opt1 from anti-HIV-1_HeavyChain
cgccacaccugggagcagagcggcuccggggugaagaagcccggcgccagcguccggguguccugcuggagcuccgaggacaucuucgagcgcaccgagcugauccacugggugcggcaggccccggggcagggccucgaguggaucgggugggucaagacggugaccggcgcggugaacuucggcagccuggacuuccgccaccggaucucccugacccgcgaccgggaccucuucaccgcccacauggacauccgcgggcugacgcagggcgacaccgccaccuacuucugcgcccggcagaaguucgagcgcgggggccaggggugguacuucgaccuguggggccggggcacccucaucgucgugagcucc

SEQ ID NO: 11593 - RNA, 375 nt, Artificial Sequence
  derived and/or modified sequence opt1 from anti-HIV-1_HeavyChain
cgccacaccugggagcagagcggcuccggggugaagcggcccggcgccagcguccgcguguccugcuggaccagcgaggacaucuucgagacgaccgagcugauccacugggugcggcaggccccggggcagggccucgaguggaucgggugggucaagaccguguccggcgcggugaacuucggcagccugaacuuccgccaccgggucucccugacccgcgaccgggaccucagcacggcccacauggacauccgcgggcugacccaggacgacaccgccaccuacuucugcgcccggcagaaguucgcccgcggcgaccaggggugguucuucgaccuguggggccgggggacgcucaucgugguguccagc

SEQ ID NO: 11594 - RNA, 381 nt, Artificial Sequence
  derived and/or modified sequence opt1 from anti-HIV-1_HeavyChain
cagguguucauggagcaggccggcgccgggaugaagaagcccggcgcgagcaugaccgucuccugcaagaccgccgacgaggacguguucgacgccgccuacaugcacugggugcgccaggccccggggcagacguucgaguggcugggcuggaugaagcccgucaccggggcggugaacuacgcccggcaguuccagggccgcgugagcuucuaccggacccgcgagcucggcaucgccuacauggaccugcgggaccugaaguucgacgacaccgccgucuacuucugcgcgcgcaagacgaagggggacguguccggcgacgaccggggguucuucuucgaccucuggggccgcgggacccgggugaucgucagcucc

SEQ ID NO: 11595 - RNA, 384 nt, Artificial Sequence
  derived and/or modified sequence opt1 from anti-HIV-1_HeavyChain
caggugcaccuggagcagagcggcuccggggucaagaagcccggcgccagcgugcgcguguccugcuggaccagcgaggacaucuucgagcggaccgagcucauccacuggguccgccaggccccggggcagggccuggaguggaucgggugggugaagacggugaccggcgcggucaacuucggcucccuggacuuccggcaccgcaucagccucacccgggaccgcgaccuguucaccgcccacauggacauccgggggcugacgcagggcgacaccgccaccuacuucugcgcccgccagaaguucgagucccgguacaccgggggccaggggugguacuucgaccucuggggccgcggcacgcacaucguggugagcucc

SEQ ID NO: 11596 - RNA, 417 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccugagcaccgcccacauggacauccgggggcucacccaggacgacaccgccacguacuucugcgcgcgccagaaguucgcccggggcgaccaggggugguucuucgaccuguggggccgcgggacccugaucgugguguccagcgccuccaccaagggcccgagcgucuuccccaccaucugcgug

SEQ ID NO: 11597 - RNA, 417 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucuacgccgggggccaggggugguacuucgaccuguggggccgcggcacccucaucgugguguccagcgcguccaccaaggggcccagcgucuuccccacgaucugcgug

SEQ ID NO: 11598 - RNA, 417 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacguguucgagcggaccgagcugauccacuggguccgccaggcgcccgggcagggccuggaguggaucgggugggugaaggccguguccggcgccgucaacuacggcagccucgacuuccggcaccgcgugucccugacgcgggaccgcgaccuguucaccgcccacauggacauccgggggcucacccaggacgacaccgccacguacuucugcgcgcgccagaaguucuacgccggcgggcagggcugguacuucgaccugugggggcggggcacccugaucguggucagcuccgccagcaccaagggcccguccguguucccccacgaccuccgc

SEQ ID NO: 11599 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagaucguguccggcgccgugaacuucggcagccccaacuuccggcagcgcgucucccugacgcgggaccgcgaccucuucaccgcccacauggacauccgggggcugacccagggcgacaccgccacguacuucugcgcccgccagaaguucgagcgcgggggccaggggugguacuucgaccuguggggccggggcacccucaucguggugagcucc

SEQ ID NO: 11600 - RNA, 384 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaagacggugaccggcgccgugaacuucggcucccucgacuuccggcaccgcaucagccugacccgggaccgcgaccuguucaccgcccacauggacauccgggggcucacgcagggcgacaccgccaccuacuucugcgcccgccagaaguucgagucccgguacaccgggggccaggggugguacuucgaccuguggggccgcggcacgcacaucgucgugagcucc

SEQ ID NO: 11601 - RNA, 426 nt, Artificial Sequence
  derived and/or modified sequence opt1 from anti-HIV-1_HeavyChain
caggcccaccuggagcagagcggcuccggggugaagaagcccggcgccagcguccgcguguccugcuggagcuccgaggacaucuucgagcggaccgagcucauccacugggugcgccaggcgccggggcagggccuggaguggaucgggugggucaagaccgugacgggcgccgugaacuucggcagccuggacuuccggcaccgcaucucccucacccgggaccgcgaccuguucaccgcccacauggacauccgggggcugacccagggcgacacggccaccuacuucugcgcccgccagaaguucgagagccgguacaccgggggccaggggugguacuucgaccucuggggccgcggcacccacaucgucguguccagcgcguccacgaaggggcccagcguguuccccaccaucugcguc
